United States Patent 8,781,750 (CELL-TYPE-SPECIFIC PATTERNS OF GENE EXPRESSION) - sequence listing, part 36

SEQ ID NO: 37417 - DNA, 116400 bp, Homo sapiens
ttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaaggtacgggcgtgccgggccacctgcgccgggaggcgcgggtctttgggggtgggggtgggggtgggggggtccctccgatttccgccgagagaacttcccagcccatccagccgcatctgcaaactcaggagtgcgaacccctctttggaggcttttcagggtctttcgcgccggggcggggccagagcagcggcgagcgcggcggggggcttgcatctttgtcgcgggtctccaggggaggcgactgcgccatgcgcaataataaaacccgcgccctgcccacggcggctgagcctttctgcgcactcttccggtgggagccatgcagcccgaggcggaggagctgcgcggagggggatccgtggagaatggaccccgggccgggcctccggagctccgagatgcggaaagtcagctgtgaggccaggactcgtggtggagcccgccggggagcccagccaccctcgggttccccgtcgcgtaccgccctggatgccagcggtgcctggagcgagcgggtttggtacccagtcctcctgcggcagcggcccgagcaggcaccgccttcccgaggcagagaaagcctggggtgtagctcgctcagagccaggaaaaacctgggcaggcgctgcgtttccagaaggaatgacaggtttcgcaaaccagccagcgccctcgcgttcgctcagcgctttgcctgcagactcagttggccaaacacacgctagagtggctagaagttctcaaaggatggggtcagtgtaacgagcattccgggtactcttccctggacgcagtgctgaaacgactgcattttatcggcttcagtcttcaaggctggaatatttcttgtgggccaggacagccgccaagactgtggcttgttctggtcgtggtattttagatctattttccagcgcatgtgttcattagcaaggcttcactctactgattttgtgatacccttgtatcacaaaggtacccttgtgataccttgtagaaagatgtggataaccatgtttaatagttaaatttgcggtatgtcaaatttgaggatagagtacgtgagttatcgcaggaggtgtagatgtttacaatatgcaaaaaaaaaaaaaaaaaggaacctacaaccatgacctaattgccttgacctccttagctgccctagtctcttttgggctgagagactgctgttaataatatagtttttaccgccagtctttgattcataactacttgtaaaatccatggtccctagatattaagtactaactgtgtctctgtgctatgtaggtttttctaagagatgcttaagcttctggcctgaggaatgtactgtccttttgagattcaagtcgcattttaatacttactgtatgcacataatgttttgatgccagctactgtcaaagtggctctgtaaccagtggtcagagtctagcgatgaaaataattttaaggtataattgctaaaaacttgcagttgggtgacattccccccaccgccccggcttttatactccttcagatcttactaactgttcaccctgaaatatgggatttaatcccttcccagtaaacttgaatttgtttatttaaaaatattccttccattctctttttccgtcttccataaccttatccttttcctctttccaagttgccaaccgtcttgaagcaaccaaacaacctccttttaaaaaatcacttaaatgacatccagaatatcattgaacttgttggcataatgcccagttatcaatttggagacaaatcagtgcacttacatgtatccttggaatgtatttagttttcatttgaactagccaaatttatcactcaggctttgaacacaaatgtcttttcaaaaggactccccaattaagaatgactcagcaccatggcccttgcctcccctcttcttgttaagctccaattcctgacctccaagtaatcccatctcccactctaggctccgtggcaccatggacccgtcccagcagttttcacatgtgtgggtttagtgttcttgctgttgtgaatacttcgcaggggcagggaacacgcctggttgtgccgaccaacggtgttccttcatgcgtgccatgttgcctggcacagaggcagctctcaggaatacttgtggaaagaggaaggggtgatattggctccttggttttgattggaaaatatcaagttggagaataccttgacctatctgattttactacaatttaacccttgatcatttcattatcacgtgagactgattatgatagtgactaaggcaagtcagtctgttcggttattaatagatcaagtgaatagtttgaccaaaaacttcagatttgggggctttggattctgtttctctagatatagagtgacttgttagcattgcaatttcaaattgcgttttatcttaaatagacaaatatatgaagtgcatatggctcaaatgagtccatttcataccctgagttacttaggattacatcttgaacttccttgatgtgtctgtggacggttggggaggtttaggctaatacatcatttttccctccttggatagaatgtggtcattaattaaaggttgtaggcagatctttttctatctaatagctgacatttatatcacatgcatgctatctatttagcaattggatttactttcctttttttctgctagttttagttaccagttattcactaagtgcccttatctgaacagacattacactggttgaattatcacttgtattaggtcaaatggagagttaaacaagcttttgattactcaggcttaacgtttagatgcactaaagcagaagtcttggttttatctatggttcatttctgtaaaatggaaggagtctttatcttctattcaatcttttgtaatctttattttttccgttagatccagagatagactggaaatcttttacagtctttatatgtaagatccaggcgggggcagggggaatggcttggtctgttatctgccagggtttaattttgagacatggccgtttcacaactgcagggtgcgggaagattagatgacctgaatgctggtggtaagtaaagcctcacacttcacattattccttaattgtctgtttttaaaaatttgtcttaaaaaaatattaaggtggcaacatattcaggtggcaacagagggtggggtgaccagtgacaaactgacttccatgtctctggctaatcttgatttctggagccaggctccagactaagtctggacaatcaattaattagcctttctatatgtattgcctgatgaatgatttcaatgctggacattgaacaatggtctgttgcaacagggtgaggccattgtctctggcaggtggggagatgggggctcttgttagctccatttgattacaagagccttgaatcaccaaaacataaagatgtactcgaatagaagagtccgttgtctgactggtaaatttaaggatgtgtttgaccctcgtgcattaaaacagacaattggccgggtgcggtggctcacgcctgtaatcccagcactttgggaggctgaggcaggcagatcacaaagtcaggagatccagaccatcctggctaacacggtgaaaccccatctctactaaaaatacaaaaaattagccaggcgtggtggcgggcgcctgtagtcccagccactcgggaggctgggacaggagaatggcgtgaactcgggaagcggagtttgcaatgagccgagttggcgccactgcactccaatctgggcaacagagcgagactctgtctcaaagaaacaaacaaacaaacaaacaaaaccagacaattgaggcggccagctgcatttcataattcctcccataagcttcctcctatttgccacttgtttagcaatggaaatggagaacgaagatggcctcaaagtgactacatcaccagtgttacaaaaatgggccagaatttaaggcaagaattatatgtttcttaatagagggatgtttctctgtgtgtggctacttgtattcctgtggatttttaccagattataagagctgctaatttctgatcagaacagagaccaaaaattggagatatggatgtggggatgattcttttgggtaccgatagactgcaggaatcgcagggcttcctttaaatccattacagcttataggctagtggatgaataagataagtggagattttctcttgaaatatttccttctatgaagaaaaggccttgaaatgtgcatcctctttgggttgactaatttctatgcctttacagctttaagctgacattataagattattctagtttggatcttgtaagataattaacaaaatggaaataaaatgttttgtttttaaaaatgctaataaattatttattttcctttgtcttagttagttttaatacatattcagtgcttaaagaacaccagtgcaggaaaactcaaactaaatggcatcatcccccatctctataattctatatgcagtagccattcatgcgaagttagaaattagaatttatagcactaagcattctaagaaaaattaagccagtacgtttatctcttgaaaaaaaaaaaagcaactaaatttccttgaaccgaattcttttttttggctcactgcaacctttgcctcccaggttcaagcgattctcctgcctcagctttccgagtcgctgggattacaggcacccaccaccacgcccagctaagtttctgtatttttagtagagatggggtttcaccatgttggccaggctggtctcaaactcctgacctcgtgatccacccggctaaggcaggagaatggcgtgaacccgggaggtggagcttgcagggagccgagatggcaccactgcagtcaccactgcagtccagcctgggcgacagagagagactccgtctcaaaaaaaaaaaaaaaaaaaatcaaaagcatgtgtttacccttattaatgatttttatttaaagtcattgcatagcaatattcatttaatgtttattttttaaaaaaattaatgattgagaacttaaatttataagtagggtaaattactcacaaatttaagtaaaatttgaagccaatatgatggcttcttacatattctttcgaaaacttcatgcacatgaaagtagataaaaatggcacagtcttttccatttaagaaaaagatcatatcacatatagatttaggttttggatgtcttttcatatcaggacataaataactgcccccattcttattaatttgggtgcataaatttcccttttgtgggttgaagccctgtaacgatttaaccaattccttgggtttatatttagattgtcctcgtccataagtgtaattgctgaattgcaagctttatatgcatttaaaaatttaacccggcaaggtgcggtggctcacgcctgtaatcccagcactttgggaggccgaggcaggtgaatcacaaggtcaggagttcgagaccagcctggccaacatggcgaaacctcgtctctactaaaaacacaaaaaattagctgggtgtggtggcaggtgcctgtaatcccagctacttgggaagctgaggcaggagaatctcttgaacctgggagggggaggttgcagtgagctgagatctcaccactgcattccagcctgggtgacagtgcaagactccgtctcaaaaacaaaaacaaaaacaaaaacaaaaaatttaacccttcctaaattgactttccaaagaggttctaccactttgcagttccaccgtggagatcagcactcgttttcccatgctttgccttcatgggtatcagattttccaatacttgccaatgtgctaggtgaagaatggtacctcagtttccttggtgcatttttaactgtgaagttgaatgcctcatcatgtttctctgccatgtgcttgccatctgatcatgcactggtctggctgtcagagcatgaaaggctatggtttgtttcactgttaattaattttcattttcattttcatttaactttaattttatttatttattgtttttgagataggctctcattctgttgcccagtgtggaatgcagtggtgcaatcttggtttactgcagcctcgacctcctgggctcaaatgaccctcctacttcagcctcctgagtagctgggactacaggcacacaccaccaggtagctgggactacaagtgcacaccaccatgcctggctaattttgtttatttttggtagagacaaggtctcactgtgttgcccaggctggtctggacctcctggactgaagtgatcctcccacctctgcctcccaaagtgctgagattacaggtgtgagcccccatgccctgcccaattaatttttaaagatttttttttctagccaggtgtgggggctcacacctgtaatctcagcactttgagaggccaagaagggaggatcacttgagagaaagttcaagagtggcctgggcaacatagcaagaccccatctctacaaaaaataaaaaatttagctgggtgcggtgacgtgtacctgtagtcctagctacttggaaggctgaggtgagaggattgcttccacccaggagtatgaggctgcagtgagctatgatcatgctactgcactacagcctgggtggcagagcaagaccctatctctatttaaaaaaacaaaacaaaacaaaaaaacaaaaaaactttttccccagaaattaatcaaattggaaaaaagcaagttcaagaataaaaacgcagctgaggtagagcagtcttactctcctttgctccttttcctttccaaattaatgaaccatctttaaatttatttgcttggaggatgacctacttctttagctatcacttttaaaatttcttctcttggaacaatctaaaatcatttagttgccagaaattactttgtggtcatgatccgtgaaatgttgagatcagggattggaagcagcagaaatccacctcttgggaaaacaatagagtgaaggcttacccgggatcctctcccgttctcacggcaaacagcctggctctgttaactggatggtatacatggattttctgagaaaaatgtaggtgttcaaagcacaggaaaccatctgggacaccgggacaccattaggcacctcttaatacaagtattcatttcaggttcaaagctttttgtcttccctgtgatttctctgtgatgttttttaaatgggggaaaccctgtagtttctctctgcctaatcttaatcccagttgtagtagcatgtcagtttcatgtttgatttcaaaacgaaataaaccaaaatttaagaaggagagattactgcagtttattggctgaccatctatttgttatatgcaaatactgcaaactgggagtattgaaggattaaatttttcctaattcccaaacctggtggtgctattgaatcacctagagagcttttcaaagacacccctacacctcatcctggatttattgaattagaatcccaggcaatctcagggtctgggattctgtgatttttttttttttttttgagagacagggtctcactgtgtttcccaggctagtcttgaactcccggactcaggccatcctttggcctcagcctcctgagtaactgagactaccagctcctgccactgtgctgggattctgtagtcttaaaatgctcatcagatattctaatgtgtggggtgtgggctccattaccttaagggaggggaaggagtaggcgtaagagctgaataagggccagggagaggttcaggtctaggtgacactgggtgatagcatgtgcagatttcactgagattggaacttgtgtgggtgagagggacggtttcacatgatgaaagagtagcattttccttcacacatctggaggataaaataaaggaaaatatttcttccacataatttcattcctttgtttgactatattaaaaagtgggttgctggccgggcatggtggctcacgcctgtaatcccagcactttgggaggccgaggcgggcggatcacgaggtcagcagttcaagaccagcctggccaacatggtgaaaccccatctctattaaaaatacaaaaattagccagtatggtggtgtgtacctgtaatcccagctactcgggaggctgaggcaggagaatcgcttgaacctaggaggtggaggttgcagtgagccgagaccgcatcattgcactccagcctgggcgacagagcaagactctgtctcaaaaaaaaaaaagtggattgctaacggaggctttttaaaatagattgtgccattcaaggtaagtaggtgttcagtgaaatgcccgtatccctactgagccagaagctgtgacttttcggtgttccccttccatctcattgcctcctaagccctcttcccttatttatcattttaaaacttcccttgtgctgaataagtagacagtagctaagggcttagtttatggcatttgactggtccaaaaatctgtaaagaaattttaaaacctaccaagttgttgaagaatagagttctggctttctcagccacttactattcaatcttgatttcataaatatttctgttttaatttcttccatttattttttaatataatagagacaaggtctcactgtgttgccaaggctggtctcgaactcctgagctcaagtgatcctcttgccttggcctcccaaagtgctgggttacagggtgagccacctacgcctggccatttcataaatacttctttactagcttctgtactccaggaactgtgctaggaactggggaaacagaagttcagttctaaaaaagttaaagttctctctttcatatatttagatctttattccactagctactgatgatgtctagaaggagaaatcttaaattcatttttatatgggttacctattgctccagtaccattgattaaaaagttacctcttgttaaaactcaagtttccatatatgcataaacctgtttattgatttccttttacttttaaattttttctgctgtgtctatttgtgcaataaactgaaagcattgtgggagtggctaaacatctgatcaattataatagcaagcccatggtttaaaatagttttatattctacatctcaagtgttacccttgtctctttcatggctatggtgagttcatacatacataaataccaacatgtggctcgtgggcatggtggctcacacctggtgggcatggtggctcatgcctataatcccagcacttcgggaggtgagggtgggaggatcacttgagcctaggagttcaagatcagcctaggcagcatagtgagaccccactgctacaaaaaatttaaaaattagccgggtgtggtggcacatgcctgtaattccagctagttgggaggctgaggtgggaagatcactagagcccgggaagttgaagctgcagagaccctgtctcaaaaaaataaataaataggctgggcgttgtggctcacgcgtgtaatcccagcatttgggaggctgaggcaggtggatcatttgaggtcaggagtttgagaccagtctgaccaacatggtgaaactccgctttactaaaaatacaaaaaagttagccgggtgtggtggcgcctgcctgtagtcccagctactctagaggctgaggcaggagaatcgcttgaacacgggaggcggagcttgcagtgaagccgagattgcaccactgcactccagcctgggtgacagagtgagactccatcttaaaataaataaataaataaataaaataagaaaatgggaatcgtgtgttcttttaagcttagcttgttttcttggtatgtaatagcattcattaaaaatggtcagatattttcctttttttttttgagacggagtctcgctctgttgcccaggctggagtgcagtggcgcgatctcggctcactgcaaactccgcctcccgggttcacgccattctcctgcctcagcctcccgagtagctgggactacaggcgcccgccaccacgcccggctaattttttgtatttttagtagagatgggggtttcaccgtgttagccaggatggtctcaatctcctgacctcgtgatccacccgcctcggcctcccaaagtgctgggattacaggcgtgagccactgcgcccggccaaaaatggtcagatattttctaaccacatacttatgttctagatgctttgggagataaagaaataaaaacattacccttgaacacctcataattgagatgaggtaaggcctttctagatgaaatattcaacagcaaagattccaataagttggctaggtaatagaagaattgccattagtactactgtaaaaaaaagaatttttgggaaagtgttctaggcagataagaggccattagtcaggaggccttctggtacaagacgtattgagttggtagttcttaaggaaacaatgaaagaggataagttgcagcccgtcgatgttaagagctgcagaggcaatagagagccactgccggcttttgacaatgaacaaaacaaagtttcagaaataccaggtgagtgcgtcgtgaacccctgggagaccctcttgtataaggcagagataacatccgcacagtaaagtggtgggaagtgtgactagaaagggtgacttcagggagattatgttggcaagcattttcacagtgtggtagtgacatctcagatatcagtggggcagtgagatttggcacagggtagaggcttggcatgggggtaagtcacaaacaatgagattttaagagttggaagatggagtacctctatttctccaatagtctgacaagaacatctactccatgatgttggtttcagttatctactggtgtgtaacaaaccatgccaaaaaatttatactaagggtacctttagaacagagaacatcacttgataataacaacttgggactttaaagtaatgcagaggtttggccgggcacagtggcgcacgcctgtaatcccaatactttgggaggccgaggcgggcagatcccctgaagtcaggagttcaagattagcctggccaacatggtgaaaccctgtctttactaaaaatacaaaaattagccaggcatggtggcacgcgcctgtagtcccacctacctgggaagctgaggcacgagaaacccttgaacccgggaggcggaggctgcattgagttgagatcgctctgctgcacttcagcccgggcaacagcgtgagtgagactctgcctcaataaacaaataaataaataaatagaagtaaagcagaggtttgaggcagactctctagataatgacagagggcttccgtgaactcaaagcatttctctaatagtggtctgcgtcacagcagagaccactggcattggaggccatcgaggcttttggagtattgggcaagggaggcacagctgaaggtcaagtttctttctttttttttttttttctgagatggagtctcgctctgtcactcaggctggagtgcagcagcgcgatctcagcttactgcacccccgcctcccgggttcaagattctcatgcctcagcctctcgagtagctgggactacaggtgcaggccaccatgcctggctaatttttctatttttagtaaagacagagtttcagtatgttggccaggctggtctcaaaatcctgacctcaggtgatccacctgttttggcctcccaaagtgctgggattacaggcatgagccaccgtgcctggccagaaagtcaagttttttaggaaaagagatgatcaacactgaaggccccgatagtggctatggagaagtgcaggtggaaccaaagtgagtcttagtagaagagaggactagaggtgagcatggtggctcatggtggacctggtattcccagtactttgggaggccaaggtgggaagatcatttgactacaggcatttgagaccagcctggacaagataccaagacccctgtctctgggaaaaaaaaaaaaaaaaaaaaaagatgagaaaacgagataaaagagatgccgccggatgagcagttggcagatcgtgatggcatcatgccacagtgactgttctatcccagcatggctgggtgcacctaaaaaatgaaagagcctggtcattgactgtattccttccatttgtaggcaaagaaatgaggttgcttggggaatgcgtgtctttccctccagagaagacattttcgctttgtaatttttccatccccagtgtctgccctttggtttgttgttcagaaaacaatttatgatttatttttctttgtgtctgagcctatgatttttttattgaattgagccattacaggccctgggttttacctgccacaatgatgaatttctattgtcactccctgatattgaccacttttagtgaagacatgcttcattggctcctagttttcttcactctgtaaagtatattttgttgtgatacgtaagacaagattgttgatgcatttcacagtttttaacctctttatgttttcagttcttggtgataatttttcacaaagttataggaaattactcaaagaatatgtctttagaaactttcgtttgaaattgtttttcatttggatacatatgtaaaagtcttttgttcgttttaatttttttttcttttaaaataaaaagagacaggtcttgctgtgttgcccaggctggtctcgaattcttgggctgaaaggatagtcccacctgggcctcctgaaattaaaattacaggcatgagccactgcacccggccaaaacagtcttattcaacatcaataatatattgaatcctatagaaacttcaaccttaggtggcctatctactttgaacttacacttgatatgcactgcagtacaaactgggagggagagggggaataggattgtagtctacaagagattgctaagaattagccaattttgctatgatgatttttttcacaaatgacttttttttttgaggcagagtcctgctctgttacccaggctggagagtgcagtggtgctcactgtgacctctgcctcctgggttcaaacaattctcttgcctcagcctcttgagtagctggaattacaggtgtgagccaccacacctggctaatttttttgtatttttagtagagacggggttttaccatgttggcctggctggtctccaactcctgacctcaggtaatctgcctccctgggcctcccaaagtgctgggactacaggtgtgaaccactgtgcccggccagaaatgacgtatttatccaatacttagacatgagttcctgattcctatattgttaacctaaatatttaaatggaaatttttgttcttgttctgctctgttttacatgaaataagctattgaaaagcagtggaacatgtcactacaaaagtttactaaattagtcttgaccattacaatctttgtattccactgacaaaagcagtggaataaaatttaaacaaaaaatagttgaccttaatgtgggcaaaaacccagttgattggttttatagctgatttattttctttgtaaaaccttcaggaactaaagtttagtctgaactcagtttgatggcagttttagattagtcttttttgtttgagacggagtttcactctgttgcccaggctggagtgcagttgtgtgatctctgcttactgcaacctccgcctcccaggttcaagagattctcctgcctcagtcttgcaagtagctgggattacaggcatgcgccaccacactcggctaattttgtatttttagtagagaccgggtttcgccaagttggtcagactgatgtcgaactcttgatccacccacctcggccttccaaagtgctgggatcaaaggtgtgaaccactgcgcctggccttagatcagtcttcattttgttgataatacagaaagctcatttagccttgattaagacaacgatcggttattcgtttgatattcgttaaagacttactgaggtttttgaatttttgtcctaaactgagaatctggtgactgaagagggcttacaattttatcttgaatcgcaacaatgacagagatttcaagtcacttctggaactgtgcctgataaacaatctctgcatgacagggaggaatgcaaagaatgcttaagtattcagggaagtaggtcatgttaaagtattacatttgtcagagaaagtttctcaagcagtccctgtgatcttcagaacccagcttgttcttcgcccagaatgctttagttgtaggcaaatttgggggctgaattaacttcccagccgctaggagggctggactgaaagtcacagattcagcacatgtgcctgcacccttgtcaacaaaaatgaagttacagttataggcaggtgactggaaaaacagtagatgggattgataaatgtttttgttttttttttgagacggagtttcgctcttgttgcccaggctggagtgcagtggcacgatctcggctcacggcaacctctgcctcccgggttcaagcagttctcctgcctcagcctcctgagtagctgggattacaggcatgcaccaccacgccggctgattttgtatttttagtagagacgaggcttctccatgttgagggtggtctcgaactcctgacatcaggtgatccacctgcctcggcttcccaaagtgctgggattacaggcgtgagccaccgcgcctggctgggattgataaatgttgtttctttattgtgggatcctggaataaaaattgtttagagtcaggcgtagtggctcatgcctgtaatcccagtgctttgagaagccgaggcaggagggtcactcaagcccaggagttaaacaccagcctggccaacatactgggaccctgcctctacaagaaattagccaagcatggtggcatgtgcctatagtcccagctactcaggaggctgaggtgggaggattgcttgagccagggaggtctgggctacagtgagtcgtggttgaaccactgcactccagcctggatgacaggttatccaaaaacaaaacaaaaaaattatttaaagagcaaaaagcaagcgctaatggacaattgatgtgtaaataaatttaggaagaagggaaaaccagagagagccttttaactgaacttgaacttggggtctttctttgctgccagtgttcagcactgcaggggacccagctgagcatgtacccagccatttgtggacttaaacatgctcatgtaccaggttttgccctgaattgcatccaagtgctggacaagaggcaccaatccgacagtgctcagagatactgagtaccaggaaaggtggcatagagaaatttgtgctgagtctttgcagaatggagatgcacgagagaaagaaccactgaataatgaggcaggaaggaacctcagcctgttggaagaaatactgattgaaaaatagtctaggaaaagttgagttaaagcttggattttccagactgcagaactttccagaacccttaatatgttaatattattaattattaatcttcaaaaggggaaatggaatgtgcatctttacccaaatacagtttggaaaggccaggctagagaagagagcacaattagaatagcaattcagaaggctttagtagtattttgtggctctgctgtggagaattttgaacagtagggtgtgacttctgcatttattatgatctgcaatataaagccaataattacctaactttatattctaatctgggactgagaaaataatcttaagatattaaagaaaattttctcttctttaggaaggggaaagggtggaatttcattttcttcctataaagatgattgtattttttatatatgtgtgtgtgtgtatatacacatgtataaattttattttattttattttttatttcttttttagatgaagtctcactctgtcacccagcctggagtgcagtgacgcgatctcggctcactgcaacctccacctcccaggttcaagagattctcctgcctcatcctttcaagtatctggaactacaggcgtgtgccaccatgcctgcctaatttttgtatttttagtagagacgggttttaccatattggccaggctcgtctcaaactcctgacttcaggtgatctgcctgcctcggcctcccaacgtgttgggattacaggcgtgagccaccgcgcccggcctatatatatatataaactttaaattaaccaaatatagagagattcttattctttaatctttggttaaatggaaagatatgaaatatgccacaactttttaaaaaataatttcgcttttattttagattcaggggatgcatgtgcaggtttgttagctaggtatatagtgtggtgctgaggtttggggtacaattgatcccatcccccaggtgctgagcgtagtacctaataggtagtttttcaactcttgccccctccctctctcccttgtctagtagttcccagtgtctactgttgccatctttctgtccacgagcacttaatgtttagctcctatttatttattcatttatttgtattttatttttgagacagtcttgctctgtcgcccaggctggagtgcagcggcgtgatctcaactcactgaaacctctgcctcccaggttcaagcgattctcctgcctcagcctcctgagtagctgggattacagttgtgcaccaccacgcctggctaatttttgtatttttagtagagacagggtttcactatgttggccagactggtcttgaactcctgacctcaagcgatccacccaccccagcttcccaaaatgctgagattataggcgtgagccactgcacccagcctagctcccacttacaagtgataacatgcagtatttgtttttctgttcctggcttaattcgcataggataatggcctccagctgcatccatgttgctgcaaaggacatgattttattcttttttatggctgcatgtcacaacttttaaatttacagtatgtgggaagtgccttagattatcctgatgaaagatttcatatttttaatctccttattaagttacatctgtctagacttgctgatactttggggattgggtggaagagaaagaggagtagaaaatgaggataagtaaaatttttttgcattgagcacactttggatggatttcattgttcaaataattctgataatttgcattagatttagtttttattttttggtctccagtaacaactgtttgtagaactaatttctatggcacgtaattgcatgtggagctaaccctcctggggcaagccacttatgcctacaaactctcccttaaccatattttctggggccagagacaattggactactgtggagtgaaaagctgtagattattgtgtcctcaaactctctgccgctcctgcaatgaatactggaggtattgtaactgtatgtgaacttgaacgaagatcaggggaaggtcacacagagccttcttgaatggagttgcaaattcttcctctggcaaatacaagtaaagggaaatgtcacgagtttgttgctttttatggtcatgaagagggaaaaatccccaaagcttgtgattcctttgctgtgagctgaccagctggcttttttcagcattggagaagaacttgagaaggacactgatttattttttccttgagtctgatcactgacagtctcatagaaaagcaaataactatattctgagactgtaactaaactaaacttttaagaaggttgtttctttgtaaaacctaaaaatcaacatagggctattcttgtaagattacttttggccacataaagaggaagagctcattctactgattcctgcttcttaataaatatctactaaactatatgtattttattttattaatttatttatttgagacagggtcttgctctgttgcccaggctggagtgcagtggcactatcttggctcctgggttcaagtgatcctcctgcctcaacctcctgagtagctgggcttacaggtgtgtgctgctacaccagctaatttttgtatttttagtagagacagggtttcaccatgttagtcaggctggtcttgaactcctgacctcaagtgatctgcccacctcagcctccccaagtgctgaattataggtatgagccactgtgcccagcctgtgtgtgtgtgtgtgtgtgtgtttatatacacactatatatatatgtatatatacacataatgtatctatatatgtgtgtgtgtatatatatatatttatacaaaataaatatatgtgtgtatatatatatattggagacggagtcttgctctgtcacccaggctggagtgcagtggcacaatcttggctcactgcaacctccacctcctgggttcaagcaattcttgtgcctcagcttcccaagtagctgggattacaggcgcctgccaccacgccccgttaattttttgaatttttagtagagatggggtttcaccatgttggctgggctgatctcaaattcctgacctcaggtaatccacccaccttggccttccaaagtgctgggattacaggtgtgagccacggcgcccggcctatattttttaaaataacatattttcctaggtactccttcttttaaaaaatagcatatatatttatatatgtatatatatatgtgtgtgtatatatgtgtatatatatacacacatatatacatgtatatatatatatacacacacatatacatgtatatatatatacacacacacacacacacacacacacacacacacgtttaatatgcccacttattggccctttttttccttttttttttttttttgagattggagtctcactctgttgcccaggctggagtgcagtggcactgtcaagactcattgcaacctccacctgccaggttcaagctattcttgtgcctcatcctcgagttcctgggactacagttgcatgccaccatgcccagctaatttttgtttttttagtagacatggggtttcagcatgttgcccaggctggtcttgaactcctggcctcaagtgatccacctgcctcagcctcccaaagcgccgggattacaggcatgagccactgcacccagccgacccttttcttcaatgtaactttctctttttttttttccttgcacaaagcattaacaatgtgaatgaaggacatgggattggatgagccaatttggggcattccacctgtgtctgagggttcctaacacagttgttttactgtgtatttttgtgttaattacaaggttgaaacttgtagagaatcaactaataaagaatcaggtgcatatagaaatataaacatacagtctcttttcttactgtcagttcgctaacgtttattgggtttgagtgcttattaggtaccaagcagttgtttttgggcacttacacatgctattccctatgttaccaacagtttatgacttttgtgaggtgactggtatcattcccgtttttaaaatgagccagtagagtggaaatttaactaggagttggagcttttgattcgatcgctcttgagttcaatgctagaggtctcactcctgtttgggcagctctcagacttggagctcatgggtatgatgagatcactgcagtgtgacaggggccttggctatgctgccgaataggagatgtctctcattattaacttctgggatgtcagacagctcctaagatccctgtgcactctgccttcctaggtatttcaggatgtattactaagatctgctgtcaagtaaatggtgaatgatgatctaataaggccagccccttgtttcagaccctgtcctcacttctcccagcccgtcatggtttagaggtggctaatgccaggctgtaagagctctttgagtttggatgcagatcgtacgtctgaaacgagaattgatactgcacatttttctctttattttgggtgcagtgactcatgcctgtaatcccagcactttgggaggcccccagtgggcggatcacctgaggtcaggagttcgagaccaacctagccaatatgtgaaacctgtctctactaaaaatacaaaaattagctgagtgtggtggtgcgcacctgtagtcccagctgctcgggaggctgacacaggagaatcgcttgaaccggggaggtggaggttgcagtgagccgagatcgtgccactgcaccctggagccctgtgactcaggaccctctgtttatattcctccatacttttcctaaactctttttcttccagcatgcacctgtgcattcccttatccttcactcctcaggttgcatcttgagggttggcatctaaaaaccaatggtttggccggcttcagtggctcatgcttgtaatcccagcactctgggagaccagcgtgggtgggtcacctgaggtcaggagttcgaggccagcctggttaacatggcgaaaccccatctctactaaaaattagctgggcgtggtggtgggcgcctgcaatctcaggaggctgaggcaggagaatcgtttgaaccgggaggcagaggttgcagtgatccgagattgtgccactgcactacagcctggatgacagaatgagactccatctaaaaaaaaacccataaaataaaataaaaaccaatggtttggctgggcacagtggctcactcctgtaatcccagcactttgggaggcagaggcgggtggatcaactgaggtcgggagttcgagaccacgcaaaaatacaacccgtctctaaaaaatacaaaccccgtctttaaaatacaaaaattagccgagcattatggcgggtgcctgtaagcccagctgcttaggaggctgagtcaggagaatcacttgaacccgggaggtggaggttgcagtgagccgtgatcatgccattgcactccagcctgtcgacagagccagactccatctcaaaaacaaacaagaacaacagtggtttttattattttatttatttatttatttatttatttatttatttatttatgagatggagtttcactcttgttccccagggtggagtgcaatggcgtgagctcggctcactgcaacctcctgttaagatagcaatttagcctgttaagataataatttaaaaaactcacatgggagcaaagtaatagcaaatgaatgactagtgaataaattaatgcaagtgggtggctgagttgttatttttaaaaattttttttgatacagagactcactctgtcagccaggctggagtggaatggcgagatcttgaaccgcctcccaggttcaagagattctccttcctcagcctcccgagtagctgggattataggcatgtgccaccatgcccggctaattttttgtatttttagtagagatggggtttctccatgttggtcacactggtctcaggtgatccacccgcctcaggtgatccacccgcctcggcctcccaaagtgctgggataacaggcatgagccactgcgcccggcccaaaacaatggtttttagatgttttcttgctggtctgctacacgttcttcttctgttcagtcagtgcatgtagtaataaataaaagctctgctcattgcttttgtttattttaagtactttttcacgtagtgcggtgtcatggcctcagataaatgtctacataatgcagtcaactttcccacaccttgggtgtcctctaagaaatgcagactacagaatcttgatcatatttatatatgattgtcctttggctctaaatttatcccattatcaggttggcttttattttgggaattctgtctgcatcagaaacatggctaaatgacttcaacttcaagttcaaacacttgaagttcaaaaacttcaagttcaaacacttcatttgttggcattttcatttttagcaagtgaatatctggcatgaattaactaaagtttagaagatctttgtttttcttcttccctccccacccccaaaaagaagaaaattcctaaagctttttgtaatttttatcacaaaataatagacttagtacagggagcatcatgctgaagccttccttaggactgtttcaccagtgaagaccatctcacaggcctgcttggtccctcctgctgttcttttttcaaagctaagagagacattctacaacttcaaatctaaggttttctgggtctcaattcccttatactccagagttcaagcacattttctttgcctgcatgtaaaaggtagttgattagctgaagttaagttaacctttggatttctttccttttcgggggttattttgttttttatagatgggtgtcactcttgcccaggctggagtgcagtagtgcaatcctagcttactgcagcctcaatctcctgatctcaagcaatcctcccacctcagcctcctgagtagctgggactatgggcatgtaccaccatgcctggctaatttatacattttttgagagatagggtcttgctatgttgcccaggctggcctccaactcttgggctcaagcaatccccctgccttggcctcccaaaatgctgggattacaggcatgagtcaccacttctgggccttaatttttctctttgactctcactatgattttgtgagagtctaggtaacttagtggcaggagaattaccacttaacttcctgaaagctttgcttttccactaactcagaactcttcctctaactctgtatccatgcaaaactggttgttgaaacatccattcaacagataataataaattccttcttcagttcacattcttcatttttactcactatactctcttgagagattttcttttcttttcttttttatttttatttttttgagtttcactctgttgcccaggctggagtgcaatggcgtgatctctgctcactgcaacttccgcctcctgggttcaagcaattttcctgtctcagcctcctgagtaactgtgattacaggcatccgcacccacacctggctaatttttgtatttttagtagagacagggtttcaccatgttggccaggctagtctcgaactcctgacctcaggtgatcctcctgcctcagcctcccaaagtgctgggattacaggcatgagccaacacgcccagctcttgagagatcttaccgatgttcttggcttccattacatctatgtgctgatgaatcccaaacctctgcatctctccacctaggatgcctctacttcattgtcttgcccctttaagctgagcccacccagctcaaatctacactgtctgttctcatccctgtcaatgcactctccagcttggggcaggtggagggggcactgtttcatgaggaaagctaatggtatgcagaagggattgaataaaagaaaggaagagaatggagaacatccgcttggctggggctcaatatccaagcatgccaagatgaaagtggagcagggtgcggccttgggaaggagacgtgaatgaactgctgacattccttgaggacaagaggccaaagcctgctggctctaaaactagtatgtttaaagcaaattattagttttgctcaaagtgccactgacatcataaaagaataagatatacctggccaagaccccacctcttaaaaaaaaaaaaaaaaaaaagcttgggcatagtggctcacacctgtaatcccagcactttgggaggccgaggtgggtggatcacctgaggtcaggagtttgagaccagcttgaccaacatggagaaaccccgtctctactaaaaatagaaaaattagccaggtgtggtggcaggcatctgtaatcccagctactcaggaggctgaggcaggagaatcgcttgaacccgggaggcagaggttgcagtgagccaagatcgtatcactgaactccagcctgggtgagagtgtgagacttcatctcaaaaaaaaaaaaaaagaattaaagataaatagtatgatgtaaaaattcatattagaggtacatttttaggtaatatatctgtaatgtttttgacaaaaataaattaatttagcttcaaacatctcattcatttgcaaaggatgattttgttgaaagcttaaatctgtgggaaaataatttttgtctaaaagtttatgttggccgggcgcagtggctctcgcttgtaatcccagcactttcggaggctgaggtgggcagatcacctgaggtcaggagttcaagagcagcctgaccaactggtgaaaccctttcttgacaaaaagacaaaaaattagccgggcatgatggtgggtgcctataatcccagctactcgagaggctgagacgggagaattgcttgaacccaggaggtggaggttgcagtgagccaagatcacgccattgcactccagcctgggcaacagagcgagactccgtctcaaaaaaaaaaaaaaagtttatatcttagggacaaagttaaatttatacatgtaaatcaagcctcttttttttttttttgcaatagctttactgagatactgtaactcacataccatatagtttacccctttaaagtgtacaggtcagtgggttttagtaatcaaagcattcttagttgaaaagtgttattgaacaactggaagcagatatttgttaactggtctgacttatgttcatatgactgcttaaaacttttcctttgcaggaattcagctagcccattctaaaaatggtccaaaaatcagaatgtaggaagggaactgctattgctctttgaactttaaatagtcactgtagggatatagtgacccaggaaatcaattagctaaactgacttcaatccagtagatttaaaacataacagaagaaaaccaacttgaaaaaagaaaataaacatacagtattatacctttagggaaaaaggaccacttagtttaaattcaatattttaaaagtcaagaataataatgcttgttaaaaatctaacagtacatgcaaaggtatataaaagctgctctttgtcctttcccatccatccctcatcagtctgtcaccagaggaaccatagttaatgatgattataataaccttcctgggcttcagtggattactcaacaactgtgtgagaaaagaaattggtgatcgttaggagtcagtgtgggttcactaaggatgagcccaacaatgacatttatgtaatattcttttcgttcttcctttagttggtctttttgttgttgttttcaggttcctggactccaggatttgggggactggactgatgatggtgattctgcatttcaccaaagtgatttgacaaaattgagtcattcagcagctctgtctaaatgtgggctgatcaaaatatctggaataaatgtaattgatcatcctggtcagagctgtctgctgtaaaactctccttggccttgccagggttaattctttatcaacttgcatgagaagtgaagacggacatctcaaagtgacaaatgatttaaaaagttaaaagttaggatagatagctgatgctggatcacatatttttctcttctttcttttttaaattttttgatctttacttcaattatcttctgtcattgcttatttctttcactactcctatttaaatatttttcaaacttagatatggtgccagcattttggtataaagaggaaagacagtgttagctctcagtgcagcagagcagtcagacttgaagatggcgtaaggaggaaggcactggatctgtggaaggacagaggagggaggagtctaggtagaatagaagaaaaacaccctgatgaaatgcatcaattcctgtgcattttagaagatcgaattataaagcaatttggcaacatgtctcaccatataagtgttcatatcctttgctccagtgctgctaattctggaaattcaacaaataaataacacaggggaaggaaaactgtattccataaaatgtttgttacaaatgtttgccatagccttgtcgaagatgttgaaagatcagttcagtgaatcatgtatggtacatatacctgatcattgtcattcaggggcacaggagaaattttagctactaggagaaatgtttatggctgtgaaatgggaaaatatgcaaaactgtattccacaatagtaattgtatttaaaaaacgcatgtatgtggctgaaggttgaaaggagatactcaggaggctgaggcaggagaatggcgtgaacccgggaggtggagcctgccgtgagccgagatcgcgccactgcaccagcctggcggacagagcgagactccatctcaaaaaaaaaaaaaaaaaaaaaaaaaaggagaacatgaaaatcacaaagtgttggaatgatagggttttagattgtttcatcttttcaaaactttcatttctctttcttgagattttgtaaaaaaaaaccagcagacagatcaacgggaaggaattgaggatgagggagaatatagcttataagtaggggagaaggttaaaaattagctgggagtttaattgattttatattcactgtaatctcaactgtgagaaggtggttaatatagagcattttgaatagactcttatgccatattaatagaaataacaccatactgttgtttgcaccagtcagcatctatttggactattgtacttaattgacatagtcacattttaatgtcaggcattgctgcattaaagtcagacatgtagattttggaccttaaaagactcattcagttttcagctgtttgagagacagttgtcaaagcatcagtagacacatcacagtgtggaagagtccacagaatgccaaaccctggccaacagagagagggtggggtgtggagtagggctattgggtggttttcagagcaccaatccatttcctctgacgatttttgcaaagacagtcatagatatgtagaacaaacaacaagattttgtgtctatagttattatttaccatttctgatccctgttttcaggacctattacatttctagaatgtagccataaaaagacaccatcgctatgtatcactatggttaatgaaggcttttcataggcaaaaaatagcagggataatggcaggaagttacagtgtgaaaggttccatggaaggtggatgtggtttcttcaccggatttttccattgccgggagacagacatcgttcctcaggcacccaaacctgtctctctcggcgtttgctgatagagtgggctgaatggtcatcgtccttgtgccctcttcagttgccctgactcctatgcatgctccttgagtgtcaccttcctacctgacagatgccatacccttccatccccaactcccattttatcttttccttctaagctggatctaggaaccctcacgggacccacaagtaaccgttattaaaacagtgtgactgctgggtggggtggctcatgcctgtaatcccagcacttcgggaagcgaaggcaggcggatcacctgaggtcgggagttcgagaccagcctgaccaacatggagatgtatttttgtatttctactagaaatacaaaattagccaggcgtggtggcacgtgcctgtaatcccagctacttgggaggctgaggcagaagaattgcttgaacccgggaggcagaggttgcggtgagctgagatcacgccattgcactccagcctgagcaacaagagtgaaactccgtctcaaaacaaacaaacaaaaaaatagtgtgactatatgttctcaaatatatgtatttaaggcaaaaataacacttggcagctatataaaactagatttagcatgaatctgttctttttgcttacaagggaagataagacttctaaccaaatacccatattatatggaaacttccaattctatgtaacgtttccattttggaaaagacttgtggttttttgtttgtttgagtttttttaaattctttaagacagattctcactgtgtcacccacactggagtgcagcagcctgatctcagttcactgcaacctctgcctcctgggttcaagtgattctcctgcctcagcctcctgagttagttgggactacaggcatgtgccaccatgcccagctaatttttgtattttttgtagagacggggtttcaccatgatggccaggctgatctgggactcctgtcctcaagcgatccacccgccttggcttcccaaatttctgggattacaggcatgagccaccgtgctcggcctgttttttttttttttttttttttttttttttttttaatcaacatctaaacccttactttaatattacagagggaaagttgaaaattgggcttaaaccaggtgtgagaaacatttaatatctaatgattaaatctcatggtcaagatgaaagatgttcagtcttaggtgaaatctttctcacaaaagttttctgtggacagttgaatgtagacagtacaagtggcttttttaaaattttgaggcaggtctttttgaagacagctgtagcccattagtaacggtcccattcaaggatggatgataatcccaaaatgtcagtggcattttcagtttttttgtgtgtatttcaattttatatttttttctaaaattttttattattcagtgcagaatttttctcaatagcattttagacttgtttgtcatcctgtttgtcttctccaaatttagtggaaaaggaacttctttctttcatagaacttgccaagacatctggggaggatttcataattaaagaatgtattttatttcctttaggaatcaacagcacttgaatctgatttgccatgacacttcagtgttgctcaactcaagaggcattgtagttccattgtagttcttgtttatgattaataggaaatgaatactctggagcagatacatttaccccaggaagatatctctggatcactttgcctccgagcactcttcctctgagatattttcctagtctcaattgctggaaaagtattaattcttccaggtttttcagataactttgttaagataataattcacgtactgtacaattcaccatttaaagagtacaactcagtggtttttagcatgtttacagagttgcataactgtcatgatcttcgaacattttcactccccaaagaaaccccatacccagtagccgtcactctgcatttcccactcccctcattcccagtaaccacagagccaaatctgtctctctatggatttgcctattttggacattttgtatcaatggaatcatacaatatgtggccttttgtgtctggctttcatttattatggtgtttgcaagattcatccatgttatagcgtacatcagtacttcctgttttgttgttgttgttgtttgagacagtctcgctcttgttgcccaggctggagtgcagtggcgagatcttggctcactgcaacctccgcctcctgggttcaagtgattctcctgcctcagcctcccgagtagctgggattacaggcatgcaccaccacgctgggctaattttttgtatttttagtagagatggaatttctccatgttggtcaggctggtcttgaactcgcaacctcaggtgatctgcccgcctcggcctcccaaagtgctgggattacaggcgtgagcctctgagcccagctggttttttaaactgctgtataatattccgttgtatggatatatcctacgttttatttatccatgcagcagttgatagacattggcattggggttgcttccaccttttggctgtcatgaataatattgctatgaacactaatgtacaattctttgcctgaacgtaaatgttttcatttctcttgggtatttatctagaaatgaaattgctgtatgttaaccctttgtttaacctcttgaggaactggcagacttttccaaagcagctgcaccattttaaattctaaccagcagtgtttgagggttccaatttctctatatccttggtaacacttgttatctgcccttttggttagagacatcctagtgagtgtgaagtggcatctcactgtggttttgatgtgcatttccctgatagctaattgtgtggatcccttttgcttttagtgaatgaaatatctggtagtctcgtatgccaaactaaagctaaaaattaaaaatgacttctgaaatgaatgtgtatatgacagacatcatgatgaatccaagtgagcattatgcactcgtagcaatcgaagcagacttctctggcttctgaataacagttcttagagttctaatttagtatttggatagagttactgcttctagtttggggagttagttgctaaaataataaaatgtctccatggtagggaggggtgatggtgaggaggtttgctggtggttggttaagtatgtttcccaccaaatatgccgaagcagtttcttctgttagttacaggtcagaatctttttgccatctttgctttctttctcctgtttgcatcctttttgttgttgctgaacttttttagagtaagttttagatatcagacacttcactcccagatagttcagcatcgtctcctgggaatatatccctacattcttctgcttacccccagtgccattatcacaacgaagaaacttttttttttttttttgagaggttctcattctgtcgcccaggctacagtaaaatggaatgatctcagctcactgcagcctctgcctgccagtctcatgtgatcctcccacctcagcctccggagtagctgggactacaggcctgtgccaccaagtccagctaatttttgtattttttgtagagatggggtctcactatattgcccagactggtcttgaactcctgaggtcaagcaatccgcccacctcggcctcccaaagtgctgggattacatgtgcgagccactacacgcccccagcccacaactgaaaaactttaacattaattgattttatttatttgtgtatttttgagacagagtctcagctctgtcgcccaggctggagtgcagtggtgcgatttcggctcactgcaacctctgcctcccgggttcaagtgattctcatgtctcagcctcctgagtagctgtgattacaggcgcttgccaccacgcccagctaatttttgtatttttagtagagacggggttttaccatgttggccaggttggtctcgaactcctgactgcaaatgatccacccacctcggcctcccaaagtgctggggttacaggcgtgagccaccacacccagcccaacgttaatttaatgatatcatctaagatagagttcgtattcaaacttcctctgttaaccttaaatatattttatacctgctttaaaaattgggtcctggccaggcatggtggctcatgctgtaatccctgcgctgtgggaggctgaggtgggatgatcacttgaggtgaggagtccaagactagcctgggcaacgtaatgagacttcagctctataaaaataaaatacaagaaattagcccagtgtggtggtgcaggcctgtagtcctagctacttaggaggactaggtggaaggatcccttgagccaaggagtttgaagctgcagtgagctatgattgcatcactgcactccagcctgagtgacacagtgagaccctgtttcaaaaaaaaaaaaaaacaaaaaaaacagtggggtccagcatataaccaaattgcatttggtcatgtttcttttctagtttcttaaactagaatactccctttgcctttctgtttttcgtactccctttgccttcctgtttttcatgagatgatagatagatagatagatagatagatagatagatagatagatagagatggagtctcactctgtctcccaggctggagtgcagttgtatgatctcggctcactgcaacctcggctcactgcaacctctgcctcctgggtttgagtgattttcctgcctcagcctccccagtagctgggattacaggcatgtgctgccacgccctgttcatttttgtatttttagtagagacagggttttaccatgccaggctggtctcaaactcctggcctcaagtgatccacccgccttggcctcccaaagtgctgggattacaggtgtaaggcaccgcacccaacccatgagatttatttttataaagagcccaggccagttgtcttatgtagtggatttgtcagatttatctatgattagattcaggctggacattgttttatttttgagacagagtcttgctctggctggagtgcagtggtgcaatctcaactcactgcaagctccgcttcccgggttcacaccattcttctgcctcagcctcctgagtagctgggactataggcgcctgccaccacacctggctaattttttgtatttttagtagagatggggtttcaccgtggtagccaggatggtctggatctcctgaccttgtgatccgcctgcctcggcctcccaaagtgctgagattataggcgtgagccaccgcgccccgcccaggctggacattcttagcaagaataccacttaggtgatgctgtcgtgatggtgcggtgatagtgagtctttactgttgtatcacaccagcaatcacagacaatgcctgtccctcctgttattgctgatactgagtttgactgttagatgctagtaagggctgagtttccctgtggggtactatggtagtttcataccggtgattccattgccagtatattcacatccagtgatgactctcgcgtaaatcactgtgaaatggtgactttctcatctgttattcttttctatatttctccatctggcattcttccatataggtgagctttttccttttaccctcatctctccctttgttttcccttaaaagttaaacatcttttttccaacaatgaagttattgaacgtatttccaacttttatgtcaaacttaaggaaagagacctccagcaggccagttcaaagactcttttggtagacatatttaatggaaaaagaatggctaggtggttacttttagactagttaaaagaatgaggccagttgggcgcagtggctcacgcctgtaatcccagcactttgggaggctgaggcgggtggatcatgaggtcaggagttcaagaccagcctgaccaacatggtgaaaactccgtctctactaaaaatatgaaaattagccgggtatggtggcgtgcgcctgtaatcccagctactcgggaaactgaggcaggagactcgcatgaacccaggaggtggaggttgcagtgagccgagattgcaccactgcactccagcctgggcgacagagcaagactctgtctcaaaaacaaaaacaaaaaagaatgaggtcaaaatggtttccctcagttctttttttttttttgagacaggatcttgctcttttgcccagggtggagggcagtggcgcaatctcggctcactgcaacctctgcctcttgggcttaggcaatcctgtcacctcagcctcccaagtagctgggactacaggggcaggggcatgccactacgccctgctgatttttgtattctttttgtagagatgggttctaccattttgcccatgctggtctggaactcctgggctcaagcaatccacctgccttggtcttccaaagtgctgggactacaggcgtgagccactgcacccggcctaccttcagttcttgaagatcacctgggggtgtggtgatggtggaggaggtgggggggttgggtagtagggaagtggtttaaaattatagatcatgatttcgttaaagtgtatcagaaacattttgttgggaatgttttcctgaagaaagtcatgaattaaatcatgcaaaaaagttctgtccttgagaaggtagggatctttaagcattgtaagtatggaaattagaaattatagaaagatttaaaaatataacaaaaaatagaagttcctatttaacacaaccattatcacttttgtgtgttcttagaaaaaaggagtgtttgtgagttgggggcatctcacaattttataggcagtttctaacttcaaaggcatttttgagaaaacctcaaggtcatagaaacagtagtataaaaatggaggtaagaatttctaattgtcactgggctaggtaactcattcctgtaatcccagcactttgggaggccgaggcagatggatcacttgagctgaggagttggagaccagcctcggcaacatgggtgaaaccccacctctacaaaaaatataaaaattaaccaggcctgatggcacattcctgaagtcccagctacttgggaggctgaggcgggaggatcgattgagcctgggaggtcgaggctgcagtgagccgtgatcgcgccactgcacttcagcctgggtgacagagcaagaccctgtctcaaaaaaaaaatttttttttaattgtaatttttctcacaaacatgtttgacccatatgtgataacgtggtgacactggttgtactccccaaccactgtttctgttccccagcaaggggatctaaaccgtttttcttcccagctcttgcttgctgtgtctggaaaacacatttgaaaggcgagaggtttgcattcgagagaggctggggcttgatggtgtccctggagtttaaaaggctgaggtttccaatgctatttgctttcgggatgttgagccctcagagtaacagatgccctaaaattgtacattttccatctagaaaaggggaaaaaaaatctgtagaagaatggattatgaaaaacaaatctaccctccaagaaggtggtcaacaaaacagcgtgactgagaccttcactcagaaattccacgatagcagacgtcacctttctcatgttcgtattttgttgtagaagacatttgggtgaatcattgacagtctttttttatcagaatactttaatacattttacattgatttaggaatttggatgttaaaaatgagaaatcttttacgatggcatgatcactggaaggagtaaggttttttgggattattttcctaccatctgttgtcagcaggaccacctgcgtatcattttccttccatcaaatgtatgacttagccgccaagtggtgcctttgtattttccactccagtgtgggattgcagaaaggctgtttttatgcttatttttgttgaatggttttatgctgatgaaatcaattgaatacctcgttgatctggaaagttgttcttatcatctggacatccagactggttccatttaattggttagcatttatctttgcagaaagaaaatcgctggtaaataaaaattagactgaacataattattaatagatgtcaccactaagcatttgtttgccttggtctaacagttgttggttaacacattgatcagattggagttttgtgtgtaaacatacttttggtgtagttttgagcctaaggagaccttgaaatgcaattttcagtgtagaacaaaaaatcttgtacttaaataaaaaatctttccatgttcctgaacaccctttaaaaaaaaatcttgaataaaatttaaatgtagcaaagctaaaattgtgtaaaagttcattttaatagcaaggtgtcctggtggttatagtcactgattgcaagtgcttgctaatagagccaggaatgagtggcaaatttagattccttcctccaggaatttgcttcatgtttgaaagtgattaagacattttcatagctgccagtacattcagttgcatcagacatttgctctacccatcaaaacatgtctgtagtttttgcttagggctgtaatggaattgagaaaggatggctaattagagtaactttgcttagtcaacggtctggctgttgaagggatttggttcctccagtgctgaccagccttgcagtcactgcagagcaatctcccagtggacggagcctccctgagcctcgcacaaagagaagccagcgcagctgggagtggctccaggagcacaaaacactaggggatccaagacttgaagaaacttatgtatttattatttatttatttgcctgttccccctagcaagtcactgattgtgctttatcacgatcgtatgcttttatgaatgctttagatcacccattgatgcctctgtccctttttcttgatttatctgtttagtagtaagaatacaaggggacttgtcctctaagtctatcttttatggaatggtatggaaggattgagtttttcttggcagtttgaggtggaattctttgtgtatgcatctccacgggcacataatcaattgaagcaatttaagtcaaatcttgctcttggtcatttagttaacaagaaaacaaacaaacctaaaaacaaatacaacaacctgtgcaatcttgaagataccgaagaaaatgaataggaatccatcctttcctaggtgtcattacttctgcagctgtttaaaggtgggtttctacacactggggctccagatgtccaccgtagcagatggagagattgagcaaatgtctgaaaatggctattaattaatgaggttgcaagatacttttgtcagttatgaatgtcacgtagactgggatgctttagtaagcaatatgtatgctcttgatttaaaagacagcctggattttatcttttgggggagaggagtactcgtatgataaccacacctatagacaaaaatcctggttcctgtctctactcctctttaagaagtgttttttaagtgcaaaatggatggtaaggcgtattgtttctaaacatctagatgtttccaataggagaactttgtagaactgaaataatttgaaacaatacatgctaaattcctttacctcaaaatttggtgcttggtaaatgatagatgtttaatagatatttattgaatgagttaactattagggcttacaaaatgatcaggtttaaacctgcaagcagactcttgcctcctattttgtattttctttggtaatcttttattttaacaggaatataaatcccattttttatttagttttttcttttgttcttcaacaaatataaaagacactttcaatgtgaataagaatataatcaggaacaaattttaagagtaatatgtggattttgtaaggatttactcttcaactgtattggttcttctggtgctgatgtttttcctaatgttaaatacagcattaatcattgaaatacgtaagacatgttacgtcttcccttttcagatccttaggcaatagctaataggtttatgtgtgtgtgtgtgtgtgtgtgtgtgtgtctgtctgtttatttttttctacctttgtcttactattgtggaagggaaataatagaatttgtcctcttttatattttatttaaaatctacaatgatgaaaatgtatcacttaaggtagtaggtaaaaagtttatggattaattttgtattaactttctttgaggtctataatttattaatgtggatggatttacaatgaaggggaattcagatgttgtgttttttttggttttttgtttgtttgttttgttttgttttttgagacggagtctcactctgtcactcaggttggagtaaagtggtgcgatctcggctcactgcaggcttcgcctcctgggttcaagcgattatcctgccttagcctcccaagtagctgggattgcaggcgcccaccaccatgcccagctaatttttgtgtctttagtagagacagggttttgccatgttggccagactggtctcgaactccttacctcaggtgatcctccctccttggcctaccaaagggctgggattacaggcttgagccaccgcacctggctgtgtcatgtgtttttatcaaagaagaatcatagcatcgtaaatccagttggaggtcagtttctgggaagttctgttctttgactactgttgtattggagatcactttctctctgagatgatgttattggtactgcaattaatgaacggtagtgtctagttttttttttttgagacagagtctcgctctgtcacccaggctggagtgcagtggcgcgatctccgctcactgcaagctctgcctcccgggttcacgccattctcctgcctcagcctcccgagtagctgggagtacaggcacctgccaccatgcccggctaattttttgtatttttagtagagacagggtttcaccgtgttagccaggatggtctcgatctcctgaccttgtgatccgcctgccccggcctcccaaagtgctgggattacaggcatgagccaccgcgcccggcggtagtatctagttcttaacttagcatagaacaatggtttttaaagtgttcttcattaaaacttacttcatttctgttttctaaaattcctaaaataaattgttcaataagcagttatagtggatttgaaatagagaacacacctggagtgtcattactgcctacactgcttgagtggcctggagggctcacacccagaacctgagtcggacttacttaggaagacattctctgttgttttagtgttttaaaagattgtattccctggtctcatcaaaatgttatctttttttaagaaagtagggatagagaaggaatttctctggcatggtttctaatcctaacaaggtctgtgatgcttggcaagtaacattctttcaggatttggttctcgtcagtgtcatggaagggactgttttaggtgatcttgaagaacagctcttcaggttttaaatttttgtgtgtgtgtgattaacttaagaatggtgagtgtatttatatacaactctccttgacttaggaaaaaatgtacagcagtttttaatatgtatgcaagaagaaacgagaaatatacgataaaggataaaggtgggaaaaatctgaccatggagaaggcattctataacattttaaaaatttactttctctctgtttcttttaaaattgacccttaacactgctcggtgaggcatttaaataatagaaacgggctggagacaataagcaagcaaaagccggcgaggtggcaggcgcctgtagtcctagctactggggggaggctgaagtgggaggattgcttgagcccaggaggttgagtctgcagtgagctaacgattgcaccactgcactccatcctgggtgatggagtgagacctggtctctttaaaaaagtaaataaataagcaagtgaaatcaaacttgaaaaaattttaaataaatatctttttttaagcataaaagtggtatattgtcattgtgcaaatgccaccatataagaaaaaagttccttcattccctcttgtcttctgagatttttcttacatacacaaacaaacatatcctttcggttgttgttttttttttttaaatatgcatatagataatactgttgcgtaacttgcctttttcactcaataggaaatcataagcaccttttggttcagtatacacagatctggctcactgcttaatggctatatgttcagtgacatggatatactctatatttttaaccagtctctttactgattgacatttaagttgattctgatgatctcctattacaagtaatgctgaaatgaacatcctttcatatataatataattttgatatataaaatgaaaattatgtataatatacatattcatttatgcttgtgcaaatatttctataggactaattcctggatgaaagggaatgccccacccttccacccttttctatatgataaatttctgacacatttacttgttaaccaaggaatgacttaagtttcaaaatatgcttaatgcattcagctttcaatagctcacagcacacactgtatataaaaatatggaacgctttacaaatttgggtctcatctttgagtaggggccatgtatcgtttccattttagtgtctgtgctgccaaaccaaacgagcgctcttttcttttctttctttttctttttcattttctttttttttttttttttgagaaaggaccttcctcttgttgcccaggctggagggacacaatcacacctcactgtaaccccaaagtctgggctcaagcgaccctcccacttcagccccccgagtagctaggactacagttgtaggccatcacgcccagctcttttctttttgaaaatattgtaatattagatactttacggaatactcacaatgccccattttggcaatcatatttcacaaacctttgacttttgactgagttgcagttagcttgaaacactcgcgttttgctttcacttagagaattaccatttcttatgtgtaattctaaagatatatacagttaacaaggtcatgtttaaatttaccagtaaacacattggcagcttctttccattctgcaggaagtggctgtgtttctgtgctttcatcctgttatttccttagggtaaacatctaggcttcatgcaaagtagaaggggcatgtgcgtggtgttcaggatgtggatttgaatccccaactcagccacttacattagataagtgacttaacttgcgagcctccctctacaaactggatgaaggttgctaaagaatatgtttttacaagttgtgctaattttaatgctactgagaacaaatgagtgctcagatttggccacgtcagtgatattggtagtgttactttgacaggtgaaggatggtgttttaagtttgccttgacttttgcatttctgtaacgtatgggaagagataactgtaattctgtaggtctatgtattggttcgctattttaatttcaggttatgagcagatttagtgcccactttatcttttgaggtcttcttatatgcttcagatctcatggttgatacttcacatttgcaagaatttctcctacacatagggaatagcctcccaaatcctaactcaacccattgtattttgatgatgctatatagaattttaagtcttggaattggggcattctatgtgaggctaggacccaatttcctgcggcttcattcttttctccacacacgtttgttttatttatttgtttattgagacaaggtcttgctctgtcacccaggctggagtgcagtggtgctcactgcagccttgacttcctgggctcaggagatcttcctgcctcagccttctgagtagctaggaatacaggcctacaccataccctcccttccccaacacccagctaattttaaattttgatgtagggatgaggtctccctgtgttgcccaagcttgtcaaacacctggcttcaagagatcctcccaccttggcctcccaaagcactgggtttataggcgtgacccaccaagtgcagtctggcatgacctcccatgccagaatgtgtgatgcaggagcgggctgtcctcttccccctcctgttcccgctctcagctgcccatacatctatttttattttttctgagatggagtcttgctctgtcgcccaggctggaatgcagtggtgctatctcggctcactgcaccctccgcctcccaggttcgagcgggaggcagaggttgcagtgagccgagtagtagctgcctcagcctcctgaatagctgggactacaggcgcgtgccaccacgcccagctaatttttgtatttttagtagagacagggttttgccatgttggccaggctggtcttgatttcctgacctcaggtgatccacccacctcggcctcccaaagtgctgggattacaggtgtgagccaccgtgcccagcctgcccatacatcttaagggacctccagctcacgcatgggggttttccagcccacatgcccaaccttcaccaaaacaaatgtgctgtagccctttggtctagaggtgcccagggaagaggcttgcataggttctgagaattccaaatcttgggcccccaggacaggtggatgttaatttcaggaaggtttgcccttttggttgctgcgggggaaggatgtagccagaggagggccagaatggggctctccgcagtgaggggctctgcctgggtctgatggtgttactgctcacagggattctttgaagcagctgctgattccccgacttctcttgtctattggttgaataatgttttccctgctgtctacctatcaggttattcattcctgattactgtcaatgttcaggctggtcaaacttgaaatcattaactatataaagtgtattatgtataaagtgctagatttgtaagaaagttgctatcttcatcttcatggagtttagtttttatcttggctaagctcttgctaatttcccacagtatagcctgcactcatgttatgaaaaaatttagatgactgttgaagagtattcaggatttctttcttacttctcggcccaggactgagcctttatgaaagtgggtagcaggagattttagaaaagtggaggcccttgtataaggaggctgggctccatttaatgacggtgaggaggcacactttaggaactaaaggagaccagcatgacagattgagcgttaaggtagaactaaacaagaggcactcaaaggcagggagatcagctcttaggatattgcattaaatcaaccatgaaatgctaaagcttgaactagggcagaaatcaagcaatgggtacagacagcattgaacacaaaagaaatggtaggatttgagggagcatgaggatgaccaagatgcagaaaagcccaagatggtctccaggtttctaggcttttccaacgaggatgctaattctttgcctgaaaaagagtattatcaagtaaagacatggtctcactgttgacccagaaaatagagggacagggtaacaaaagcagtgatttgttttctgtaatactaatggctgacactgactagtgcttactgtgtcaggtgctgtctgtcctacgcgcttggtacacttgtgatagacacttataaatccccattgtaccaatgaggaagcaggcacctagaggtgaaggaaccttacaggtagggcctcttctcaaggcgaggcattctgatcagagaatgcctaagagagggagagacagagacagaattcagtataaagacagaaagcccactgttaaaagcaatgtcaggtgtttttctgagagctcagaagctgtcactgacataaccaaacctcaaatccgggagtcattctttttccgttggcaagtcccgcaggcctcatctccaaagacatttcacatcgacccattctgtccacagggccttccctggcttcatttctcccctgaatggacacagcagcagccttcctgcctccagcttgctctccttcagctcctctctgcaggcagattgctggtttgggggtttttagggtttgtctgtggtcaatttatatctgataaagcgagcaagtcttaagcgtatagcttggtgagttcttacaaggtgaacgcacgagtaaccctctcccaggtcaggttggagaacctcgccagtgccccagaagcctcccttgcatctcctcctggttattgctccattacattctgacttctgtctgcacagatcagtgtcacacatcgttcaccaggtatgcagtgatctttgaaacctgcacgttgagtcatgtcgttaccagaactcctggcatcacttccacattgcactctttgccattgcctgacatgagataaataagaatgcatggctgggtgtggtggctaacacctgtaatcccggcactttgggaagccgaggtggaaggatcgcttgagcccaggagtttgagaccagcctgggcaacatggcgaaaccctgtctctacaaaaaatacaaaaaaattagctgggtgtggcagtgtgcgcctgtagtcccagctacttggggggctgaggctggagtattgcttgagcctgagaggtcagagctgcagtgagccataactgagctactgcactccagtctgggcaacagagcaagaccctgtctcaaacaaaaccgaaaccaaaaacaaagaatgaacacatgtcgatgtcttatttctctcttccctgccattggtactttttgcctattcagatccagctcaaaactcaactttttctggtacactttctcttatcaacagaactgaaagagacccctccctgttagtactatgtgtcttagtactctgtctttgatgtgtggcacttccttttgacttgacgcatccagatgacataggaacccatcacagggattaatcaaatgttgactaacgcatggggacccagggtggaaccaaagcttttgcaaaatgatgaacattcagaggctttggagagtgaacttggaggtcaacaaagagaatgaaatgcaagatgcagtatgagcatgtggtgggtctggactgcaagattcaggcactttattttaggaatagttaatgtgaagaacatgatttatgaacgacagagtggggagtgtattgagaccaagtaagactaatgctccattgtgaaaacttacatatcaaagcaaatatattgtcccctctgtccccagaagcaataactggaaacagttttagaggacataacctaattggtataaaaacttttcactctcagaactatttttcccattgtcataggagtggataccaaataatgttttcctgtcttggcagtgattcacattactgagtttgctattgaactattttttccttgccaggaagtacacatcagagagctgcatttcactgtgtgtgtgtgtgtgtgtgtgtgtgtgtgtgtgtatctatttcaatctactgattaccaaagagcttataattcttaatggagagtttgtggaaaagatgaaaaaaggatttttttaaagaacaataaccagaaagtttgagacaattgagtattatagcaaagtcctttcttgcggtgacttctctggttgtaatgtcttgggttaaaaaaaaaaatcaatttcatgcaaaaaaggggggaggattatgtaaacaaaaacaaaaaaatttaaagtatcacagtctatcatttgggtgagttgtggaggggaaaagaagtcatttgtacagtttgatgaagaaataaatgtattttctagtttctaagataatctgtgtatgctctaaacttaaagcacatcatttcctgtaagtcagtatttggttcaaaagtgcaaaggctttatgattgatcatctacatctatcacatgattatcttctggaggtgataatttttttttttttttgagacggaattttgcgcttatcacccaggctggagtgaaatggcgcaatctccgttctctgcaaccttcgcctcctgagttcaagcgattcttctgcctcagcctcccaagtagctgagattacaggggcaccaccatgcctgggtaatttttttgtatttttagtagggacgaggtttcaccatgttggccaggctggtcttgaactcctggcctcaggtgatccacctgctttggcctcccaaagtgctgggattacagccatggaggtgataatttttttaaaagattaaggcaacagcaatttgagagtgagtcattgatgggacacttgtttagggaaagccctttttcctgcagaagcaaacttgcttcaggaatggcatcaggctgaaagcattttctttgcatttcaaataaagttggcaagaaagctggcacctgtctgctccatttctgtgctgttactacacacatacgttctactttgcttgctgtcaaggttcaagatcagtaacagcagggagggggcatttcccagaagcccacacgacttcatgaggaagcgccaaccctcgctggatggggcgtcggcttgcattcttcggaaacagaaaacaaaacaaagaaactctccctttctagtcactcacatgtgaatattggagactgtttcactagcagttatagtctatacttcttgaaatcatttagtttgcttacagatcttgaaccaagtggttaaggaatgaatcctttccattgaggtatccgttatctattattatttatttaagcgcatatgaaccaaacgagccactttgtactctgtctttccaggcgtcaaagcagggtaagttgcccctcttgactgagtcccgaatgtggtctgagtcagagaaggttagagctcagagctcgagagagttcaggtcttttacaaaacaaaacaagtcaggtgagaaccaaagctactgctgttgacttgaccaaggtcccacagttgttggggtggcagcgatggggtaagcatattttctttttctttctttttttttttttgagacggagtctcgctctgttgcccaggctggagtgcagtggcgtgatctcggctcactgctcacctctgcctcccgggttcacaccattctcctgcctcagcctcccgagaagctgggactacaggcgcccgccaccatgcccggctaattttttatatttttagtagagatggggtttcaccgtgttatccaggatggtctcgatctcctgaccttgtgatccacccgcctcggcctcccagagtgctgggattacaggtgtgaaccaccacgcccggtctattttcttttttttattttgatttcattttatttttctgagacggggtgttgctctgttgcccaggctggagtacagtggcacaatcatggctcactgtggcctcaacttccttggtctcaggtgatcctcccaccttagcctcctgagtagctgggaccacagacacaagtcagcacgcccagccaatttttgcattttttgtagagttgggatttcaccatgttgctcaggctagtgtctaactcttggactccagcgatctgcccacctcggccttggaaagtgctaggattacaggcgtgagccatcaggcccggccatgtttacttattaatattttaaagaattatgaggaatgcttttacaccgttggtcggagtataaattagtcaaccattgtggaagacagtgtggcgattcctcaaggatctagaaccagaaataccatttgatccagcaatcctgttactgggtatatacccaaaggattataaatcattctactataaagacacatgcatacgtatgtttattgcagcactgttcacaatagcaaagacttggaaccaacccaaatgcccatcaatgatagactggataaaggaaatgtggcacatatacaccacggaatactatgcagccataagaaaggacgagttcatgtcctttgcagggacatggataaagctggaaaccatcattctcagcaaactaacacaggaacagaaaaccaaacaccacatgttctcactcatacgtaggagttgaacaaggagaacacctggacacagggaggggaacatcacacaccggggcctgttggggagtggggggctaggggagggatggcattaggagaaatacctaatgtagttgacgggttgatgggtgcagcaaatcaccatggcacgtgtatacctctctaacaaacctgcgtgttctggacatgtatcccagaacttaaagtatttaaaaaaaaaaaaagaattatggctgggtgcagtggcccatgctggtaatcccaacactttggaaagccgaggtgggtggatcacttgaggtcaggagtttgaaaccagcctggacaacatggagaaaccctgactctacgaaaaatacaaaaaaattagctgggcatggtggcaggcacctgtaattttagctactcaggaggctgagaggcaggttgaaccccgggaggcggaggctacagtgagctgagatcgcgccgctgtactccagcctgggggacagagcaagacatcgtctcaaaagaaagaaagaaagaaaaagagtcacgagcacattggttaaatggactttccaaacaataggtgctaaaataaaattgatagagttatagtgaaggattacagagagcccctgaagtatttaattaatattttgtgggatttggggtacagctgaactgcctgtcactcttcccactcccaccctacccccgttcagaagtcacaactcatgcttttggaggacagagtgaatttctcccaaattactgtcttctgcctcctaaatcaggaccacatttttcaggtgtgcttatttggggaacgaggcctggtctgtgttccgctgtattgctgatgaagctaaaaattaagggattaatggcatcgctagatgcgccctgtagcggctggcagctctaaaagctcttctgacagctataacttatgatttataaatgaggttaatggattcctgttagaatggaaaatgcacttgtgtaagatcacttattcaagccgtaatcagtacctactgcaagtgctttctcctgaggcttgtattttttgctggaggatttttgtttttagtagatattgctggacataggtttttcttttctttttaaaatttgcaacaaatcccaaatcaccagaattgctgaaaacatgctgtgagagatgaatgtcaagttcacagtcactgcccttctccgacagaaccaacaccagccagccctcgagcgcagacggggaaattcaaactgatactctccacccctaatgttgagagagatggttatgcagcttcaaggtcctctgcaaattcaccatacttggatagactgtgaatgtatttttaattaggcactgatttttagagcattgggttatgtagtagtgaatattctgaccagcctgcatgtttcagaagcagaagtatgaaaaaatagatttggtagcaaacaccaaccagccaaacaaaaaagcaaaaagccaaaaacccatcttgtggttgatgtggtttccatagggctttgcctctcgtacatagtcacttcttaagaaacactctccctttttttctcagtagagtaaggtcttgataagaaggttgcaagatgtgcaatataactgttttattgagtaattttgttaaaccaggaaaataagaaagaaaagaaactagagctgttatttgtctttcttagaatgtcttgatcaatacattctaggctggcctgtaagaaaaagaagcacagggattttgaatagagacactgtcaccaggttaactttgtaaagggagggtggtgggctttcccagatgtactttcccttgtgaggttttagcttggctcttagctcattcaaagcaaagactgagagatgtttaatttgcaaatccttcaggtgtggaacttggattgtaattctttcctccttgggtaacatgatgactagcatggttatggctggcattttgcttttgttgtgttttgatacactttcgtgtttagaaggtaacgcatccgatgggacgaggcatctgaacaagatggtttggaagcttccttttgagactggagaaatgtgtggactaacacaaatgtgttcttagaatagtcatcatttctttgtgggaaacattattctggcacctattaatgcttatagggactagaattgttgaattccttctccactgaattcaggtagcttgattggggccattttggaggataggaaaactgggcagtgtctggaaaggccaacatcttcactgcacaccctacagggagggtgggtggaagttcccacagtggcatcagttggacaccatgacgagctcagtcccaggtgactgagacagacagaatggagaagcactcaccgttatctcattctcctagcacatccctcacccaactacagtctttctccacttagacatccatgccactgggtgttaccccaaaaatctgaagccaagcagattgacccctgacaatgaggccctgaagttcagttacgactccttgaagacctcttacctctcacaggccagcttcctctcccatccccctcactgatggttcccagccttcaccagattcttttttttttttttgagatggagtttcactcttgttgcccaggctggagtgcagtggcatgatcttggctcactgcaacctctgcctcccaggttcaagcgattcttctgcctcagtctcccgagtagctgggattacaggcatgcgccaccatgccaggctaattttgtattttatttttagtagagacggggtttctccatgttggtcaggctggtcttgaactcctgacctcagatgatccgcccgcctcggcctaccgaagtgctgggattacaggcgtgagccaccttgcccagcctggattcttgtttttccttctcaccctctcccctactaaatccccttctcttcctcagaagttagtccttctaggttctccctgtaaccttacctgcatagaaactccccctctctgcacataaacggagctgctttctgatttactttccttttgagagctggtctccagttgctgcagatcacctcatccagtgtccccttcaccacctgtcaggttcccttggtcagtatcatgcctctgagacagcagctgcccattggaatcacctgggggagccttggaaactactaatatgtgggtcctttcccagagattctgacttaattgggttaggatataaccacaacaacagccccacaaaagtattacccctcgttctataggctcagagggtgagaaatttgcccacatgtctcacagctgatgagtggcttagctgagatttcctttcatgggtgagcttgcagattgtgctctttctgttgactgtcctgggctatgccagatccagagaagcacggcaggatcattaccagctaagaaggggtcttaccattgcctgccccttaggaatcagttgccctaggcgaagtccctgttttcctccaagcagactgataaacactggctgtgctcaagcagcagcagggctggattcgcgtcacttactttggtatgcaggaggctgcttgtattccgtggcgcagggagctaagcacacacgtcagagaaagccatttcaatttatcattttaattttgctattaagcatccacggaccctaaatggattctccacaatggcatctgcaagtccattatcagctaaatgtttaatgagttttttaagtaaccgatggatgccacagtgtataggaaactttcttgagtttttttcacatataaggaggcatttctcgaagtcacttgggatggcttaacatagctcatccctgccagctgacttgtggcctctttcccttccttccatgtgcagtgccttctatcttgaatgctgcagccagcagaggttctggcagtggaaccctctgcctagtgggcttcagaaaggagcctgtgaggcagagacatttcaattgaaaagcagtttagaattcagcctccatttgctaattcccatagatgctcgtcagcaaacacaggacagttgtttgtggatttgaaatttgctactttttcattctgtatcttacattttggtgattgtgctacaaatatttggagttgaacataataggataatcactgttgattcttggctaaatcacattatcttaggccatctttgcaaatcaagtgcattctactgaaaaggagacaagcaattttgcttgttctttttctctttcagtcgaatggagcatggacttagaattgaagttgcaatggggtgggcaatacattctaactgggtttttagttaaaaatcagcaatcagtttaagcaatctggttcaaaggcagtatagctacaaatttgcagacagtgtgtagtacagttgtccttcagtatcttagacgaattggttccaggaccctcccacccctgttggtaccaaaatacaaggatgctcaagtcccacagtttgccctctggatccaggggttcccaacctcagattcaaccaaccaaggattgaaaagatagtttttgccggatgaggaactgcagatacggaaggctgactgtatttcatttcaacaggggtctcgattatcctcctcattgaatggtaatatgttacctgttttggcaaagtttggagtaaacttctgtctccacctccctgtattgcagctgtcagcatggtgaagagcctgcaaggcgtgttgatgtgtgctgcctagggctgcctaacacaaaccaaacaaacatcccttctcaggatgggagaagagctttttatgagaccttcttctgtcttcctcttgcccgtctctgcctttgcccccataagcaagtgacagttgtgtagtgtttagccactacgtatttctcatatctgtcttcatggtggagcttctgatactcctatcttagggacacacctttgattagaagaagtaatattagcctctaaaattttttgaactttaaaatcaagaccttacttgggataacgctggtttcctcctctgttgaaattgtttatctcttggactcagaaactatttagcctttctgtggcacacagtggatttcaaaacatttggtattatcagatttctaagcaaggatgtgatgtaattattttactaccaaatgaggattcttttgagagaagcagccacttaacgtgagagtaattgcttgaatatgaagtggtgtgtaggaattgagtgagaactgagatcttgacttgcacgtatgctgtagataaaacctactatgaatttgctggtgcagggccacagaaaaaactagtcatgagaattgccagaattgtcagaaatgtgttttgagatgatttatattcattattctaactcttcacaataacattttgcttattttgcaattggaatttgtggaggtccaagaagtcaagatggtaattaatttgcccaggacagctggtaggtgcatcagctcagagcagcgggtggtggggaacttgtcttagacattcacgatgcaggtcatgacactggactataaagctgtagctctaggggtctgtattctgtgctctgtaacttgacatgatctgggacccaaagttaaataactaatcaagagaagtcaggtgcttttttgttaaacacggaactccagtattcctctgaagcttaaggagagagtaagtaacatggtattgggcttgttccctgtccttaacacaagaattcttggaattgccggattacatattcttctcccctgagaggacacccagtgcaagcatggctcacatgcctaaggtctgtgttagatagatcatatcatggatccagcataattaagtagagatgcattttcttggtttaagttaccttaggggaaaaaaagaataaaattcttcaggttcaaccttggagttcttcttctttttttttttttgaggcgaggtcttgctctgttgccgggctggagcacaggggcgcaatctcgactcaccgcaacctcctcctcccaggttcaagcaattctcctgcctcagcctcccgagtagctgggactacaggcgagtgccaccatgcccagctaatttttgtatttttagtagagacggggtttcaccatgttggccaggatggtctggagctcttgacctcatgatccacccgcctcggcctcccaaagtgctgggattacaggcgtgagccaccatgttcagcctggagttctttcctgattctatgaggctgtgagtagtggttcttaaccaggaatgttatcaccaccacctcaggggaggtgcacatttcttgatatggggggtcggggttgggggcaccagggatgccccatgtcctgtaattactgtccacagtgtccacacaggaagataccggttgtatcagagacttggtctaggattcacaggtttttcttccagttggatttaatgagcttctctctgtcctaagacccaaatgctgtggggtttgccaacattacaaggtaggcatttcacagaacggaattctggcaggccatcttcatgcagtgaattgctgtcattggtaggtggtgctttttattgcccccatctccagcagagatcttataaattccctttgcctgaaatcagcatggttgatctcccacctaaccagatttagagtgctttgttttctttaacatactttcccagagaactcgggagttttaatacttttaaaaacaactataactttttataaagtagggaatacttgactgaagtgttgtgtgttaaaacatactgcatgcatccgtggtgtctttagttatggggaatgttagtagatgtgactcagagagggttccttgaggaactcattttagaaaatgcagtgatttcctccttagtggttcagaatgcacattaaagagtctttaaattctaagtaaatctgcttaactctgtctgcgtcagagtttcccaagctaacctggagcacagaacacttctgagataatgcgtggtatgttggtgttgatacacgcagtatactcatgctctcagagaccggtttgataaatgccgatctttgagaatttagaggcctaatttgtagacaacattcctgataaaatgagttcacctgtagtggccagtcctttggggtttccataagcaatgtgagatacattattttctaataagacatccaacaatttgaatattaatgttcaatggaattaattttgcatgctaaaagccaactgatgattttagtggatctctcttaacaatcattctttctcatgtctaaagatgagtttgggttatttctcctgaaattatggttaactaactttcatgaattttactgaaaatgatgagaaacagaaaaatctgggatttgtagacagtggcgagaaactctctgtctagtatttatacccctcaccaagcagcactcctgggccctcaagctctgctgctgtgcagaaaccgttccagccgccttccttaaatagcaagcactgccatttcaaacacaagataaaattaatattggcattctggaaattagcatttttgcactaggattaaattaaattagttaaacgaatgtgacagcatgacaaagctggtctaaccaagccaatcaggtattgaaagtggataaatgttgctgttgggtgaatagctcctactcggcagttggtgggatgatgtagcgtaggctgtaaaccccatcttggaataaagacctgcaggataaagtgcagtaggacacgtggggttcagacagctgggccctgttttcgtcctgtggagctggagggaaggggccacagggactctgggtgatggtgaggagatgttcacccccttttctgagtccttcagatgaactcagtcgagcttaaagtgatgtcaccaagcagtaagggaacttttttggcttgttggttttgtttgctgaatatatggatggaaagaaatatcatgaaatttataacgagcagtggctttatttaaagatcagagacttcatagcatctgtaggttaagacctgggacctgctgccaccctcaagaggatctgctgcctcttccctgaggaaaactggcagcaggaagagagctctggaggccaatttctcagagataagggcttcttatttttagagatcactacaatcatgcccaccccgggatgcatcctcttctcaatttcatgtggttggagagagcttttgactctatgctttgataatagctctgaaacccgataagcagttcattttctctcttttaaaaaccttgctagttaaaaggcctcctcatatttttcttttgcagattgccttaaatctttttttaaattcatggaatataaatgtatactcctgattgccttagcagtgcttactatatatcttgagataattaaaaatcacatcagccaggtgcggtggctcatgcctgaaatcccaacaccttaggaggctgaggtgggcggatcacctgaggtcaggagcttgagactagcctggccaatgtggcgaaaccacatctttactaaaaatacaaaaattagccgagtgtggtggcacatgcctgtaatcccagctactcaggaggctgaaacgggagaatctctggaccccgggaggtggaggttgcagtgagccgagatcacgccactgcactctagcctgcactctagcctgcagctgagatgcagcatcctcaggctgaacttcttggaaagcatgactgtcggggaaggaatggagagactaaagaatttgatccagttccctcacaaaaattagggctattgttcatctaaacttctcataaatctggatcaccagtggaataatccatttctgcatttagcctccgtcttattttcagcctacttctagaaatttaaatatacattggaaaatatattgtatgcctaggttgaaataaaagggtttttttttttttttttgccagtctggattgctgtttgaagtattcaattttagagtgaatacaccaagagctacagctattgacttgtatgaaataaatcatcagtcttaatgatagctctttgagttacattgatgggtgggctcactgatacacaccacacaactctgggtgtatgtgtatgtgtgtgtgtgttgtgggggcaggatcacttgccctcgcaacctgaggatctgaaccaaccaggaacctcaggaaaaaaagggctgctatgggctgggcgcagtggctcacacctgtaatcccagcactttgggaggccgaggcgggtggatcacgaggtcaggagtttgagaccagcctgaccaacatgatgaaaccgtctctactaaaaatacaaaaattagccgggtgtggtggtgcgcacctgtaatcccagctactcaggaggctgaggcaggagaatcgcttgaacccaggagatggaagttgcagtgagccaagatcgtgccactgtactccagcctggaggacagagcatgagttcgtctcaaaaaaaaaaaaaaaaaaggctactgtgtcttcttttctcttcctgtgtgcaagtctgtgatttcaaggctatggccatgttacgtgtagccgtacccatgtcttgaggtgcagccccgtgtgaatgtgtgtcctgggatgtagtgagatgtgtcgcctctaccgagctgtttctaattttgttggattcccttttcatttcacatctcagactcaagccaaatgctgcctcctttgaaaccctccttaacagaaacatgaggaccatttataaaaggtgaccgtagtgtgagataaggggtggaaagtactgggatagcacgtggaccttgatttgatcaaatggaccaagtctcataaaatggctgctgagtgcttttctatttagaaagagaatttcccccaatacggtttcatttgaatctcacacaatccaaaaacagagatagtattagtctcagtttgtaactgggaagatgagctcagagtaaagttccatagctgagaggagcttggactctaaccaagacgttgtatgtgctgtgctgtcttctgtttcccccatgctttctatagtttaaaaaagaaaagaaaagaaaaatcacaggcggccctcgtccatttagatctttatataaaccacctttacccgctttgtcctgcccagtcctagaaaatcagaaggattagatgcctttgccatttgccaggtgttattgttgagtgcagagcaggaaggacacaggtaataactcccagagctttcattttagagaagaacgcaggcatggaacaagtaattcccaagaccacaattattgagaacaaatagtataacaaagacagctaaaatttatgttaatagttgacttattaagaacttaatatgttcctggtgatgtttccaatattctttgaggtatataaaaatgaattcttggccaggcgaggtggctcacacctgtaatcccaacactttgggaagccaatgcgggtggatcacttaaggtcaggagttcgagaccaacctgaccaacatggtgaaaccccgtctctactaaaaatacaaaaaaattagccaggcgtggtggcacttgactgtgatcccaactacttgggaggctgaggcaggagaatcacttgaacccaggaggcggaggttgcagtgagccgagatggcaccactatgctgcagcctgggcaacagagtgagactccatctcaaaaaaaaaaaacaagagagaaaaatgaaaaaatttttttctttttaaaagccagtcaagtttagcagtgtagggttgtataccgactttagtaacactgatgttaatttctgataacccactaccatcggaccagcctaaaaatgaattcttaactccattttacagagaatggggaagatatgagggaggtaagaaatgtgctcaaggtcgtgaaagtaacttccttaaggcggaagcaaatgtatatgaaacacacttgtgaaatgggtacataatgcataggatacatgtgttctctgtcaggagcctgtagtggcctgctgtagaactgtgatatgcttggctccgtcccgttcaatgtttttgatgaatggcttagctgaggacattaatatgttatttacatttggagatgatataaacagaggagttaaagctccagcagtgtggcctgttggcctagatgatcttaaaagatttatgaaccctggcaagcaaggttattaacatgcttgaagcctaagaatctatgagttttagggttcaatgtattttcacttctacagtgataaagtgagtaaaaaggaaaccgtgtctgttctcccaatttccctctaagaggataaaaccaaacaacaacaatgccatagaggtaaccattattaaagatttggtacatattgttccagactttaaaaaaaatgcttacacaaacattgactccttttctctctcccttttcctcttcctctccctctttgtcagtgggttatttttgtttagtttggttttaaacacataaaagaatcattctcagcaacttgcttcttttcccccttaagccagggacatcttcacacatgagtgtgtctaaatctacctcatagcttttgatgttgtctattgcatgaacatttcataatttaactactcccctctactgatagacatttaagggttttttttttttttgctattatgaagtatttattacttatttatttttcctttgtagagactgggtttcagtttgttgcccaggctggtctcaaactcctggcttaaagccatcctcctgcctcagcctcccaaagtgctggaattataggcatgaggcaccacgcccaaccctattataagttattatgtgttgcacctcataaatatgtaatgccatatctattagaatggcatggtgtagctaatgggtttgcgtatttaaaattctatccctatttccaaattgccttccagggatattgtttactgatttgtactctggtttttattttttttgtttgacatttttaaagatttactttcaaaacactttctattagaatgaaggagaaaacacaatgaagaggtttctttacaagttttgtcgtgggatttaaaattccttccagataatctttaagtctgatgatttgatcatttgtgggtgtgtcctggttatattggcttctggttccttcccacgaaggccacttacaggtttgcttcttggtcatactgcccggggtgggacgaattgcccctttggagcctcgtctactgtgtgaactgcaggagtgctgggccacttgcacccggtcgtccaatgaggatgtagatctgggagtatcacttctgcagtgaaaagggttgctttggttggcttacctcctctgcccctggcatcctgacagctgtcaagggctcatcatttcacaacttcattaaacagcctggtactcctgtttcttactctgcaaaggaggtccctagcacgttgtggactcctgtggagaaggaagtggatggagaagtctcctagtttttctgtggtgccttggctaccacttggacattcttggttgttgttcttacagaaatgagaggaaaacactgttgctggaaacatttgaggtttttagggtcttttttttttttaacagcttgtttagttgtaatgtggtaatacttcatgggaataaactctggctgacccactcaaaggatataagcttgaaaacatttagggttttgatttgttcaaaggaggcatttgtgctttttgaagcacaaatccagtgggaaaataggttttctggtgcttaccatgtttaagtgtaaggagcgtgtctttcaagtctagttctcatctcaaaagaaataactatttataaaactaagttcagggtggagggataaagctatgcgaggaagcttcggagtggaaaaagtgaaatatacatttcctccttctttcttgtttggtaacagttaagtcccagtattactttcctccctgaaatgggtggtcctcgaatcccatctggctccaatgaatcccatctggttccaccgcctcctgtcccatgtgccactatgttgtgtctgcatctttcagggtctctctgggcagagctgtgtgtaaatcctgtcttctgtggccatttgagttgcagacaggagagactgattgaagttaagcaaggtgcgtgtttattaataaagaaatgtacccacaatgtatgaaaccatcaggtcataaaataacacgtgttccccattattttttaagtgaatgcttgtgcctgtatatatacacacgtagaaaacacagaaaagacttaaatgaatgtaggtttgatttcctctatttgaggtgactttaacttattgataactctcagaagtccgtgaatttttaacaacggtatgacttatttagacggtttggggatggaagaaaaaacaaaaacacttttgatttggagtgaaataaagggaattatccatctttaacaacacgtgggatttgcaaaagtgtggacatgtctgaatgtgacaatctgactaggaatgaagtcccattttgtgcggatgttggtgcctcataggctctgaaagctcacctgagacatcacccttgaggtcaaagcttgggtaccctggcgggacgcaagctattcacatagtaaaatagactcaaaactcaggttcagtaacgtcactgtcataaatcgttttctaccgaagttaataatgtatctacggcctttctcaagtagggacagttaccctgtggttactgaaaattagtatctcataatgtattcattatcatacttaggatgtaaggatgtgtagcatttgacctcagtttttaagggtccttctttttatcatctaatgtactttgctatgtgtgtgtaacatctcttttttttttctttttttttttttaagagacggagtctccctctgttgcccaggctggagtgcgtgatctcagctcgctgcaacctccgcctcccaggttcaagtgattctcctgcctcagcttccctagtagctgggattataggcgcacaccaccacacttggctaattttttgcatttttagtagagacggggtttcaccatgttagccaggatggtctcgatctcctgccctcatgatctgcctgcctcggcctcccaaagtgctgggattaaaggcatgagccactgcgcctggtgtaacatctcttttttaaatgatgtttttatttggagacgagggtctctctatgttgtccaggctggcctcaaacttttgggctcaagcaatcctcctgcctcagtctcctaagtgctgggactacagcgcacgtcacagtgcccggctcagtaacatttctaaaagagtagacggaaatttgtgcctgtgtgctatagtcttcatgtttaaagagactcagtttggctccaactaaagataccttggattgggcaattcacagaggattataagaattttttcaataattttaggtacttggtagaaccctaaactctatagaacttcagagttctggttcctaaataagaggcacaattgaccgaagtttattgcattgaaattgaggtattaagatggcttttttatgttccctgtttagtttgccatatcatgaaactgtgtatgtcaacagtttctaggtttaagattcactgggttaccatgtagcccacgataatatgtgattcctgctttcctcccccaacttttcttcctgttactaatcaaatctaagtcctgtgtacatactcaatgatatttagttagaatactctgacatttggctgggcgcagtggctcatgcctgtaatcccagcactttgggaggctgaggcgggcggatcagctgagatcaggagttggagaccagcctggccaacacgaaatcccgtctctactaaaaatacaaaaattagctgggcgcagtggcaggcacctgtaatcccagctactcgggaggctgaggcagaagaatcacttgaacccaaaaggcggatgttgcagtgagccaagatcatgccattggactacctgggggacaagagcgaaaatccatctcaaaaataaaaataaaaaaaagaaatactctgacatttttgcagatgggctttgtggagacacactgcccccttctccattccctaccccctgcttttgtctttaggtttcatttaaaatgcccatctttcatattttggtaagagaagactttaagtggaaatgtaatctgagtattctgtttaataaatggactcagcatgggcattttgaagccaacaatcccatctgtagtgtaagtattaaactacagtggtattatttcaggaggaagctcatgcagttgaaggacagccttgctgggagccgagaacagccaggtgaaatcaatttagcacaacttaaggcttctggattgcgtgtcttgaacccactgtcccttcagcgttcagggtctaagtcagtggtgagtccagagtcattcattggcctggaagcaggatggaatgatgtcagatggagtgcagagttgagattgctttgtagcatgcaggtctgtaccagaccttttccagaccggttccagacctggaataccctttaagtcattttataattgtgtgtagtaacaggaccttcaaagcatggcacgtatctttgtaattgtgtgtagtaacaggaccttcaaaacatggcacctatctttataattgtgtgtagtaacaggaccttcaaaacatggcacctatctttatgttgagagcctcaaacagaaaaacgctggaaatagttggtggcaagagttggcttcgggccatgatgcccccattcctgagctgtgtgacctggggcaagacaaccccaccccaccagaattgctttgagtcccggtgtcattattataaaatggaaataatagcagctgcctatgttggttttaagataaatgagatatctgtatatataacattgctgtatattacattgttgaaacatttaggttcctaatggttattgtttctattggcttaaaatttttttacctatattctcaggattaaaaatacgaccaagagcaagccgggcacagtggctcacacctgtaatcctagcactttgggaggcagaggtgggtggatcacttgaggtcaggagtctgagaccagcctggccaacatggcaaaccacgtctctactaaaaatacaaaaattagccaggcatggtggtgcacgcctgtaatccctgctatgtgggaggctgaggcaggaagatcacttgaacctgggaactggaggttgcagtgaaccgagatcacgccactgcacttcagcctgggtgaaacagtgacactccatctcaaaaaaaaaaaaaaaaaaaaaaaaaaaaaaaggattatatgaccaagggcatgcctacatgcctgctgattttgtgggttttttcatttttgttttttgtttttctcgctccgtcacccaggctggagtgctgtggctcaatctctgctcgctgtaacctccacctcccacatccacctccaggttcaagtgattctccttctgcagcctcccaggtagctgggactacaggcatgcaccaccatgcctggctaatttttttgtattattagtagagacggggtttcactatgttggccaggctggtcttgaactcctcgtgatctgcccgcctcggcctcccaaagtgctgggattacaaacatgagccaccacgcccggccatgcctgctgattttgaaactgatgccatcagttgcacagggcatcctatggggaggattgcaaatgaccattgtagtaatatttttaaggaaaaaacaatgacccaaatggacatgttatatgtgtcttgtttgcttgctgggctctgggagcactggccttcgcgccaagcggcctcccttctctgcaccccgtttatccttttcttacacagcccttgcctgtggaaatgagatctcagctttaccattgcttcctcagagaagtcctggacacccccagcctcagtcagggctgtttttttttttttttttaaaacctacttgattcattctcaagggctctgtttattgttatttgttctatgtatgcctccttcatgacagtttccacagctgcagtttagtaattatttgtttaaaagtctgccttctgacttgttcagtcaattatgcttaacctgcatctaatcacaaggaaacattatttattattttaaagtaaaaaagaggtttttaagtctgccttccatagtaatttgtaagctcaaagctctgggaaacacatctgattttttcatggttatatttgaaataggtctggaaaggtgaatgtatgtatctggtgttccaatgaatgaattaatgagtggatgaatggctgatgggcacacttacccagatacaaggccctatctgcttgtaaggtagctggatctttcagacaaatataagacttaactcttcattgtttttgaacttccttttctctgtatttcttctttcactggtttgtattctggaagttaatgccttgtttctgacttggtcatgaggactgaaattaagtttctatggctttgtcttttccatagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagagggtaagccgcccctccaggaactggaaggcacacagcacttgcaacaaactttggactcagcagaaaatactctgtcatactgcctggtggtggattggtgttaacagcaaaaacaatcaattggttacaaaaggaagtatttatctgaccatttggataccccctatacttagaccttgaagttatgtttcctttttcttatctggaacttgatgctttttaaattattgttgctttgtcccaactgcttgtctggagttgaatgtgaattcttgttggaaacagaagtcatggttgctttaaaagagtcattatctctccctctagagaggagcctgctatacttgtacaactctttctgataggcgcattgcaaggcacgtacccctctttgcttaaactatgatgtgctgcgtgttttatagctcttgagcctagagatcttcgaggaatggttattgaagagtgaccgtttggacacagtattgggatttgatttttacccatatagggggtgaggaaccgtatcttgaggtcagaattgagagcatgtggcccagtaagtctcttgtgaaaagcgaaaggctgcatgttgaagaaggaccttgagctcgttgttccatttaattataaataaagggataaccaataactgctatcaaatatatgtaaaatgatgattcggcatacggtaaattgattcgtgtaatatgaataagagagacaaatgaagggaaaagtcctttcacaggagattcaacatcgcctcacttagatgagattcttcaaacatgtggaacctgtttttcttcttgtttgatgcccccacagagctgcttcaagcagggagctgcttttgaagttggtgggaatacttatctgtatatagcaccacaggcacaatataaagttagaaatatacacagtctcacaggcggagtatttgcatgacctagtgtgagagtttcaaataattttcacccaaatgattggaatggacccaactcaaattcccaagtccaaagctttgtctttcccatgttaacttttgaatcaagtcaagcaccagcaacatgtgagcttactatgaccaagtctgtaaggttaagacaaggcaacttggtgactaccaaatgaattgtgcaagggatgagagctgcagggttcaggtggagcagtcacttgaggtgagaggggagattagggggaggctggatttagatgtgtgtaaacaaggaatgtcagcaaaagtgaggagaataataacagccaacactttatgtgcttttattatagggcccagagaggtgccttttgtgcgttatcacctttaatagttacagcaaccctatgaagtaggtgatattgttcccaagatgcaaatccagatcagcagattccaaaaccacttaaccactgtgctctcactgtgccgggcaggttcggaggctggtgtgttggaacagcctagcccctgcaaagagtttttattgaagggtgtagaatgaaagcccagaagggaaaaggggccagataacagggccctgaaagcagagtggagtttagaaagtatttagtggacaacgtgtgatcactgaactatgccaccaaaggggtgccggaggcttcttgtctgacttaggtgatctgtaggatgtataagaggagggagggatggggcagggacacagtttttttcatagaatcccaaatagcctggaaattcttttttaatctgtggcatgtttactggaggtcttaaggttatcttaccatagtccagatgtgatttcttttacatttcagccacgtgggtaaacactgattttcacagtgagtgattcagtccctcccctgtgactattccatcgtctccctgaggtgacctaggcttctgaccatggcctcggaggtctgagcaaatatcaaatcccccatgcaggaagggtggtgatttttattttttattttttgagatggtgtctcagtctcactctgtcgcccaggctggagtgcagtggcttgagctcggcttactgcaacatctgcctccccgcgcacatcccccgcctccggctccagtgattctcctgcctcagcctcctgagtagctgggacgtgccaccacacctggctaatttttgtatttttagtagaaatggggtttcaccatgttggccaggctggtttcgaacttctgacctcaagtgatatgcctgcctcagtcccccaaagtggtgggattacaggtgtgagccgccacgcccagctgtggaagagtggtaattactatacattttttgttattgttgttgtttgtttattttgagacagggtcttgctgtatcacccaggctagagtgcagtggcatgatttcggctcactgcaacctctgtcttccaggttcaagtgattctcctgcctcagactcctgagtagctgggactacaggtgcctgccatcatgcccagctaacttttgtattttcagtagagacaaggtttcaccatgttggccagtatggtcttgaactcctgacctcaagtgatccgcccgcctcagcctcccagagtgctggaattacagacgtgagccaccgtgaccagccaattaatataccttgtccttcccaagatcttgaaaaggccttgacctctaggaaaaaagaactagatgtgcctccataccatagcccagggctacagaggctacccaccagaggtgtttctggaggccttacttttggggtgagcttttgctgttttaggtccaactgctattctcttggtttattaggttctctgtggcaacttggcatactccttctgtttttttctttctctatttttttctgcctggcagatgataattaatagcctgacaatgtaaatacagacagaatcttcgtgttaacttattaaacagcatttttccgtgcttttgacatcagtgacagctcatggttaggtttttgtttagttttgttttgagacggagtcttgctctgtcacccaagctggagtacagtggcgtgatcttggctcactgcagtttccatctcccgggttcaagcaattgtcctgccttagcctctcaggtatctgggattacaggcatgcaccaccacgcctggctaatttttgtatttttagtagagatggggtttcaccatgctggccaggctggtctcgaactcctgacctcaggtgatccgcctgcctcggcctcccaaagtgctgggattacaggcttgagtcaccgtgcccggctcgctcatgattaggctttatggttgcttccagaaatcagaattctatatgacagtttgctgtaggatagacaaaggcataatttggcatgtgacactgacctgtaggatttgggacacctttgtttctaccactgtccacttaaataagaagagaactgacccattttggtccctgggaggactggcccacagtggaatttggtcctgctgtagataaaatagcaagatcaactgatgggagaaaataatgaacaagggccattcctactggagggtttttactttacagtggcagacaaagctagaggtgaaattttttttcccattttgattcacttgctctttctaaaactggaaatactggtagttcagaaccaaccctcctcctataatgaaaacagaattctgcttctttgtaaactttcttaaatgttagaaagaaggaaccgcatataaatattgtctaaactctacagcagggtctgatatatgtagatttggggagggggcttgattatgtcatttggtggacttctataagagcatacacaatgaggcatggacacaaacatttatttataatgaaaataaacacaactaattaccttagccttggcgagcagtccctttcttctgagctttgggattttcagtttatacaaacagcttatatagaaatgcaactgggcttcctctccctaactaaaaagtgctgtcatgctgtgctgttcccagcattcacagagactgcacaagtgccattggtttggggcaaatctgcttctaccgaaaagatgaaaaaaaaaaaaagaaaaagaaaagctccctttccgcaacccaaattatcaatcgttttatagtctatggcttgtacggtcttctctttgttaaaaacccaaacaagagcctgggtgcagtggctcacacctgtaatcccagcactttggggggccgaggcgagtggatcacctcaggccaggaggtccagaccagcctggccaacatggtgaaaccccgtctctactaaaaatacaaaaaattagctgggcgtggatggcagatgcctgatatcccagctactcatgaggctgaggcaggagaatcgcttgaacccggaggcggagggtgcagtgagctgagatcacgccactgcactccagcctgggcaacaagagcgaaactccatctcaaaaaaaaaacaaaaacaaaacagaaacccaaacaggaatgatttttaaaacattgtatcttgggctgagaccaattttagatttaaaagttttgcaggctgggggcggtggctcacgcctgtaatcacagcccttggggaggtcgaggctggggtccaggattttgagatcagccaacgtggcgaaaccctgtctctatattttttttaacttttggtaattagaacaactttgaaatttaaacgtgaaattcaatcttagtatctgttaggcagatgatttttttttccccgaacagttgaggaaaatcagttactcaaaaagcaacaccttatttattttgataatagcatatttgattttgaaataaagtgtctgcaaaactcattgccatatacaagtaatccagtgattatctcaggtcttcatccatttgaattaatcacttacaatgcagttatttgttttctttttgagatttgcgtctctgcagagtacgtacagcaaacattttaaagcatgtgaaaaccagcttttctccaaccttcacaggtcacatttgtttctgtgagcaaacagacaatggcaatcttttccttagctttagaaagttttttttttaaagaggcccttgctctgtcacccaggtcagagtgcagtagtgcaatcatggttcgacgtagcctcaaacttctgggcacatgtgatcctcctggctcagccttcccagtagttaagactagaggcatgtgccactgcgccagatagttctttaaaatgcttttgtagaaacaggttcttgccatgttgcccaggctggtctcaaattcttggcttcaagcttccttccacgtcagcctcccaaagtcttgggactacagaagtgagccaccacagccagccttaagtaatttctgttcacacctcttgtgtacccagagttgaggatatttacaccagcagcaatggagcaggaagcagctgggtgctctgaccttggcatttgccactctggggctagctgctttaaaactgtcagccagtgaccagatgaaccaggccttgttacactaatcagataacggtatagaggcggctcccggtgtgtgcacgtggaccgccactgtgacaccagctgtgatcacaccccccacccccggggaaaaatgagaaacaaaaaccctcaaaatgctgtcacttaaagcagaagtctttgaggggatgtatttcttaacgttttacaggattccacttttctacatctgagtattttcccccagatatagtaacaaatacaacactttagagaatttcatttttctaatggcgcttaatgtcatcgtctgcttttattaaatttgccatttgaacccaccagctcctggtgtacagttcctctgggaaacagaaaggccgaaagattaccgccagataatcccagccctccctaaagatcttgttaccttacagaaaatccattctgagttaaaagtcgttcttctttgctttgaacatttaataactttatctgtatagtaggcaccctaagacctgctctgagcctcttcaaagatgactcccccaccccatacctgtttcctctgcaagaggctgctttctctgcccagaaggaatatttttatgatttgattccttttctatttcagttttcaaattgtgacatcattggtatcttgttagaagtgcctgtcacccacattacagccctccactcctcctttccttttctctacaccagttgttaacatctggcatttgacatctgtctctcacccacactttggctaaaatataagaatcaagcccaggtgcggtgacttacaacggtaatcccagcactttgggaggccgaggagggcggatcacttgagcccaggagttcgagaccaatctgggaagcatagtgagacccttgtctctacgaacgtttaaaaaaattagctggacgtggtggtgcacgcctgtattcctagttgcttgggaggctaaggtgggaggatcgcttgacttgagcccaggagtttgaggctgcagtgagccatgattgcaccactgtaccagcctgggcaacagattgagaccctgtctcaaaaaataaaataaaatataagaatcatgaggacggccgggcacggtggctcacgcctgtaatccccacactttgggaggccgaggtgggcggatcacgaggtcaggagatccagaccatccaggctaacacggtgaaactccgtctctactaaaaatacaaaaaaattagccgggcgtggtggcgggcgcctgtagtcccagccacttgggaggctgaagcaggagaatcgcttgaatccgggagctggaggttgtagtaagccgagatcgtgccactgcactccagcctaggctacaagagggagactctgtctccaaaaaaaaaaaaaaaaaagaatcatgagggcagagttttcttgggatggggattcggagggtggtccatggcaggagatggggtgaggggggctgtttagttcagtgctgaatcctctgagcctggaccagtagctggaacagaggtagcgctcagcaaatatatgaataaatgaagacacagttttcagttggagttcacagtattacatttataatcatctaggtgaggaggagctgttggctttaactctgtatcaattcatttcctgcttaaagactgcggctttgtacattttatccaaggctctctttcctttgttgcatcagcactgacaaagccagaccctttccaggatcgcaccatgctgggttctcacaggtgcttgctgttggttagccaggtgttgcctggaaacatgaaataggaccctgacctgcacgtgattaaatgtggattcctagtaacgctatcaaacacaagtgcccaatagataaagagaggggtccccttgcacacactttggtatttcaaatacaatattattgcatgacattttctcaagctgtatcctgttttgtaatgttttgaagactggagggaacacacacaaaataggccttgaacttaggtaaaagtactatgctatgcgatttctgggaactggttttaattcattctcctgctctgcagcaattgtttttagtgtggctgcactgaaattacttatgtcattgacaaatttctggtccaaatatttcactgccttcatccttaaagaaacagagatttattttcctgtaatcagcagtcaagatgtttttctctgaactatattcaagtctgacagtgcagtgaactttttttccttctgacttaacaaaaggagtgaggaagaaggacagcaagacttctgttcaccctttctccccttcgtaaatcaactaattctagggcgctagacacggctaagactgctttaattactactttttgcgtgatcttgatttgaatacatttctttatctcattgcaagtcagttttcatctatgaaatgagcatccccacccatctccgaaattctgtggctaatatcaatatgactagttatatgggtactaaaaatgaaatagtggattagctaatgaagacacccaagcgacctgaagcaggcagcaatccacttggtaattccgttatgcctttttataaaaatacttttatggcttttctaatttttttttttttttcggagacagagtctccgaactctcccaggctgaagtacagtggtgcagtctcagctcactgcaacctctgcctcctgggttcaagcaattctcatgcctcaggctcctgagtagctggaattacaggcgtgcaccaccacgcccagctaatttttgtattttagtagagatggggttttgccatgttgaccatggctggtctcaaactcgtaacctcaagtcatccacccacttcagcctcccaagtgctgggattacaggcatgagccaccgcacccggcctctaatctgatcttaaaagccattttctatatttgaagttttaatttaattaaacaaaaagttcaaggggggaattttattcaaaaatatcttgaaacataatcctcttggtgtcaaagaataagataaatcccttcacaaatgtggccactaaacgtcatcctctcatccccccatatgtgttctgctgaatgactggcggtcaggactatgtaatagggattggttatagccagggatgggggaaagaagttggtaaatgccatagctgcttgccctaaagattttcagtcagccttggagatgttacctataaatctctatagttcggaggccactcaagtccactttcaaattgggtccatgttctggcccatttgagaaggagccaggcaagtcagcctgtaggcttgcccaagtaacagtctaagaattaggcccttttctgctgggcacagtggctcacgcctgtaatcccagcactttgggaggctgaggtgggtggatcacaaggtcaggagttcgagaccagcctgggcaacatagtgaaaccccgtcctactaaaaatacaaaaattagcccggcatggtggcatgcagctgtagtcccagctattcgggaggctgaggcaggagaatcgcttgaacccggtaggcgagggttgcaatgagccgagatcacaccattgcactccaccctgggcaacagagtgagactctgtctcaagaaaaaaaaaaaaaaagatttaggcccttttccttgaagggactgaggtggtccacaaggagtggctctctgattgtaactaagccactaatggagacatgcaattattttagctgtgtcttagtccgttcaggctgttgtaacaaaataccttagaccaggtaatttataagcaacagaaatttattacttatagttctggaggctgggaagtcccagatcaaggcaccaacagaatcagagtcttgtgaggtcccactttctctggatggtgccacctatgtgttctcatgtggcagaagggcagaggggacaaacaaacacccttaagcctcttatatgagggcactaatcccattcatgagtgctccatcctgaggctgatcacctcccaaaggccccaccctctaatatcatcaccttggtgattaggtttcaacatatgaaattttttgtggggagggacacaaacattcagactgtagtggctgttttatttatggaatgaaaatcttttaggcattttctcaaggactgactcaccttgagtgtaaaacaatttcagtgtcacctaatttatagtaacttttacatgattaaggcaatgatatagtctagagcatgatgtccctgtattatagtgtattggtccattctcacactgttataaagaactgcccaagactgggtagtttataaaggaaagaggtttaattgactcacagttctgcaggggcggggaggcctcaggaaacttaacaataatggcggaaggggaagcaaacacatccttcttcacatggcagcaggaaggagaagtggcgagcaaaagggggaagaaccccttataaaaccaccagatctcatgagaactcactcactatcatgagaacagcatgagggtaactgcccccatgattaaatttcctcccactgagttcctcccattaaacatggggattatgggaactacaagtcaagatgagatttgggtggggacacagacaaaccatatcatatagaaaaggatgctttgataatgtctgaagatatattctctgggcttaaaattcaacaactgtttagcctgttaatcaagatttattcctgcatatcatgcttcgaattgttttcaaattgctctttacttcaagtatcagtatagcctgatatcaggtagttttcctccgacctctagtgttaaccagtgcatgcattagtcattcaggtgaaaagtgctatgtgctagattgaattaattgagtgaactggttgctttcatgtgtcttaacatggacgtgcaatatttagaccaaccgcaggcataaggtcattatccccctgtattaatttgctaaggttgtcatgacaaaatactcgactggtggttcaaacaacagaaatttattttctcacagttctggaggctggaggtccgagatcttggtgttgcaggtttggttcctcctgaggcctctctcttttgctcgcagacggccgccttctcactgtatcgtcacatggtctttcctctgtgcacatgcacattcctggtctcttggtgtgtccaaatttcctgttcttataatttttttgagacacggtatcgctctgtcacccaggctggagtgcagtggcgcgatctcggctcgctgcaacctccacctctgggtttcaagcaattctcctgcctcagcctcctgagtagctgggattacaggcttgcaccaccacacctggctaatttttgtatttttagtagagacggggttctactcttcaccatgttggccaggatggtctcgaactcctgacctcaagtgatcagcccgccttggcctctcaaagtgctgggattacaggcgtgagccaccacacccggccaggactcctgttcttattagggcccaggctaatggcctcattttaacttagtcacttcgttaaaggccctgtctccaaatgcagtaactttctcaagtactgggagttaggacttcaaatgtgaattttgtgggggacacagttcagctcataacaccgcctccatgagtgatccactggaaattcacatttgggaacagagaaatgttagtagaagggagctttgaggctctgaaccaggagcctacccctgtgcaggaggctcttctgcttaaccacttgaaggtttgcggagttttctccataaaaggaagccatttattcctctggagctaaaatatgcctccctccaactgctcttctctgttcccagggctgccttgtggaactacagagaataaactcacctcctttttccacatggcagccctctaagtatttgaaaacatttatcatgtctttcctttaatcttttcttctctaggcaaaacatctcccgagaaaataacctgtctcacattaaaagaaaaactccagggcttatatatatttcagacaggaatgtgcttgatggaagcttgccaaacatcactgggtttcaatttcagtatccccagttttaagaaccatttctttctcagactctttaaaacatgagaacaacttagtttgctttaagccaaatattatatactgaaagaattgactggaggacatgagtcattgatactgaagtatgtgactgctggtataagggaatcccttacctcaaggatgttgcaaaatgagctgaagtcaaataaagtgaagaaaacatcaatatatgttgacatggattcctaaccctggaatgatcagtcacccttctggtacttcactcaacaagatgattagcatacagccttacacaaagcagtagctagagattagagcaagagaattcctgctttccagataactgttagctgtaaataaagtggcagattgatagtgtccaaccaaatagtcagggagcagagccaaggtttgctctcaagcagcctcctgccaagccctgtgacctcaccgtgtaagcttagcattatggactgaaggtttgtgtccccctaaacgtacatgtcgaaatcctaactctaaggtgatgtggtatttggagggaaagcctttgtgaggtacttaggtcatgagggtggagccctcatgaatgggattagtgtccttccctttcaccatgtgaggttacagggagcagtctgcagtccagaagaatccaggactaccagatcccaaccacactggcctcctgatctctgactttcagcctgcaggattgtggaaaataaaagtgttccttgtttataagccacctggtttatatggtgcttttatagcagcccaaatggactaggacaatgaacaaaaagtatgatgtcttctcatgcttgtcaaaatcctggtcctaagtattcccctaatcaagtccatttctgttgagtatgttcaaataccttaggattctttgtcagtgttatcttgatagatgtctggccattggaatctgatgctgtttcgagtcttcatcccttatgtagctcatggactccttttggtcttcagttttctgaatatcttgtaatgaggactctccacgtgaatccgtttccattcaatgtgcggggttctttgagctctttcggtctagaaactcatacacttggctggatgcagtggctcatgcctgtaattccagtgctctgggaggccaaggtgggaggatcacttgagcccaggggtttgagactagcctgggcaacacagcaagaccccgtctctacaaaaaaataaaaataaaaaaattatctaggtgtggtgttgcatgcctgtagttccagctactccagaggctcaggcaggagaatcgcttgagcccaggaggttgaggttacaatgaatctcaccatttacactgtagcctgggtgacagagtgagaccctgtctctaagaaaagaaaagaaaaattcatgtacctcatttctgggaaatttttttacatatatctataccttttcatttggtctatttcatagagttgcctaggtaaagaaataaatatatgtggactcaaggagagaaataatatttattctacatcacttttattatttgagtttttaatgtttattttcccgttgctttttaaagtgattttaaaattctcttttagtgtttctgttgtatcataacaattcctttgaggaactattcttcagagtatttatcttggattttgaatagcaataaccatgtctatacaaacatgtccagttcaactggaccataaaactcaattagttgatatttatctatgtgcatagcatgcagcagagagcctgcccatcctgtagataacctgacagtgtcatttagattcagggtgtgtatagatagatagatacagacagatatctatctatacacaccctgaatctaaaagacaggtgtctgtctatctatctatctatctatctatctatctatctatctatctactatctataactatctagatatagatatatctctatatagatatatatatatagatatagatatatatatctatatagagatatatctcctcttttacagttatccaatttggagctgtatttcactcaactttaaattatcttggagcatttcaaaggaataacaggaggtgaggtcaccccactgattgccagggttgacttggctgatcgggctggctaggcgggtgtccccttcctccctcaccactccatgggcgtccctcccgaagctgcacacttggttgaagaggatgaccatccctgatagaggaggactggtcttcggtcaagggtgtacaagtagctgcgctcccctgctagaacctccaaacacgcgctcaaggtccatttaaaggaataacagtggcatcgattctctgttctatttcatctgtccttttccagcaagaagaaaagagaccctactggtttttggcttcttttcctccaagggcgatgccaggttaaagagaaaatgagaggagaggaggccagggagggttgaatttagtgtgcaagtccattcttccattccgtgacactcatatttgggttaaatacctaagcatccttggaggaagttggagagcctaatattggttttaattctgagtgtagtggtccctgtcccctccctttcaggaaaaatagaggaaagtagcctgctttattgcagccatctgtccactggtcccgcctccagactgcccactccgaggcctctcccgttctcttcctgtgtcactgcttggttttttgtttttgttttttatagagatgggatcttgctgtgttgcccaggctggtctcgcactcctggcctcaagcaatcctcccatctcggcctccccaagtgctgggattacaggcatgagccacctcgcccggcctgtgtcactactttgtgctgtcacactgtggaccactgtttccatgttttaatcctctccacatgtggctttgctgccactttctccctcattgcccctaatccctgtccattcccagggtcctttttcagattcctcttcctcagggttccaggccattcttatttcatggacatcattccgttcgggtgatcccacagattcgcactgcatctttcatcttgtgggcaccgtgactttggactcctccctcaccttcgtcactactgcatccatctgttttgttgcttcagtctcttcctcccgtcatcacagcctggttgccttttctaaatcacagtcaaattcggtgccaccatcccctgcctcaagcctccaatggctccctatagtcttcagaaccagcagcacaaagttcttttttaaagaaacaaaccagcttttgtgagctgtaattcacatactatgcagttgacccatttaaagtacacagttcagtggtttttgctatattcacagagttgtataaccacccccacaatcaactgtgggacattttcttttctttctttcttttttttttttgagagggagtcttgctctgttgcccaggctggagtgcaatgacgcgatctcagctcactgcaaccttcacctcctgggttcaagtgattctcatgcctcagcctcccgagtagctgggattacaggcgtgcgccacaatgtctggctaaattttgtatttttaatagagatgggatttcaccatgttgaccaggctggtcttgaactcctgacctcaagtgatctgcccgcctcggcctcccaaagtgttgggattataggtgtgagccaccacacctggccaggacattttcattacctcataaagaaactccatcctggttagctgtcactccctctcccgccaaaacccccagtcttaggtaaccactaactactttatgtctatggattcgcctcttgtagacatttcaaataaatggaattaaaccgtgtatgctctttggtgactagcttctttcacttaaagttttttcaatattcatctatgttatggcatgtttcagtactttatttcttattactttttattactaacccatttccattaaacaagctcaattttatttatccctgcatgagctgatagatatttaggttgcttccacttttggctactaggaatattatgctgtaatgaacattgatggacaagtttttctgtgggtgtgtatttccattgctcttggttatatgtctaggagaattgctgggtcatataataaatttatgtttaacattctgaggaactaccagcctattttccaaagtggctgtaccattttaccttcccaatagcgatgtgtgagggttccaccttctccattccttgttattgtggtcttccttgccccccgccacctgcccctgttttttaaaccaggcacatcagctttatgtttttttttttttttttttttttttgacacagtctcactttgtcgcccaggctggagtgcagtggtgcgataccatcttactgcaacctccacccctctgggttcaagcaattcttgtgcttcagcctcctgagtagctgggattacaggcgcccgccaccacgcccggctaatttttgtatttttagtagagacggggtttcatcatgttggccaggctggtctcgaactcctgatctcgtgatctgcccacctcagcctcccaaagtgctgggatcacaggtgtgagccaccgcgcccaacctgttgtcttttttcttttttattatagtcatcctagtgggtgtgaggtggttttgatttgcatttttctaagggctaataacgttggacgtattttcatgtgctcattggtcatttgtatattttctttagagaaatggctactcagattctttgctcacttttaatggataatttgttacaaagtctttaacatgtcattcaagaccctttataaatatttttagtttcatctccagtgttgtcttccccgccaagcccccaactcccggacctccctaagtaaactccgaacctcatagctgtgaggaacccactcatgattgcccaaatgtcctgctcttggcatctctgcctctgcccatgctcgtctgtccctatggaccgccttcctttgtgccccaggtagggagtgtcccctcatcccttcagagaccagctccaaggctacctcagaggtgagccaaactagagctgcccactcccgccactgggcgtgtccaccacccactcccgccactgggcgtgtccaccacccactcctgccactgggtgtgtgcaccatccatgactgagctcccgaggccagggatagtatctcatttagatccctgggtgttttgcgtaataaatatggagcaacaacttggtaaatatttgttgagtgaaccattctgatttgggaaaacacgttttctatcatccatctatgtattatacagcaaaatgtttcctataattcttgctttgggtggtgatgtcttcctctaaaaatcctaatttaacaaaaacagagaatggaaatgataaaagaaagtctcctgcattggacagtgaccttaggtctcatctttactcctgcttttatcctaattgatgacttttctttgtaaatgcagacacacagaggctcgctgggcagctgggccgtgcaccctgtccttgatcattcttagaggtagagatcaaaggagacccattggctgagagagtctacaacttgccacatgatctattgctctgccttgtgattttaattgcctctttaagaatatcaaatcaggccggacgcagtggctcatgcctgtagtcccagcgctttgggaggccgaggcgggtggatcacctgaggtcaggagttcaagaccagcctggccaacacggtgaaaccccgtctccactaaaaatacaaaaattagccgagcatggtggcatgcgcctgtaatcccagctacttttgggaggctgaggcaggagaatcacttgaacccgggggtcagaggttgcaatgagccgagatcgcgtcattgcaccccagcctgggtgacaagagcgagactccatctcaaaaaaaaaaaaaatcaaatcagatgtgttagcgtcttcatgaatgtcataaaaagaaatgtttcagtgccaaaactgaacagcagtacagtgacctttgaaaatgttgtttagggtattaaatgtgtaactagtgacattttgtgtgtttttctttttcttcctatccagctcagtggaatagctgttgcttgtcccagtgttagaatttggactgatagaaaggagaggagctggagattcattctgctctgcaagggcagactcgatttcagaagtggcaccagatgatagccttgtgttgtccccaaccactggtgctgagaaatgatgcagaaccaagccctcagatcccagatcacccacggctcctgggacatctctggggaagggacttattaatgtagaccctgatgcaacatcccaagtcgtctttatccatgatttgcacagccaggacactctggggctgggattgggaggagaggaatggccaagttgccctgcccccttggctctgtggactccagaaggatggtcagtaccagcagcatttcacacacaccagcctcattattaaaattggagcaatttgtgaaatagagttgagacttctctagagaaaaaaggttgggaagcagctcagtggctgggtctgggagtcagcttccaggcaatatctcactgagtcaggacaaggcccatcattccctgttcccgccaggccgggtatttgccaggatgtgaaacggaagccaggcttttggagaggctgaagctgatttttgtaacaaggtctggttaccagcaaggaagcggttttcacgttgctcactctgggcccgagtgtggtgcatcgcgccccctggtgcccaaaaagtgcaactacgtgccatgccagccagctctcctggacttccatttttccctgattctcctgttcctcgcccacccttctctttgctgtgcccactgtggtctacgccgaggctcccctccctcctccctgccccaagcaataatgaacaagatcttcattctctgaagagaagtgcaatagtaaaactttcctttttgtttgtgtaggggaagagctggtgttaatgggtcaggcaggcaaggcatgaagtgataaatagggaaaggatgaaagaagggaacaaacccaggggacctaacggacccaccctaacaaaaaattggagtacaaaaaaagtgtattaaaattgtgagaccacaccaactcattcgtcactcgtgtctttacaaagaacaaacctgaagcttcaatgagaaagaattgaagtattctagggctgcctgaaatcttctgaacttttaacataggctttgatttccgagttgtgtgcttgcatgttagagatatgatagtgtctaaaaattggaacatggcatagtttgatctaaaaagttagctaacttctgccatttagaaaaagaccccatgctcaagtctgcttttgaaaagttgccttggtcaagtgttgaagacagcacttgttagaaggaacaagttcacttctgagagcccttctcaaagagtttaggaaacagcactactgagagttgccagtcttcagagcagtgcaacgtgtgtgtatgcgtaagacacagatggtgaaaatatcaaatgctacagatgccaagaagggaggtgttggcaccacaccaacctttaaacaaacataaggatgcagaatgcagtctttaaaatggagggagaatttactgtctgtgtggctatttccttgaaatgacttaaaaagctgagatacagaagtattagtaaatcggtgccaggaatgaagtaaccgtttagatccaatgcgccggctccagcatcgaactcatgcccagcaccctttaaaccctcccgggactctgcagaacccgctgaccactcacagagcccagctcgggggagggctttaaggtgaagcacgtgaccccctgcttgtgcggcccgggcggggaagtttgcgctcccgaagtcctggagctcagcaagggaggggccagcgccagcccgcgtgtgggtggctgggtgggggcgtgggtgggggtccgcctataattatctggggaaatgcatccgcgctctgcttttcgctgcggcagctccgagggcacctccggttctcccccatcctccgggagtgtctgggcgctcagtccgctctgatcccgccgaaaccacctgcggttggcaggcaggagactaggcgtctgccggggagggcagggacccgctaagctgatctcctgtacagtagtgctacttaaaatatgctggggaccatcaccatcacaggtaaggcacaagccaggtcgcttttgtcctccctggacggcaggcacggggcacgaaaaggggctttcttccgttgaatgagcgtttggtggggagcccgggaggtcagtggcgggaccgttattggcatttatttctctccgtgtactgagtttttcttcagaagaacattctcccttgggctcagcaagaatcagacaacctcagtgtttcatttttggctgagctggaatcttcttgactgtgcctatgggagacctttagtatattttgttcggggttgtacccttccccttagggagagagggatgtggagaggaacaacagcagccgactgaatagaaatatgtcagatttgtgtgaatttgaaaataagctgtgaaagcttaatctcttgccgtagtcatagacagaatacattcctcttctgggcaaattacaagtgtttgcattttgacttgtttactaggaactttgaataaaggtacacttggtggtttaggggactaacatttaagctctgctttaagtggtggttttaataaagccatagttattataaaatcggtggctaggaagcaacactatttaggcaacaaatagtaaaaaaaaaaaaaaaaagaaaaaaagaaaaaagtatgtttctttagcttactttctaggaatctggccgtgagtatgaattataatatttactgcctacttctagcaaataacttacacgcatcaaacttttagaatgctcttacagctcctctaacttgacatttgatagtcttatgccattgtactgtggcctaacctgcgtattttctcttcctgtcatcaagaaaattaaattccgtttgtgaatttaactttataggaacaggacttctttattctttaaatatttgagatcattgctgccaaatctttttttttgtttgtttgttttttgtttgttttttgagatggagtcttgctctttcgccagactgaagtgcaatggtgtgatcttggcttactgcaacctccacctcctgggttcaagcgattctcctgcctcagcctcccgagtagctggggttacaggcacgtgccaccacgcccagataatttttgtatttttagtagagccggggtttcaccaagttggccaggatggtctcgatctcttgaccttgtgatctgcccgccttggtctcccaaagtgctaggattatagacgtgagccaccgcacctggcctacattttttttttttttttaatcaactgtagaatttctaggacttaaaattttctcaatgcaactgctcctgcaaagccatgcgctccagtggaatttacaagaatgtgaaagttcagcaatactaaaattatctctcacttcctatagattagcttgtttactttgagatttccttaaaattcgacccccaagttgacttggctaacctttctaccatttactcagcttgaaagtttatgccatatctcgaaactattaataaatagactgtacaaaatgaaaaaaatttaaaacacaaaaatctccattttttcccccagatcattaacttttctatgaatgaaatatgcaaatgtgtattgtagggagtcacagctggggtggtgcttctgagatcatgacttttttctgagtactttttgggtacaatatgatttttattatattcactattcaattagtcgcatactgagattcctatggtaaaaggaggtggtctaaagttttagcagtaattaaaggttaataaactgggagcacttgagggggcttgtaatagttggctcagataatcccaatggagtgataaatgaatggaaatagtgggaaggactaacttttaaggcaaaatcaggtaattggctctattgctttctaaatttacttttcttacaatgtgggtgtggaggatatggcaaaattttgcactttttcctggtaagaagaaagtgcacagaaaatcttaactccaaaaatttaccagcaagaaatcttacgtagtggaaaaagtaaaaatgaaagggagtttcagctgtcatttggtttttgctccgcaagttattctgatggggaagattcataatcatcatctttaaatagttgctcagaatcttgaaaagccatgagagctttaaaaattgacagtaacaaccgggcgcggtggctcacgcctgtaatcccaggactttgggaggccgaggtgggcggatcacgaggtcaggagatcgagaccatcctggctaacacggtgaaaccccgtctctagtaaaaatacaaaaaaattagccgggtgtggtggcgggtgcctgtagtcccagctacttgggaggctgaggcaggagaatggcgtgaactcgggaggcagagcttgcagtgagccgagatcgcgcctctgcactccagcctgggcgacagagcgagactccatctcaaaaaaaaaaaaaaaattgacagtaaggtggccgggcgcggcggctcacgcctgtgattccagcactttgggaggcggaggcgggcggatcacgaggtcaggagtacaagactagcctgaccaacatggtgaaaccccgtctctactaaaaatacaaaaattagctggacgtggtagtgtgcacctgtgatcccagctactcgggaggctgaggcaggagaattgcttgaacctgggaggcagaggttgcagtgagtcaagattgtgccactgcactccagcctgggtgacagagcaagactccgtctcaaaaaaaaaaaaaaaaattaaattgacagtaaggtttaatgaaatcttaaaggtctttgcatctttgggattattcacttaaatactatagaaggttattgtagttatctttagtactatgttattttaggaggcctgtgtttaaattttacaattcattaacaggactgatggcattttgtaggaactacttaggaacaagtttgcatttctgaaagtaaggaaaagctgtcacttaatactattatccccctcccccctgccacacacacaacccagtttacacaaaccactaaaatgaatgcagtggaaattgaattatgaaatgattgcttattcacattacatactgttgccattcttggggtctctttctctcacatctcatttgcaataagttagctttgagacaagaaataagtgatgtgacacgatgatcatccccttccccactcaactgtaaatggcgtgccagcataaaaatgcctttttttttgagatgaagtctcactctgtcacccaggctggagtgcagtggcgcgatctcagctcactgcaacctccacctcccgggttcaagcagttctccctgcctcagcctcccaagcagctgggattacaggcacctgccaccacgccccgctaatgtttgtatttttagtagagacgaggtttcgccatgttggccaggctggtcttgaactcctgacctcaggtgatccacccgcctcagcctcccaaagtggtgtgagccaccacgcccggccaaaaaaatgctttttgaattaagcaagtatcttttcgcttttctctaacacccacattactgaaactgataatattgatacattgcaaactgtgaagtatcatgagaaacagggacattattctttaaagtagaaactggggaagaatcaatcctccaacgttcatgttagttctagattatttataatgcactttccgatgcaaataatttttacaagagaaaaaaataccttgcacatgggtgtttcacatctgctatggagacagattccttgtcaagagactttggagacacgaaattgatactttcacaactgctggattaataactaccacttcctgagtgcctagtctggcaggtgttgttcagcactttgtggacattatcatgtattcctcacaataatcctgcaaaaagtggttctgtaaccccatttctatcataaaagtaagtttctcatgatttgataattacccaaggtttcacagctagaaagagcataactgtagagtaccttgcaaaagacctctttctcgttgtgaagatgctaatacttgtttagtgacccacattcttacatgcctgcccagatgtttaagggatcgtgaaacatcaatatcaagaccagggattgggactgggcacggtggcttatgcctgtaatcccagcactttgggaggccaaggcaggtggatcgcttgagtccaggagtttgagaccagcatggtcaacgtaggggagacctcctctctacaacaaattaaagatttagctgtgcatggtggcacatgcctgtagtcccagtcacttgggaagctgaggtaggagaatcacttgcaccactgaattccagcctgagcaacagagcaagaccctgtccctaccccaccccccaaaaaacacaccaggtccaatgatgatgtcacctatatgctccagtatgggatccttgcttttatgaatttgcatatatctccgcttggaggttttctggttaatgagctttagaacaagggagattgggtgtgtagcctataagggatggacttagaatgcagagaattcctggaaaaattccaggacaatgctacgaatcttgggggaaagataactagttccagatgttactgtaagccgtcctgatgtgcctggggatggggagcactggtgattctcagcctgaaaaatgaacatgtcgtttctgcagtatcgtacttctttttctcaaccaaaaatgatggtgctggtgtcactgaaacctgatagctaagttttggataaaaacattaatattttgtagtatataatcaacatattcctttaaagtttttttttcttttaagcctctaaaagaaaacaatttataatttatctcttaatcgctaagtatttggaaaagtgagaaaaaaaagatgatgctccaggttttgaacacacgggctgtctctacattatatggagcttgcggatggggaacacatagccagcagggaccactgtagcttagcccttcttgggatcatggagcgtttgcagctttggggacggggagattatggagattttcgaaaggaaaatgtgtatttgcacatacacgttatagacctggagactgattttataaatcgggattcacagaacatttatctggagataaacccaggttaatagcaggtaacaacacctcagtgtgaaacacttcagtaattcttggcccaagtgaggtttttgtacatgaaatgatttcaagttttgatttcttactacatcactaaagatgtaacttttcatatattttcacatttatttgactccgttaatattccataggacttttttttttaaccttgaaggggcttgttatgacaaagctgtttaaaatattaaaaagcacctagtttgttattattgaataagtgttataattttttttataatgttgtaattgagaatagtttatactcttaaaaatagggtgagaggtgttcagtccaggaagtatctcctctatttcactttccacacttattattaaggataactttcatttatcttagaaaaacataaagcaaaagcctacccaaggtctcgcttggcagtgataacttcaagttatttttccttccggaatgttgtagcatgaagtagcttcatccatatccagcctttatttttactgcatctttttaaaagttttggccgggtgcggtggctcacgcctgtaatcccagcactttgggaggccgaggtgggtagatcacgaggtaaggagatcgagaccatcctggctaacatggtgaaaccccatctctactaaaaatacaaaaaattagccgggcgtggtggcaggcacctgtagtcccagctactcgggaggctgaggcaggagaatggcatgaacctgggaggtggagctggcagtaagccaagattgcaccaacgcactccagcctggacgacagagcgagactccgtctcaaaaaaaaaaaaaaaaagttttgttttggagtactagtagcacgatcatagctcactgcagcctggaactcctgggctcaacgatcctcctgtctcagcctcccaagtagctgggaccctactgagtagcacgtccagttctgggtctgtttttttttttttttttttttgagacagtctcgctctgttgccaggctgctggagtgcagtggcatgatctcagctcactgcagcctccgcctcccaggttcaaatgattctcctgcctcagcctcctgagtagctgggattacaggcgcccgccaccacatctggctaaatttttgtatttttagtagagatggggtttcaccgtgttagccaggatggtctcgatctcctgacctcgtgatccgcccgcctcggcctcccaaagtgctgggattacagacgtgagccaccgcgcccggcccagccctgcatcttatatgcactatatccatgcagagatccctccttcttgggtatattcagaaaattaagtgaatgaaagctttctctacatcttctttaaaattatcatatcttttccaagtaatgttttcagcatattgaccctgtctcacacaagcatgtgattaggtgtctccacccagaagaagggtatagaaatatttggtttctgtagtaatattctcttgagaaacaaggcatggatgatgttgtttcactaatggttgatgtcgaaagccctgtcaatacaagactgtatcacacatgggtatgtggcctgttggaaggattagtctttttcctgcgctttgaagtgtctacagggtgggaaaagaccagtgactagcaggacagtacgaagacggaggtgcctgtgaattcgggctccagaggcttctacgggggacacaccgaccactccctttaacattttggccatctttgtgacctagtgggatgctggaattgtttctggccgaacctcagcaccagtgagtacgtgagcaccacgactgggctttctgggcatgggagagacttgggcggatagcagcgtgtttaaaaatggcggggtcattcaatcacacatgagttaaaaaactatacattgtgtggaaaagaccactccaaaatcagaggaggttttaggggcaccaaaaagtacatccacatatcagtgatcccaaatcaaagatggagctttttggttttcctctttgtagccagtcggacaaatctaaggcagatgaaaattccataggagttttgaattaaaagaagcgccctaacggaaagctgtgatgaagggtggttgtgaatggattccactgtgccaggcctgcacgggttagcactggctgcctgtcctggaagccccctccattatttttagaggcctcttatcaatcactcccttcactcccagcagtgggagtgggttgagcctctggtctgagcctctcctgcctgccgcccccacatcttttaggctattttataatgcatttaacagcctcccgctgtgttcactaagctacagtctttaactcattcacaaccagcatgcagggagcatgtaaaaatactttctcaggccgggcgcagtggctcacgcctgtaatcccagcactttgggaggccgacatgagcggatcacctgaggtcaggagtttgagaccaatctggccaacatggcgaaactctgtttctactaaaaattagctgggcatggtggcgggcgcctgtggtcccagctactcgggaggctgaggcaggaaaattgcttgaacccgggaggtggaggctgcagtcgagatcgcaccactgcactctagcctgggcaacagagcaagactgtgacttcaaaaaaaaaaaaaaaaatgaaaggtttctgctcaccacaaactagaagggaatgatggtggtcttgtttgggactctttacctgcagcaagaacctgggaaatgtgggggtgattttggtgtgtcatgtacagttgggctggggaaagcgaaaaaagtgaagaagaggaggtgaggagggggaggtcagcacaggaagaagggtcctggccacctttgacccatacttggggtaaaggacctgcatctggccaggctctgtggcttatgtctgtaatcccagcactttgggaggctgaggtgggaggatcacttgaagccaggagttcaagaccagcctgggcaacatagccagttcctccatctctacaaaaacaaacacaaaacaaaaacagaaaagggatctgcatctttacatggtgcaaataaagaaaactagaagatagggagttaacttgagacatactattatgtgctccttttctccccttgaaatgttgatgcaggaagtcagggtggtaaaaaataggcacaatgtcacattcagcttcacaagatttgaaagtgcatctcagctgggagcggtggctcacgcctgtaatcccaacactttcagaggccgaggcaggtggatcacctgaggtcaggagttcgagaccagcctggccaacatggctaaaccccatctctactaaagatagaaatatttagcggggcgtggtggtgagtgcctgtagtcccagctactcaggaggctgaggcaggagaatcgctggaaccctggaggcagaggctgcagagagctgacatcatgccactgtactccagcctgggcgacagagcaagactccgtctcaaaaaaataaaaaagagtgcatctcaactttttttttttttctttgagacggagtcttgctctgtcgcccaggctggagtgcagtggcgcgatctcggctcacggcaagctccgcctcccgggttcacgccattctcctgcctcagcctcccgagtagctgggactacaggcgcccgccaccatgttcggctgattttttgtatttttttagtagagacggggtttctccgtggtagccaggatggtcttgatctcctgacctcgtgatctgcccgcctcggcctcctagagtgctgggattacaggcgtgaaccgccgcgcccggccttcaacattttgtattggcgattttcagtgacttctggtcctgaaaatcaagagctttctggttcagcagagctgaaagctgttcaatactgccctcttctgtccaaaactcattcaggcatttggacaatgattttatactcgggaatgtttttgacaaagcgtgatggtgaaaattggacattatctaaccatggggacagaaaaacaaattgtgcagccattaggtcttagttttgaagactttattcagaaaacaacacaaatagtgattatctggatgttgtacttatgaaaaattttccctattctctgtattttaaagtcttctacaatttatactgattatgtttggaattggcaaaaagtaaaataagtcgttctattctgaagaaaacaagcaaaaatattaaagtttttgttatttttatagaaagccaactgatacttcatcctcataaccagccttagtgtcctcacctataatgtaagtgacttatgttataggtgaggacactaagaacagagattttcattttatttttatttttactgttgtttgtttgtttgtttttgagatggagactcactctgtcacctgtgcagtggcacgatctccactcattgccacctccacctcgaaagttcaagcaatcctcctgcctcagcctctcaagtagctgggattataagatgcaccaccacgcccagctaacttttgtatttttagtagagacggggtttgactgtgttgcccaaagctggtctcagactcctgaccccaaagcgatcctcctgcctcggcctcccaaagtgctgggattacagccccgtgagccactgcacctggccttatttttcgtttagattcaggggatacatatataggtttgttacctggatatattgcataatggtgaggtttgggctctagtgtacccgtcaccggagtggtgaacattgtactcaatactatttttcaactctcacttcccttccaccctccctcccttttagagtacccagtgtctattatttccatctttatgtccctgtgtactcattggttagctaccatttatgagaatatgcagcattttactttctgtttctgagttattttacttaggataatggcctccagatccttccatgttgctgcaaaggacatgatttccttctttttcatggctgcatagtattccatggtgtatatggaccacattttctttatccagtcaaactttgatggacacttgggttggttccatgactttgctagtgtgaatagtgctgcaagaaacatacaagtgcaggcatctttttgataaactgattttatctctcttgggtagatgccaaataatgggattgctgtgtggaatggtagttctgttttttgttccttgagaaatctccatattgttttctatagctctcttactaatttacattcccactggcaatgtataaatattcccttttctccacatctgtgcgaacatctgttgttttttgactttttaataatagctattttggctaggcacagtggctcacatctataatcccagcactttgggaggctgaggcaggtggatcacctgaagtcagcagttcaagaccaacatggccaacatggtgaaaccccgtctctactaaaaatataaaaattagccaggcgcggtggcatgtggctgtaatcctagctactcgggaggctgagacagaattgcttgaacccaggaggtggaggttgcagtggaactgagatcacaccactgcactccagcctgggcgacagagcgagactctgtctcaaaataaataaataataaatagccattctgactggtgcaagattgtggttttaatttgcatttctctgataattagtgatgctgagaatgtttttgtatgtttctttgccgtttgtatgtcttcttttgagaaatgtctaagaacagagattttgcccaaggacccggtgctagtaagtggtacagctaaaatttaaacaccagtctgtccccagaacttctgctctttaattttcttcccctctgcctgaattttttttctctctttggtgggggaaagttaagtcgttttcttgttgtttaatacgtagataaaatttatattatggtatgtaatgtgaagcaaatatcggatagcctcctctaaaatcaggttgggtaaatcatcactctatattttgttgttttctataatttttagtagttacctgcaattccgagtgcattcttccaagtgattttttaaaaaaaataacttcaggccaggtccggtggctcacacctgtaatcccagcactttgagaggccaaggtgggtagatcacctgaggtcaggagttcgagaccagtctctacagtttagtagagatgtggaaaccccgtctctactaaaaatacaaaaaattagccgggcgtcgcggcgggcgcctgtaatcccagctacttgggaggctaggacagaagaatcgcttgaacccaggaggcggaggttgcagtgagccgagatcgcgccattgcactccaggctgggcaataagagtttccgtctcgaaaaaaaaaaaaaaagaaagaaagaaagataactgtaaacatacagaaagttggaaaactaaaatgaatacagagaacacccataccctttactcagattcacctatcccaaatagtgggatattgtcaacattttccctcgcttgctatatttactttctttttgttgggaaaacaaaacaaacatcagtccacgggtttctgttataagtcatgtaggtatgagatatattaataaattcactggagaaggctgggcacagtggctcacacctgtaatcccagcactttgggagactgaggcggattgctttgagctcaggagttcaaggccagccatggcaaaatccctgtgtctactaaaaatacaaaaactagccaggagttggtggctcacacctgtagtcccagctactcgggaggctgaggctggagaatcgcttgagccctggaagcggaggctgcagtgagccaagatgacgccatggtactcctgcttgggcgatagagggacaccttgtctcaaaaaattagggaagcatttgaaagtaagttatatacatcatggtcctttactcctaaatatttcagtgtgtattctccaagaatagggatattccctttcataaccacagtacagttattgacagttatcaatatcatacatttacgttattacagaacttttctataatctgcttctaattttgtcagctaatctaattatgtccattttaaagcattcctctttgcattacaatatccaccctagggtcagagattttgtgttgtcgtgtctttttagcttcttttaatctggaagacttctatagcttttgtcttttagactttgatatgttcaaagtataagttccctccccgtttctactcattccttatttgatgtttcttttgcctatatcaatttaggttaggttactcattttttttttttttccccgagatggagtcttgctctgttgcccaggatggagtgtagtggcgtgatctgggtttactgcaacctccgcctcccgggtttaagcgattctcccacctcagcttcctgagtagctgggactacaggcacccaccaccacgcccggctaatttttgtgtttagagactgggtttcaccatattggccaggctggtctcgaactcctgactccaggtgatccgtctaccttgcactcccaaagtgctgggattacaggcgtgagccgctgcacccggccataggttactcattctaagccagaatcctgcagaggtgatgttgtgtccttctcagggtattgcacgcggtgtccatctgtcccttgtaggctgatgttaaggtgttttccaatttctccactgtagaattgggcttttctccctccctttcaacaataagcatgtaaatatcctctcctctcctccatttagcactttagcacccattgattcttgctttatccagctttcactttgatggatgctcgggccgatcttttgaatcactatctgtgagtgggtgggtaggatttatgcactcttttcaaaacgatgcatgactgtaactgtgaataaactctgcctttcacactgaaatagaattcaaattgctgtccacattagacataaagcagtttttccatctaagtgtaggagttgacatatcgaaatacttgttcttgccataagtggcgcttatgaactataaaaagttgtaatgatttatggaaaataagaatgtttatgctttaaaagtgtatgaaattgacttttctttcaaaaagacaaactgtgtattttgctcctttagtgccttcactctaagcactacccagccagcctttggccctcctgagataccacacacctatatgacgttggtcaagtcatatgaccgtttttaaaaagactgtttttaagagcagtttcaggttcacagcaaaattgagtggagagttcggagaattcccatgtgtcccttgccccaacgtctgcatagcctcccccaacccttatcaacattccccaccagaatgggtcatttgttacaatcaatgaacctgcactgacacatggttatcacccaaagtccatagtttacattagggctcactcttggtggtgtacattctgtggatttgggccaatacataatgatgtgtacccaccattacagtgtcatgcaaaatggcttcactgccataaaaatcatctgtgcttcatgtattcatcccttcctcccccaacccctggcagccactgctctttttactgtctccaaagttttgtctttttcagaatgtcatatagttggaatcatacattgtgtatcttcctcagagcgtcttcttttgcttagctatatacatttaagttccctccgtgtattttcatggcctgataactaatttttctttttttttttcttttttgagacagagtctcgctctgttgcccaggctggagtgcagtggcgcgatctcagctcactgcgagccccgtctcccgggttcaagcaattctctgcctcagcctcccgagtagctgggattacaggtgcccaccacaatgcccggctaatttttgtttgtttgtttgttttagtagagacggggtttcaccatcttggccaggctggtcttgaactcatgatctcatgatccacccacctcggcctcccaaagtgctgggttacagtcatgagccaccgcgcccagcggtggtttttttttttttttttagtgctgaatagtattatgttgtctggatataccatactttatccactcacttattgaaggacatctgattgcttccaagttttggcaattatgcataaagttgctgtaaacatctgtgtgcagatgttttgtgtggacataaattttcaactcatttgggtgaataccaaggagcatgattgccagatcatatggtaagagtatgttcagtatgaaaacaaaccgcagactgtcctcccaagtggctgtccatttgcgttctcacagatgactatttttgaagtcccagttggagggagcaggtgagctccaccttctagcccataaggctctgtaagtgatggctttgtgatgggaacttgactgatagcctcatgggcgaatgtgatgggaacttgactgatagcctcatgggcgaatactcaagaacttaaagctctttacaaccaagccaaacccacgagcaggttccaccatgccttggccattgccagacaaaaccccattgtgtttttgcttgattttcgtcctgtgacactgacatttcaggccaggctagttgttttgcagaacgtccttcattgtggattcatctgattgtttcctcgtgattagatgccgttaaacattttgatcagcagagctgcaaagatgaattcttgtccttctgagtgcctcacatcaggaagcgcgatgacatctgttccattatcgaggataagtctgatcacttggttaaagtggtgcctgccagatttctccattgtcgaggtcctttttgtttgtttttgtttcttttttttcttttttttttttttgacacagtcttgccctgtctcccaggctggaatgcagtggcacgatctcggctcactgcaacctccgcctccctggttcaaccgattctcctgcctcagcctcccgagtagctgggattacagacatgtgccaccacgcccggctaatttgtttgtatttttagtagagatgaggtttcaccatgttggccaggctggtctctaactcctgatctcaggtgatccgcccgctttggcctcccaaagtgctgggattacaggcgtgagccaccgcgccaggcctcgaggccctttttcttttaaattaagtgtcagggaagttcagcggcggcttggcagttggttagcaggatggttttcggcctcagcaggcttgggtttgaagagaccccactggggcggtccgcaggacccccgggggtttcctgggaggtcgagggctggcgccgggcgcggggaggctgcgtcttttgtgatgttcgcggctggcttcccgggcccaggctttcgcgagctatggcagccggcaggggcgcgctgggcctcacgggcggctgttgggctgcccctgccggcgggctgcgcgcgccatgccctggtggagtaaactctgcagtgagtagcacgtgcacccaagcggcagttcgccccgcagcgatggcggacacggaatcccgagggccaccaactgtcccttaggaccggcccgagatgggtgtgtgtgggttttccagcctccttccttcccgtcccaggcttgggaaagcctctctactggccaaggcgcgcagggacaggtcgggaagggcctgcgcccgtggcatcccagcccaggctgtagagccgcccgctgcccttgatcttgccccagcccccagccctagaaaggaaaggcctcgttctgggtcccgtgacaggtgccaaaacgctctgcgccagcagcctacctccccgaagactctggcttgaaaggggagtcggggggttggaatggacatggctgtggctgcggtcagctggggaggtgggcggcagggcaggtcgaggatgacccaggcctcaaaaagtcaccaggatttagcgaagttgccctcactgtaaggcctggaggccggcaaagtgtgggacgcagaacagaatggaacaggcctcaacacttgggctgcgccatggggagtgtgaagcccagtgatggggcaggctggaaagtacggtctaggcttcaatgcgggttccaagcccagtgggtggccacacgatcgcatgtgttttggggtcaggatctcaacagcgcgggtacagatataggtacctgccagactaggtaggttagaagactattctctaggccctaaagccattaggagtccacagcctgttgatgtgatagaagcggtattttaggaggctttgcttagcaggtaccttgtatggagtgagtagattgccccagcacagagggtacgtggaggccgaaatcaggctgaagcacaaagcatggaggcgcccgaagattgttctgacaattgtagctcttaggattacttatgttaaaagagactgcagactagttgaccagctacaacttaaaatttttctatatacattttattatgtgttcaactcataactcacttactctatataaagagagcatttgattattgttaagctgtactgaactatcaatagctgttcagtaacagctaccttagatactgatggcagtcgcccaggctggagtgcagtagtgtgatctcggctcactgcaacctccacctcccgggttcaagtgattctcctgcctcagcctcccaagtagctgagactacaggcatgcgccaccatgcacgactgatttttgtatttttagtagagatggggtttcaccactttggccagcgtggtcttgaactcctgacctcaagtaaaccgcctgcctcagcctcccaaagtgctgggattacaggtgtgagccatagtgcccggcccaatagctgttttgttctgcctgctggcagctggttcacgaacctttatctccctagttttgactataaacatgtcggccctttcagaatgaagcagaagtgtttccaatggaaacacagatttaagagtggagggaaaatagtgagggggaaatggttgtgtgacaccagctttctactcctatattagcaacatgtctctgcattttctgattccagggaggttgatgagtgtttgtttttaatcacatgcttgctggcaggatatgtaatttatgtttgtattctgtactagtgaaatcatactagaatagagtttgttactggaatttttcttttttctctagtatatttccaattattttatccaactttttcaaaaggaaagtcacatctcttaaatggcattagaagtgtttgcaaaaagttcttttgtgaccgccaggcacggtggctcacgcctgtaatcacagcactttgggaggctgaggcaggcggatcacctgaggtcaggagtttgaaaccagcctggccaacatggtgaaaccttatctgtacaaaaaatacaaaaattagccgagcgtggtggcagccacctgtaatcccagctacttgggaagctgaggcaggagaatcgcttgaacccaggaggcggaggttgcagtgagctgagatcgagccactgcactccagcgtgggtgacagagcgaagactggttcaaaaaaagaaaaaaagaaaaaagaaatagttcatggaaatacacttaaggaagcctttggatttaactataaacaaattcatcacagtgtcagtttataataggaacaaatagaaacttaaagcattttcttatttcagaatactatacatgctttaaaaaataatgggaagagtgtatatatctaaaatgtagaagtagtttaaatcgtcgatgtctggactttctctttgaatatttgcttcaaagtttaatatgagtgtttaatttttccttattgtttgttaagtctaatgttggtcacaaatgtgtattttataaagagaaaagggaaatcctttaggaatgcgcctcagatcaaaataatgagattcttgggtttttcttgaaatcttcttcgctatctgaaatgtttagttctcagaggtaaaactaaaatgttttgttttaaatgctatcttagatactgatggcagaaaaaatgagccttgctgattatcgaagctgttacagatggtgagtctatggcatcaccactgaagcaaaggcccttattgagtctctgaagaataagaggcccagataacctattcatctatgaatatccaaaaaatctagcaatatttgaaaagaaaaaaagaactttagcataacttagagaataacaaggtacaaggacaaaaaaaaactctaggtcacactcttgccctgacttggttgggtacctcaggcagttttgttgttgttgttgttgtctgttcatttgttttttgagtcagtctcgctcggtcacccaggctggagtgcaatggcatgatcttggctcactgcaacctctgcctcccatgttcaagagattctcctgcctcagcctcccgagtagctagggctacaggcacccgccactacgcctggctggtttttgtatttttagtagagacggggtttcaccatgttggccagcctgctctcaaactcctgaccttaaatgatccacctgcctggacctcccaaagtgctggcattacagggatgagccacctcgcccagcctagttttttatttaactttctggggttcagtttcaaaataaaaccaaataagtagtatgatggcaatttgtagacatagatttgtaatatttcataaataagaaaattaaattgttttcagagtaataagattatataattggaaggaatgtatggatttggggaagcattctatatttctaaatatttctgcatttcaagtatttattgctgtgttctaagtcttgttgtatgtactagttataattttttttttgggggggacagagtcttgctgtgtcacccaggctggagtgcagtggtgcgatctcagctcactgcaacctccacctcccggcttcacaccattctccttcctcagtctcctgagtagctgggattacaggcgcctgccaccacgcctggctaattttttgtatttttagtagagacggggtttcaccgtgttagccaggatggtctcgatctcctgaccttgtgatccgcccgcctcagcctcccagagtgctgggattacaggcgtgagccaccgcgcctggctagttataattattaaccttcaatttgtgcttaaaacattaagtatattttttcaggttttgttaagatctttttggtgtccattttaattgacctgtttagtacaaaaatcgatatatgtcctatatagaaaattagaggctgggggcagtggctcacacctgtaatcccagcactttgggaggctgaggtgggcggatcacctgaggccaggagttctcgagaccagcctggccaacatggtgaaaccccatctctactaaaaatacaaacatcagccaggtgtggtgacacatgccactagtcccagctactcgggaggctgaggcaggagaatcgcttgaacccgggaggtggaggttgcagtgagcccagatcacatcactgcagcctgggtgacagagtgagactctgtcttaaaaaaaaaaaaaagaaaagaaaaaagaaaattcagacaagcaaaactaaaataaatgacattcgcatcccccagagatcatatgtgaaggatgtgtgtgtatatgtgtgtgtgtgtgtgtgtgtgtgtgtgtgtgtgtgtgagagagagagagagagagagagagagagagaaaggagagacagttgtttttaagccagaatgaggtcattgtatatactgtttggtaacctgctttttgcagtcaaatctctacccttttatgtcaattaaaattcatctcatctaatcccaaatctcatactcagtattttccaagaagacccaaaaatgtccttttgctgtttttccctaacaaatatccaattcaggatcatgccaggtacctctggttgttgtgttccttaaatctcttaatttaacacaatacatctccctcctacttccccccattaaatcacattgacttgacttttcccctcagtgattttaaaattacaaacccggaaaaatatagtaaacacttatatacacttgacctattcgccatttatggaaagccacatcatccgccccaccacccactaagctatttggaagttacttgcagacaatccttttgtgtttctgctggattttcatccttctgtgacattgacatttcaggccaggctagttgttttgcagaatgcccttcgctgtggatttgtctggttgtgtcgttgtgattagataccattaaaccttttggtcaggaatgccacgtagatgaattcttgtccttctcagtgcttcacaccaggaagcgcgatggcatctgtcccattattgaggatgttaaatgtgatcacttggttaaggtggtgcctgtcagatttctccattgccaaggtcatttttttgaaattaagtaatgtgtatgttggtattctgaatgtacgtttcctgacagccttttacccgatggttttagcagtttatgatacttgactgaatgagttattacaatggtgtctgtaaattgtgattttctaaatctaaaattctaacaataatgactttgaggatcaaagtggaagttatatctatatttattgacatttcttttttccttaaagaagcgctcccttctcctcatttaccttttttagtatcactctcgattcatggattctttttttattcaatgtgttgtaacccatcaatgtcatcattctctttctttttctttttcacatcagacgagtaatgtgccatcgtggtgacaatgcacacattgcacatgaacacccaatcgtcactctcataaaatacaaaggatccattattcttttctatgcttcaaagtttgggcattgggagccccttcaagccagttcttgtgtccttttgacacctccatcagcttttgagcatctcctttctgttacaacaaaatattcttcatacgtcctctgacccagcctggaatttctccaaagagctctggtcccttttggggacctgttgaggtcggacttagttaccacatagaatgtccccttctttagatttgtgtagatacttgtttgttctttagcttgttcctcaaaccctatatttcctgttaagtgggaagttacatctaaaacttgatggattcttgtttaaaatatgggtgtgatgtgggattccatcttacattgcaacagaagatgcactacctcgttgactcactcttagaggtgccgtgactacttatgtggaactaattttttgatagttaagtttgtcaactttccctttaacaagcaacagaaagagcagataattctctttgaacctgaatttttgaaggtcattggaaagaagtagacattaatctattaagatttgcaaatctctgtaagatctcactttatccttgaattgcctcgcattaaagaaagtattaattggtcatatttttaaaatatttaattttcactgggtgcagtggctcacgcctgtaatcccagcactttgggaggccgaggtgggtggatcactagaggtcaggagctcaagaccagcctggccagcatggtgaaacccctcccatactaaaaatacaaaaattgactgggcgtgttggctcacgcctgtaatcccagcactttgggaggcagaggtgggtggatcacgaggtcagaagatcgagaccattctggctaacacggtgaaaccccgtctctatactaaaaatacaaaaaaaaaaaaattagcctccctactcgggaggctgagacaggagaatggcgtgaacccaggaggcggagcttgcagtgagccacgatcgtgcctctgcactccagcctgggtgacagagtgagactccatctcaaaaaaaacaaacaaaaaaaacaaattagctgggcatggtgacagacgcctgtaatcccagctaatcaggaggctgaggtgggagaatcacttgaacctaggacagaggttgcagtgaaccgagatcgtgccactgtgctccagcctgggcgacagagtgagactctgtctcaaaaaaaaaaaaaaaaaaagttaattttcttgggctaggcactatagctcacacttgtaatcccactgctttgagaagctgagacaggagggtcacttgagcccagcagttggagagcagcctggacaacatagtgagatctcatctctacagaaaataaaaaacttagctggacatggtggcatgtgcctgtagtcccagctactcgggatgctgaggtgggaggattccttgagcctgggaggttgaggctgcagtgagccgagaccacaccactgccctccagccggggcaagagagtgaggccctgtcggagaaaaacaattttcttgtattgtaatcaccttttctcttctccccacccccccgcccctttttgttaatagttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcaggtaagcttccttgtcttctaagataatttttctcttttatgccaatagatggcaaatttgttacataaggaatcgggagcaaataattaatgccttcgtgtagaaccttcagttgaggaaaataactatcaactagattcaaagatctaggatagtttcatggtttttggtgattgaaatgccatttagtcttatcgatgttatgaaaagaacgacttcgttttacctcctaatgtgactgctttagaataaaataaaacggcatgtgtgtgtgcacatgtgcgtgtttgacccaaaggcataagaaatacattgtgttcactcaactatcttgttgagtttttttaaaaataactagtgctccaatggctgggcgtggtgcctcacgactccgtctcaaaaaaaaaaaacaaacaaaaaaaactagtgcccccaaatgggctaatattaaactgcctgaaatatagctgatgatagctctttcagaaaaaatggattttttttcccctagcagtagtaacaagtatttttaaaaattttccagcgcatataatgaccgaccctcactgtgttagttacttgcagttgctagtaactccccatctttgtggtttttgttttgttttgttttgttttcttgagacggagtctcgctctgtcatccaggctggaatgcagtggcgcgatctcggctcactgcaagctccgcctcccaggttcacgccattctcctgcctcagcctcccgagtagctgggactacaggtgcccgccaccatacccagctaattttttgtatttttagtagagatgggttttcaccgtgttagccaggaggtctcgatctcctgacctcgtgatccgcccgccttggcctcccaaagtgctgggattacaggtgtgagccaccacgcccagccctatctttgttttgttttttgagagagccttgctgtgtcacccaggctggaatgccgtggtgcaatcatggattgctgcaaccttgacttcctgggctaaagcaaatcgcctgcctctgcctctgtctcctgaatagctgctgggaccacaggcacatgtcattactccgagctaattgttaaatttttttgcagacaggggtcttgctatgttgcccaggctggtctcaaactcctggcctcaagaaatcctcctgcctcaccctcccaaagtgctaggattacagtcgtgagccactgtgctcaacccatcttcgttttcttttgttttgttttgtttttgagacagagtctcactctgtcaccccgactggagtgcagtggcgcaatctcagctcactgcaacctcagtctcccaggttcaagcgatcctcctgcctcagcctcctgagtagctgggattacagataacacaccaccatgcccagcttagttttgtatttttagtagagacggagtttcccccaggatggtcttgaactcctgacctcaagtgatctgcccgcctcggcctcctaaagtgctgggattacaggcatgagccaccgcacccagccctatctttgttttttgtttgtttgtttgtttttgagacagaatctcgctctgtcgccaggctggagtgcagtggcacaatctcagcttactgcaacctccacctcctgggttcaagcgattctcctgcctcagcctcccgaatagcagggactataggtgcatgccaccatgcccagcttatttttgtatttttagtggagacagggtttcaacatgttggccaggatggtctcgatctctttacctcatgatctgccctcctcagcttcacaaagtgctgggattacaggcatgaggcaccgcgcccggccccatctttgtttttttaatggagttaaactatggtattattaggtcactttgacaactatcctgttgttaataaatgagagagaaaaaggagattttatttacgctgattcttcctcctcctacagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcactt

SEQ ID NO: 37418 - DNA, 17087 bp, Homo sapiens; identical to SEQ ID NO: 35881

SEQ ID NO: 37419 - DNA, 20988 bp, Homo sapiens
ggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggtgagggcgcggatccgggagggcgggagcgcgagtcggacaaagggaggagagagccaaaggggcttccttttttccgcctagaaaatggctgagccggacgtgtggttcacagccgtcatttcctctctgtccgctccagagcctcagcactcagatttggaggaaaacctgtagctggcgaggaagccaggagtgtccccacccccactctcttttctctgtttacccccatgttacctgtctcacggacacattgtacacggagacatccttttgacagtttaaaagaagtgcataaaaccgcgtacacatcgacaagctgcagacactcttactcccatcggctctcagacaaaacgcagttggacgttaactgacttatgcccattccttagtctataagcatttccccagcactttcctgcaatccgtcctggtctagaaactcacagaaaagaacagcttttcgctgctggagtaagtcacttaaccactctgagactcaggagataacacagttatgaggaatattgtggaatcatgtgactcacagagccctttgtgaactggcacagctaaacagaaacgtggaaacaaagtattacatataaaacagttgtaaggtgaccttcaaggagtccatgatactgtgtattttctgtacgttgagggcttcaggaatgcgtacacaattatgtccgtgtttaaatatgagtacattcatgtgcaatcacttaacatttatggacctttcagctatattatttcactcactctggtgagaactcttgagtaggttgggaagatggtgtttgcccatttcacacatgagggaaataagtcactttcacagtgtacctatatggaagagctacaatacaacatagttctaagcctcctactccagtcacagttccgctaagtcatgcaatatcctaccagggacaggtagatgactcattgtttaagatagacacaaatagtcctgacgaggtagctgagtggttgaagccacaggctgctaagatagacacagattgccaaaggagtggcttgtttgcccctgcgccctgagtctcttgtgggtggcagtgtggcctaaggacaagcgccaactggagacttggcatcaggtgtgtggactccatgtgtgataagaagtaccatgctgatgctaaggtctacctaattttgaactgcccatctgttttgcttttctcaggagcaaatccagaaccagctcgaccatttaaaaagagtgaaagatttaaagaagagacgtcgggcccagggggaacaggcacgagctgaactcttggtaagggttgttggaattcacagttggttctgctggtgctctcctcttctgtagagctgatgttacttcccttaaacttgtccagcatgtcacccagaacttgtaggtagaggtggatcaaccgcacatggcagtgggaactcacccggagaactaagattcccttacttttggggaaagcatggagaagccaagtttggaacccttggaaatcagacctgtcagtttactttaacctgctaactgcgtagaccagggttgatccttggcaaagctgagataggtaaaattattggatacagttagcttgcgttggtaccattctgcagacaattgctaatagtggatttgtgtaatccccactgttgcttctctttggcttattctcctttcttaacaatgccttaattctgaattttttactctgccctcttcctccagtctcaaggccttaacaagtggctgatgtgttaatttatattaggggtatatgggaatttttttttttttttttaagacagggtctcactgtcatccaggctggagtgcaatggtgaggttttggctcgctgcaacctctgcctcccagttcaagcgattctcccacctcagcctcccaggtagctgaggctacaggcgtacgccaacagactcagctaatttttgtatttttagtagagatggtgtttctccatgttggttaggctggtctcgaactcccgacctcaggtgatccgcccacctcagcctcccaaagtgctgggattacagacgtgagccaccgcgcccagcctggctccttgtttagaacaaaagtttataatagagtcctgttggtggtgggggttgggtgaagaacgaaggacagtaaattatggcaaacaaatgagcgccaagagggaatcgtggggagagcacctctccccctcctacccaaagctagagacagcagttggtgaacacccgtgaaggacagacagcgggtatggattacatatgaagggcccagggaaattgggcaaggaagctgttattggttgttccatcctccatagggcacatatctgaccctgtcactttcctgtgtgacaatcttccatgcttcccagttgggatagagtccttacccccagcctcccaggccaggcatgacaaggccttaccttttctggtcccttccctcaacactcatgtgctccagccagatagcaccatttgctttctctccccactcttttgcctgtgccatttcttctgcctggaaaggcttcccgctcattgcctatgtggtgaattcttgttcatcacatgaacattgtgtgaaattgcttctgtgaagatggtaccagtttctttcattgcaggctgtcaccctatctttaattacccatccatgactatgtatatcatatgaacctgactcacttctctgagttgcttgagaacagggactatgtcttaataatcactggggtaattcagttcctgggcattatatatccagtcagtaaagactggaaataatgagttagcactgtgcttgttttaatccataatgaggtcttgggctacatggtcacaggagaactatgaaggccctagaaatgagccgtttttctctttactgcctttccctgtcgtctgcatagagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggtaaggcttgcagagccctgctagagcagcacccactgaaaatatcgtcccttctcctttgccaagtagtatccaggaccccctgtcttctttttaactctgcaggaatagcaagagcttgccaaactctatattgtgcaccttggaaggaaactgtgtaaactagaagttctggttcacacaacttgaattagtcaattgcgttgtctcatagaaatggcaaaaagaagacctggtgcttgtgcctacacagcactgacaagtggtctgattacaggcaaggctctcaacctttttgggcctcagtgacctcatttgttcagtaatgaggggcttagaccacatgtcattcaaagactctcctcactccagtatcctgtagttttaatgtattactatagccacaaaacaatgagcacttgagcaggagtggttaggttacctgagcagtcctgtgatttaaccttggtagagcaggtgataaagctgcagcagacctaccccggcaagactacaggaaatgagctaatgcctgtctgtcgtttgctcattcagtgcgtattaattatttgctttgtgtcaggcactattctaggcactgggattaagtgccaaataagctttcctgaattatattttagtgtggcgatcagatagttcttataggtatttgataaaagccattaaaaatggatgatggcgggccaggtgcagtggctcacacctgtaatcccagcactttggggggccgaggcgggtggatcacaaggtctaggacttcaagactagcctggccaagatggggaaaccccgtctctactaaaaatacaaaaattagccaggcatggcggtgtgcctgtagtcccagctacgcgggaggctgaggcaaggaattgcccaaaaccaggaggaagtggttgcagtgagccaagatcgcgccactgtactccagcctgggcaacagagcgagactctgtctcaaaaaaataaataaataataaaaaataaaaataaaaatggatgatggcatagggcaagggtcagcaaattatggtccatcccctgtttttgtatgtcctgggcaataagtatggtttttacattttaattttaatttaatattatttatttattttgagattgagtcttgctctgttgcccaggctggagtgcagtggtgcgatcttggctcactgcaacctccgcctcctgggttcaagcgattctcctgcctcaacctcctgagtagctgagattacaggcgcacaccaccatggctggctaatttttgtatttttagtagagacggggtttcaccatattggtcaggctggtctcaaactcctgacctcgtgatctgccctcctcggcctcccaaagtgttgggattacaagtgtgagccacagcgtcaggccagtttacatttttaaatggtaaaaatcagaaaaatgtatttctttctttctttttttctttttttatttttgagacgaagcaagaagggagtggacagcatagtaatgcagttgaggtcaaataatatcaaagctgatacccatttgattcaataacatgaccatcattggtgatcttaggtagaactatcacaatggaataattggggcaggagccacattagggggagttgagtagtgactaggtcaggtgaatggagactacacaagtagatgactatttcaagtacaactgttaaggggttgtaataaaatacttagagacgagacaggattatggagttttatctggaagggttggttaaagaaactagaagttagacatattttcaaaatacatatggaaaggagtatatgttgtaaggtttctaggtgagggagaacactgaagccacaagaaaccatatactggccgggcacggtggctcatgcctgtaatcccagcactttgggaggccgaggtgggcagatcacctgaggtcgggagattgagaccagcctgaccaacatggagaaaccccatctctattaaaaatacaaaattagccgggtgtggtggcacatgcttgtaatcccagctactcaggaggctgaggcaggagaatcgcttgaaccagtgagacgatggttgcagtgagccgagattgcgccattgcattccagcctgggcaatgagcgaaaccctgtctccaaaaaaaaaaaaaagaaaggaagaaagaaaccatgtactgatcagcaatgtgcggttcctgagaaggcaggtggaaatgagaactaaagtacatatgccaggaattagtgtcagagagtcttctgttgtatgggaagaaatgattgtttcagagtatgggaaagacagttggtttgcgagaactagtaggagtatttggtcagtgaacatctatttatagtgtaaccattctgccctgttgtgtaactttcttttttttttttttttaagacatactcttgctctgttgcccaggctggagtgcagtggtgcaatcttggctcactgcaacatccccctctcaagttcaagcaattctcctgcctcagcctcccaagtagctgggattacaggcgtgtgccaccacgcccagctaatttttgtattttttatagagacggagtttcaccatgttggccaggctggtcctgaactcctgacctcaggtgatccttctgcctcggcctcccaaagtgctgggattacaggtgcgagccaccgtgcccagcccctgtcgtgtaactttcttatcagctttgctttctcaaatcttgactgctctggcgtgggcactgagtaagcagatggtcagtctcatccaggattggggttttgcaagatggacttgagtgtttttttttccttagtttttattgttgttgtttgagacagggtctcactctgaaacccagtcggagtgcagtgacatgatcatggctcaccgcagccttgacctcccaggctcagatgatcctcccacctcagcctcccaagtagctgggactacaggcgtaaaccaccatgcttggctaatttgtgtaatttttgtagagatggagttttgccatgttgcctcggctggtcttgaactcctgggctcaagcaatccatccgcctcagcctcccaaagtgctaggattacaggtgtgagccaccacatccagccttccagccttcttcatttttttaattgtaaaatatacgtaacctaaatttcaccattttaaagtgtaaaactctggcacaaagtagcatttagtaaatccacagtgttgtaaattatcaaccactgtctggatctaaaacacttttaccacccaaaaggaaacctcacactattaagcaatcactcctcatttccttctacccctaactcctggctctatggattagtctattctagatattagatataattgaaatcatacagtacgtagcctttttcttcacttagcatacttttttttttttttgaggcagagtttcactcttgttgcccaggctggagtgtaacggcacgatctccgctcaccgcaacctccgcctgccaggttcaagcgattctcctgcctcagccttccgagtagttggtattacaggcatgcgccaccacccctggctaattttgtatttttagtagagacggggtttccccatgttggtcaggctagtctcaaactcctgacttcaggtgatccacccacctcagcctcccaaagtattgggattacaggtgtgagccaccacgcccggcctatcacttagcatatttttttaaagattcattcatattgtaatatgtttcagtactggccaggcgcggcggctcacgcctgtaatcccagcacttcaggaggccaaggtgggcagatcacgaggtcaggagttcgagaccagcctggccaacatggtgaaaccccgtccctactaaaaatacaaaaattagccaggcgtggtggcgcatgcctgtaatcccagctactcaggaggctgaggcaggacaatcacttgaacctgggaggcagaggttgtagtgagccgagatcgtgccattgcactccagcctacgcaatagaatgagactccatctcaaaaaatatatatatgaaaaaatatatatttcagtacatatatatatgtttcagtatttctctttatggctgaataacattccattgtatggatatataatatgttttgtttattcatcagtcgatgggcattttggttgtttgcaccttttggctattgtcaatagtgctgctgtgaacattgaacacaaaaagtagaaaatggttcacaaatttgtgtgttatccttgtgcaggagccatgctaatctgtgcatggttcccatttgaggatatctgctgctgaagcaagcaccataattaaggctttaaaacctttttttaaattttttttagacaaagtctcactctgttgcccaggctggagtgcagtggcacaatctcagctcactgcagcttccacctcctgagtgagtctcctgcctcagcctcccgagtagctgggattacaggcacacaccaccacacctagctaatttttgtatttttggtagagatggggtttcaccatgttggccaggctggtcttcaactcctgacctcaggtgatccgcctaccttggcctcccaaagtgctggtataatagacgtgagctactgcgcctggtctaaagcttcttttttttttttttttttttttttaagaatatttttttaaacagatggagcatgaaactgaaggtggatgatgaggaaaggagagaaagaaagaagtcatggactcagtaagggaggaggggctccatgaatatcaaaaagtgtttatgttggaagtcactggaaaagcaggataaatattacttaatggggcaatactggaggcattcccattgaggtcagaaacaggccggatgcccagtatcatttatctctatttaacactgcattaaaggttctaaccagttcagttaaataaaataattataggtatacaaattgggaaagaagttaacatacagaaatcagcagccttcatatgccagatagcagccactagaagacatattagaagagaacatgctgtttccatttgcaaaaaaaaaacaagtgataaaatatctgggaataaatttataagaaatatacaaaaacctatgtggagaaaattataaaacattcaaagattcctgaaagacacaaaataaacttgaacaaataaagagatatcacttattctttgataagacagggaaagcaagttgtccttcacattcataaatgcagtttcttttttttttctgttactcggatatattatgtagtgaagtctcggatttcagtgtaaccatcacccaggtacccagtgtacgttgtacccattaagtaatctgttatccctcatccccccccccccacccttgcaatttcaataaaaataccaacaagctctttttctggatctagacaaattgacagtcaacttcagatagaaaaataagcacataataatatgcacatataaaataagcacatattattatgtgcttatttttatgggataggccgggtgcagtgactcacacctgtaatcccagtactttgggaggccgaggcaggtggatcacattaggtcaggagtttgagaccagcctggccaacatggcaaaaccccgtcgctattaaaaatacaaaaattagccaggtgtggtggcacatgcctgtaatctcagctacctgggaggctgaggcaggagaatctcttgaacccggaggtggaagttgcagtgagctgagatcgcaccatttcactccagcctgggaggcagatcaagactctgtctcaaaaaaaaaaaaaaaagctgggatagatcactagagcccaagaggttgagcctgcagtgagctatgattgcaccactgcactccagcctgggtaacagagcaagactctgtcttaaaaaaaaaaaaaaaacataggtaggctacactgtgaaagaagagctctgagggagaactggccctactagatactacaccatattttaaagcccatataattaaagctgttggtattagtacaagaaaaaagcgcacacacattgtaaccagtcaaaagatagtattaaaattgaatatttgccacaaatatcacaaatacaagtgatagttctaatataaaaagaccttttaagtattgcgagagaaaagaccaaaattctagagaaaaatgggttgaaggcacaaatagacaagctgcaaaagacataaattgctttgtgaacatgtgaaaaaatgctcagctgtacttataataagagaaatgcaaactaaaaccacactaaaataccatttcttactcgttacaatagcaaaaattttcaacttaatacacttttgacgaagtgtcggagagacactcatatgccagtgggctggtaggaatgcaaaatcatgacccttttggaggagaatttctcaatatttaacaaaactgtatgtgtgtgtgtgtatgtatacacacagttagaattaacaatttttctaggaagggtagagggaggagagatgagagattgattaatgggtacaaatatacagtttgatagaagaaataaaagctagtgtttgataggtcagtagggtgactgtagtttacaaaactattatatatatctatgtatatacacacacatatacatacgtatattatatatatatatatatatttttttttttttttgagatggagtttcactcttgttgcccaggctggagtacaatggcaagatctcagcttaccgcaacctctgcctcccgggttcaagcgattctcctgcctcagcctcccgagtagctgggattacaggcatacgccaccatgcccggctaattttgtatttttagtagagacggggtttctccatgttggccagtctggtcccaaactcccgacctcaggtgatccgcccgcctggacctcccaaagtgctgggattacaggcgtgagccactgcgcctggcctattttatagtccaaagtgactagaggagaataattgcaatgcttcttgcataaagaaaaggcaaatatttaacgatgtgatggatatcccaatacactgatttctttacaaattatgaacatgttaaattatcgcatgcacccccaaaatatatatgtctgttacgtatcaataaaaaattttaaaaatctaagaatttactttgaagatataactattaaaatatatttgaaaatacatatgcacaagataacctgctgcaacatttttataattgcaaaatactggaaatagtctgacttagaaacctacaagattgttttagttaattatgcacatatacactatggaatactatccaagttaaaaaaaggaaaagaatgatacctatgaactgatacggagtggttttcagtatatattgctttgtggaaaataaaaatgtgaaatagagagtatgctactttttttttttttcctgagacagagtttcactcttgttgcccaggcgtgagccaccgcgcctgacaagagtatgctactttttgtgtatgaaagaagggagaggccaccgctggctcacacttgtaatcccagcactttgagaggccgaggtgggtggatcacctgaggtcaggagttcaagaccatcctggccaacatggcaaaatgctgtctgtgctaaaaacacaaaaattagctgggcgtgatggcagacacccgtagtcccagctactcaggaggctgaggcaggagaattgctcgaacccgggtggcagaggttgcagtgagccaagatcgcgccattgcactccagcctgggctacacagagcgagactccgtctcaaaaaaaaaaaaaaaaaaagtatactggagttctttgtactaacagcttttccgtgtatttgaaattatttcataataaaaagaaagcaagctggacaggtaggcaagcttgaggtccaatcataggacgcttaagttagtaaatttgaaatcctgaggtccttgaccagtggatggtgggtactgaaggagggtatgggaaatgctggtatagcaaatagtatgcatcccattttcctctgcctgccttttagctcctcaacactgagttatgttccagtgatccttttctccctaatttctcccatgagagccagtctgtagttggtttttcaacaaacatctgtgaaagaaaaccgaagttttaaatgacttctcatggttattttttttcctttctcttgcaggacattggggacacattgagcaggtatagttttctgtttccctagtgttaaatcaaatatgagaagactgtctccttcacatttgtaaatcctgaaaggagccctgagcctgaggatggacatcttatcaaattgacacatatccctgaagagagtcactagtatacaaagaattagatgaaccacagctctactcagtaaaattcaggaagtagggggttcatgtgggaggctgccggtggattaggggtatgaggacacttccatggagagggtgtggccttacagggacctgggctgaatataagggtagtttatgtctattgcttcctatacatttcagaatcctttcccccttcattatctcatttttttttttctgtaatgggggaaataaagcctaagaaaggtgtgactggcctgcatttacataattactgatgagccacctggattctggctcttattcttactcttgctatttctctatgttccatcaaaaaaaaaaaagtgaggaagaactccctggcagctggaacacgatcaaagagggagagcttggagggggcagtaagccagggcaaagttgttttgcaggatggatgacgaggcaagtgggatgggccttgggaagctcatgtttggtgtaagaatgccttcaggggtggaaactgactttgaggaagctgtactgtgaaggtgattaagatcctgaatggtgaaaaccttctaaagcaaaatgcagcttgactatgtgggagcatttaaggagattggggaggtccttatagatggggcagtttggctgggaggcctgtgttgatagaatcatgttgatggaattgaggttcctgagggatcctaggatggagataaggtggagttcataccagtcccagccagatgacctaagcaaataatactgttacctgatactttatgatgccagtctagctgtgacctaacatacagagttagctgcctcagaccctagcagtttgtgacattaaggattgaatttggctatataagataggaaacccaaaattttattggcttaaggcttaaacataataaaagaaatgtgcaggttgggtgcggtggctcacacctgtaatcccagcattttgggaggccaagtcaggtggatcacctgaggtcaggagttcgagaccagcctgaccaacatggtgaaaccccatttctactaaaaatacaaaaattagctgggcgtggtggtgcatgcctgtaatcccagctacttgggaggttgaggcaggacaattgctcaaactcttgtggcggaggttgcagtgagctgagatcatgccactgcactctagcctgggcgacagagcctgactccctctcaaaagaaaaaaaaaagtaagaaatgtgcaggtaggtagtctgtggctagtgtggtaactccagtgatcctcagagactcaggtttcttcccattcactgttctaccatccctaaggtatggtcctcatatagtccacaatagctggtagaatgccaaccaagaagaaggagataagtcgcatcacattacctttttttcttcgtttttttttttttttttttttcatttttcttttttgtagaggcagggtcttaccatgttgcccaggctggtcttgaactcctagcctcaaagtaattatcccaccttggcctccaaaagtgttgggattgcaggcatgagccactgtttcctgtcatgttacatttttaagtagatttctcaaaacaccatgagatacgtcttacttctcataggccagaacttagtcacaaggtcacatctagctatgagggactgggcagctgtgagccataaaaggcagaagatggcagaaggggtattggataggcaactggcagtctttgctatagacatccttgcagggctagggaattgggtaatgtcccccacagtgcctttctatctgaacatgtcattctttccatatttgggaacctgagaattcgggttaattgcccaccataaatatcaaggactgtcatggaatctagtgctttctggcaaagtcagcctcatatgtaattcagtaaacctttttgagtacttagtatttgaaaagctgtgagctaggtgctttggggggtatgagaatgagtacagtatcctattttggtctagaggatcatagctcaggaagagaaggtgggaaaagctgtagtggctgattttaaagactgtccgtgtacgctagacagtttaacttagcccctgtcctagttcctggaaggtcatggaattgggaaaaagaatttacttgggccggacgtggtggctcacgcctgtaatcccagcactttgggaggccgaggcgggaggatcacctgaggtcaggagttcgagaccagcctgaccagtatggagaaaccccatctctactaaaaacacaaaattagctgggtatggtggcgcatgcctgtaatcccagctactcaggaggctgaggcaggagaatcgcttgaacctgggaggcagaggttgcggtgggccgagatggcgccattgcactccagcctgggcaacaagcgaaactccatctcaaaaaaaaaaaaaatttactcatgttttttaaatttagggctgaaagaatcaggattcctgaaccttggatcacacctccagatttgcaagagaaaatccacatttttgcccaaaaatgtctattcttgacggagagtctaaagcagttcacaggtaatgtgaggagaggtgtcatgaggggaaatggatttatactgagtatctgcatattgcctgatgaagaggataattttccagccagatagtgggatgcagactgaatattttcttgttttcttttcttagaaaaaatgcagtcagatatggagaaaatccaaggtaaatttatctacctactgggcttttgatgtaaagttgcttggaaaaaagaacatctgcactgaaagtgggaaacgtgggataagggtgatacccattggccagccttccctgatattttacatcttccctttggtcttaattaattttctcaattaacagcttcttgttctaatttgaagtttgttaactgtatttagtcaattcgcagtctgcattgatggaggagaaaaataagcaatccaaaaattaatcaatccagaattaatttgattgtttacttcggaaagaatgaacaaaaactaccttggatacgtttcacttgagccagtgtttatcattgtaatttactgagttcctactgcttgtgggcacaggtgccagctcgggctggaggaatccagcagcactgacaggcagcaccgccagggacatggttaggagcgggcagtcaggagtcaggctgcctgggttctgggcctgcctctaccacttagtaaggattcaacaagtaatttcctcatctgtaacagaacagtaatagttcttacctcctgaggtataagaattaaggttagttaccatttctaacacttctagaatagaacctgacacataataagtcctatatttatgtttattaaatcgttctaggcatttggagaagcttttccaaattaaaatttttctgctcacgagccacattcagtaaagagttggccatatattattccacccaggaatactaaaattcctgggcagtctggtggattctgaaatccttatatgtaggtaaacccttctcttaattattagaaattacaaacccccacaatctttgataattttctattttgtatatgctgggttcatatatgcattgcatctattcagatatatactttttggggcatctagcaacatagagctagcagatacatgtcctctacaagcaagacaaatggggagaaactccactcaatacagtggataataccagaagtggttagttcaggcatgactttccttgatctggctcttcttttcttgccacttaaaagtcttagtgggataatgtgtgagaaattctgtttcaactataaagtgccttataaatgaatggtcatgtttaccccagagtgtcagtgagtgtcacttgagccattcagctcttgtacacagatgacttatgcaactcaaaagttatgtatgacgtggggttggaaccgcgtttccctctgcagaatcagctgactcactggaaggtggaattcttgatcttggctcagttttatcccatattctaccagtctcaggcatgtggttatccctgtacttaagattcccaatccctctccccttaaagcttttggttggatgatagagccatacatcatatgaaaaaattagtgcatgactaacaacagaggttctggggtttctggtggagaccactgctttatgatgactaaccaaagcccccttagttatgtatttcctggaaaccctcatgacttccataactttgctcttttattctttcagaattaagagaggctcagttatactcaggtaggtgatgagagacaaaaccatattagggtaaggagtaaaaatccttgtgaacctaactactattatgaatgatttggaaattgcttagatttggattcttttggttacatgtataaagatgatacacaacaaccacaaaaatcctcagttgtttctatgtgttaacagtatctttgcctcctgaaatgtctcagagctgaagccatagggtaaaatcaatctcaggtgttaaagaaggattatagggtggaaaccgcagttccccaaaagtagaacagagctggtacactagtacactgctctgcccgcccagcttcagggtcaaaccatggtttgtgacaagcaggactgattgagctccacaatagtgctcttgagtgctagaggaagtctaggagtcttgtgtcatcccatcactgtgcctcagagcaaagtttgaaacttcccttccccctcacaaccgctttcaccctactatagagcctgggtaaatttaacattgcagaagtattcaaatctaaggtgtattcgtcccatagtcacagtcaccttctgttatgaattatcctctaaatgaagagaaggactctacatacagtggatctgcagtccttggtgtgcagtggctctgatccatatttattttcaacaagtattaaatgagtactttgcttgtatcctacactgcctaacattgtgcagggtattttagaggaacagaagagcataagtcatcctactcttggggtttacattgtctggttggaggtatacccatgacacaagaagaaggtaggcagctgttgtagacagattgttgaaccaggagccaagggttctggggttcttggttacctctatcagttgcctgtcttttgtgggagtaaaaatttgtgggcttaaatttctgagaggtaatgtttgggactcttcctcctgaacaagatgtgaggagcaaatgagagaatacatatcagtatttttatttatttatttattattttaattttttaaattttttattattcattttagaggcaggttctctgttgcccaggctggtgtgcagtggcatggtgatagcttgctgcagcctcatactcctgggctcaagtgatcctcctgcctcagcctcctgagtagctggaattacaggcatgcaccaccatgcttgcctaatttttttacttttattttttgtagagacagggtctcaaactcctgtatgcaagcaatcctcttgcctcagcttcccaaagtgctgagattacaggcatgagccacatatccagcccattatcagtgtttttgaagcaggaaaacacttgatgatagcaagatgctgtaatactaaatgccagaggagatgacatgggtcatacacagttttagatttcagaacagtaagtgtaatggcctgggcagattaagaaaaacttggaggatgtgtgttttggactggacattagaagaagatgaatagagcttcgatgtgcagagtaaagatcttatagaatggataaaagagtgatttgggctgggtgtagtggctcacacctgtagtcctaacactttggaaggctgaaatgggaagtctgcagtgagccatgattatgccactgtactacagtctgggtgacagagtgagacctcatctcaaaaaataaaaaaaagtaaaaaataattttaaaagagtgatttaaaaagtaagcatactgatacaggttcccagtcccttacccacagttctaaaatcccaaatctctgaaagccaaaacctttttcattattttgtgggaaattaattatagcatcaaaacctgaatttatgtggtactgtttagagcctttatccttcattatgtaaacattcatgaatctcacagcagatctattaatacttcattatagaatgctgcctgtctaaaacctgtaatattctgaattctatgaaacttggggcccctggaattttcagaataagggatgatgagcgtgtaagaaaacctcaattcagcgtatctgccaggcacagtggctcatgcctgaaatcccattgctttgggaagttgaggtgggaggattgcttgaggccaagagttcgagaccatcctgagcaacatagtaagacctcatctctacaaaaaattttttaaaattagggtggtagtgcacacctatggtcccagctacttgggtgtcttaggcgggagaatcacctgagcccaggagtttggggttacaatgaactatgaccacaccactgcgctccagcctaggcaacagagcaagaccctatctcttaaaatcagttcatgatggatattgtggcttcagatgtgaaagaaaagatacggggctaaaattctgtattttcagagtattctggtaaccagctaatccaagcagtaatttttgaaatgtgaagtttagaatatattctaaataaaatacgtgcaacctccagtgggaacctcttattattggggaggtagtagaaaggcgctgggtgttctaaaataggctctcctggcccacggctgactgtcttccttgtgtctctacagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttt

SEQ ID NO: 37420 - DNA, 28813 bp, Homo sapiens
agtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaaggtacgcacgcgtgcggcggggtgtggggaaactggcccccgccgcgcacttgtggactggagcttcggctgggttttgtttttgcttttacatttcggattactccagcactgggagtatgatctccagcgatacagataaagccaaagttcccgcagactttcccggtcctctagcactcagaagggcatatgttacctagcttctgtggttccttttctgccttttctattcttgtccatttttctgttacatttgtggttcttttccttatgatgtgtaggaactctttgtatattctggatttaagtaatttgtcagtttactgtattgtggatactttctttgggtttctttcttttctttttttttaagccaaatttagcagtgggagagttgcataccaacttgaataacagtaatattaataagttctgaataacccattaccatcagaccagcctctgggtctatttcttgtcttttagctttgtttatggtttctttgttagacagagttttgtttttaagttatagttgcagtcaaatttttcttcataactttgtgtattattaggtcagttctcctcaaattttaatgcactaacagtcacctggggatcttgttaaaatgcagattatggttcagtatgtcgggggtgggatctgagattccaagtttctaacaaggtccccagtgatatcatatgcctcttttggaagcacgctttgtgtagcaaagtttttattgttttgatttgtgtgtgtggtttttttgtttgtttgcttgttttgttttgcttttaagacggagtctcactgtgtctcccaggctggagtgcagtggtgcgatctcggctcactgcaacctccatctcttgggttcaagcgattctcttgcctcagcctcctcagtagctgggattacaggcgtgcgccaccacacccggctcatttttgtatttttagtagagatggagtttcaccatgttgaccaagctggtcctgaactcctggcctcaagtgatccgcctgcctgggcctcccaaagtgctgggattacaggtgtgagccacccccccggcctgtggtagcaaagttttaagtagtgttttagggtgtaagtatattcctgtatgtttgctgataatattgttactttttttttttttaaacggacagggtctccctttgttacccaggctgaagtgcagtgactcaatcataactcactgcagcctccaactcctaggctcaagcagtcctcctgccccaacctcccagatactaggactacaggcatgaggctatcatcttgtttttgtttttgtttttgttttttttcttgaggcggagtctcgctctttctcccaggccggactgcagtggtgctcttttggctcactgcaagctccacctcccgggttcacaccattctcctgcctcagcctcccaagtagctgggactacaggcgcccgccaccgtgcccggctaattttttgtatttttagtagagacggggtttcactgtgttagccaggatggtctccatctcctgaccttgtgatccgcccgcctcagcctcccaaagtgctgggattatagacgtgagccaccgtgcctggcctatcatcttgtttttactttttatctgcattacatgtgtagcaaggctttgctctgggtttgtgatttttcccttccccacaatcccctcaatcaaagattattttaataagtcgtaatagtggtagtactagtagcaactatgaaatttcttttagagtacttttggtggaaaggggctgtgatattaaataaacaagatggggtaattaagattccaaaaagtctgtgtcatttaatcatacttgaagaactaaatgtttgtgtgagtatgtgtgtatataggatgactcaagaaatacaataagttccctgtcctcaagagttttaaacttgactgggaaacagaacatacacagatgaaatgtgagtgatagttataaaccagtgtgttaaggatgaatattaagatgcaggtcaaaagcatgattgctgtaatatataaagtgtgttcagagcagacctttattgctcaaggaaatcttcctgaaagaggtaatatttaagcctggcttttaaagggtgtggattactaaagaaggatttactaatggtattcgactagtgttactactccctgaaataatctttgatttttttaaaagaaatatattagagaattagcaagcccttaccaggggcgtgaagggtgcaaaaggagtctgaatggcaaacagctagtctgataatgccagttgttgtcactacaggtgtacctggtgtgagtgttctgacattcagggccaagtgtatcatacttactctgcaagattaactgtgattctcttataacagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggtctggtgccaccttatgtctatatacctttttagggaggcttattttctcatattaattggaaattaaggatagtggctaattaaatacatttacttggtgatttgcctttgtttacaccaccagtgtactgagaattcatacataccatacatatttttaaatgggctgctgaggagatttgtgtggctatgttttgaagcacctggggaatgaacctgtgggagtgtaaagatgtgtgagtcagcaggcccaggagtttggagtcaggcatccatgttctaatatggtttcagttgctggctctggcttcggatgaaccatttgattctgtctgaccagtttcttcattcaaataaagactatgagagtaatgctagcttgggtatatagcaaatgccaggagattaatttctcactttgcaggatccagatagagagatgtatgttgaaatggctcacttgcccaataattccagggcagagaggacaatctaagggcagaagtgggagaaaagcgatagaaagctggaggagtgggaaaggctgctggaacccattgtcagtgacctgaagatgaggacagctaaggagttagccttagaagagaaagtgagatgagctcttatgctaattatgaggatatgcagcattgagagctgcagaaataattgggagtacctagcctgttcttcccactgaacatcattttggtagctattaaagttaaatattagatgatactgttctactttttactttatttaggaaatgctgtgattataaagccttctgaactgagtgaaaatacagccaagatcttggcaaagcttctccctcagtatttagaccaggtaagaatttcttgactcatctccaacatatgtgtttactgtggaaaacacacattttattttcttgctattgcatgttattgctggccggggacccaattgcagtctctttaagccttcaacagttggcttagcaaaagaagttcggttccaaaatacacggagtgtattttgtgtggagtcacccagctcttggggttacacaatatatgtaggcccatggcttcatgccaaacagattctgtgtttgtctgggatttggggttaatttttgagctaacatgattttaggtgttttcatttaatggattatttaatgagggactggtactgtgctgggtgctgacatatttctgttactaacaatctcttttgttctaacaaaatgtacttttctgtgattatataagagtactttttttttttttttgagatggaatcttgctctgtcacccaggctgtagtgctgtggtgtgatctcggctcactgcaacctttgcctcctgggtgcaagcgattcttctgcctcagcctcccaagtagctgggattacagacgtgtgccaccatgcccagctagtttttgtatttttggtagcgatggggtttcaccgtgttggtcaggctggtctcgagctcctgacctcaggtgatccgcccagcttggcctccgaaagtgctgggattacaggtgtgagccaccatgcccatgtgtctggaattggtgggttctcggtctcactgacttcaagaatgaagccgcggacccttgcagtgagtgttacagttcttaaagatggtgtgtccggagtttgtttcttctgatgttcggacatgttcggagtttcttccttctggtgggttcgtggtcttgctggcttcaggagtgaagctgcagaccttcgtggtgagtgttacagctcttaaggcggcgcatctggagttgttagttcctcctgtctggagttgttcattcctcccggtgggttcgtggtctcgctggcctcaggagtgaagctgcagaccttcgcagtgagtgttacagctcataacggcagtgcggacccagagtgagcagcagcagcaagatttattgcaaagactgaaagaacaaagcttccacagtgtcaaaggggacccgagcaggttgccgctgctggcttgggcagcctgcttttattcccttatctggccccacccgcatcctgctgattggtccattttacagagagctgattggtccgttttgacagggtgctgattggtgcgtttacaatccctgagctagacacagaatgctgattggtgcatttacaatcctctagctagacataaaagttctccaagtccccactagattagctagacacagagcactgattggtgcatttacaaaccttgagctagacatagagtgctgactggtgcttttacaatcctctagctagacataaaagttctccaaatccccaccagattagctagatacagagtgctgattggtgcatccacaaaccccaagctagacacagagtgctgattggtgcatatacaatcctccggctagacataaaagttctctaagtccccacccgactcaggagcccagctggctttgcctagtggatcccacgccggggctgtgggtggagctgcccatcagtccagcgctgcgcgcctgcacccctcagcccttgggcggtcgatgggactgggcgctgtggagcagggggcggcgcccatcagggaggctcgggcagcatgggaacccaccaggggcggggtgggggccttgggcatggcgggctgcaggtcccgagccctgccctgcggggaggtggctgaggcccggcgagaattcgagtgtggcgctggtgggctggcattgctgggggacccggggcaccctcctcagcagctggcccaggtgctaagcccctcattgcccagggctggcggcgccggccagctgctccgagtgtggggcccattgagcctgcgcccacccagaactcgctctggcttgtgagcgccacgcgcagccccggttcctgcctgcgcctctccctccacaccttcccacaagcagaaggagccggctccagccttggccagcccagagaggggctcccacagtgcagctgtgggctgaagggctcctcaagcgtggcgagagtgggtgccaaggccaaggaggtgctgagagcgagcaagggttgcccgcacgctctcacctctcacccagcctataagagtacttctgctttcaaaaaagacatgtctgtggcatgaaaacatgccacacatacacaaaaagtgccctcctgaactagagggcagatcctcacactgacttaacatgctggcatttaagaatatcaagaactgaataaagaaaatgatctgcccaactgcgggtagttcatctgtctgagtcagaggttcttatgccttcctggggaggaagttatgatgccgcgaagaaattggcactgctgagttctacatgcagttgctacagggaggagtcttcatttagctttaagcgaaatacagcttaaaaatatcttacctgtattctgtacatcaacttgtgatggattgaggccagttctggttcttggaatgatatttttctctttgttagagccattttgttctaatagctgtgatgatccaatcaagaaagatgaaatggaagacagtgagatgtcaaggattgaataggacgtagaaccagaagatagaggttgaaggtaccgctttgcccctgaccaggggtaaattcttcaataactgactctgtccggataaggaggataataatgctctaccagcttcagttaccgtgttaggggatcaataatatatgctatgtagattaagccatagaaaagttaaagcttgaaacatttgttgggcagctgaaccatgaagtgaatgaaattaattcgccttcaagtggaaacatgagatccacaagccagcttttacttcacacttccaccttggagtcttgaatacctctctgtcttccttgcttgccatctgttctcttacttttgatgctgttattgtccaagatgttctctcttagaatagctggtaatgatagcacaatgcatagatgggctcagtccacagaagctacgtgaattctcccagtaacagatgaggaaattgaggctcagagatgttcagtagcttgcctaaggttgcataagctagtgagtggcagagcccagattcaaaccagatacacttcaaaagcaagcgctctcagctactgtgccggatataccattcattcagaatagcgtgggctaagcccactctgtgttgtgagacagagaacattcagactaagacatgcatgacctgtcctgtgggagccactcttcaccagaggcacttctgcacacacccgcgtctcatgcattttccctggtcaaattcaaccatttgttctccttagtgtctttgttgctgagctcatgtaaaaaaacactggagtctccagattagttctatgtgggttcatgcttcccagatgccatcggactgtgtgttctcctcttgtccttggtcagttccctctcccatccctcacagggactggtcttgacactctctgggttttactgaatgttacatgtttatgttgaagagattgctgatgttagacgttaggatttatttggcagtgcaagagtttgtgtttctctttctttgaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcaggtgagtctggctctctgattttctgaggttttcccagcacaatggagacttttcctgacaatgttactctttgtacttgaaccccataccttatggctccaagatacattattaagctttggtggttgatgtcctcaagagtaacaggagtctttcactgtctcttggcgccactgtcaaaaatggtgagctgtaagtcctgacatcatgtggttgtccttaggaattttaaaaaagttatatctgttctcaagattacagctagatctagcaagaaattttaacgttcttctggccagtgatctgtgaagtacataatccaaagtattgtgtgtgcctaataaaatctttaaatgcccatttgagagggtattatgctgatatcttaactgagatcctttgtgggcaaaacaagtgttcctcattttttaactgtgaataacatcttgcatctgaaaattagaaaataagaggtttcaggttctctctgctaaatccggtttagctactaagaagtgccaaatcatagaactgactctgtgctctgggtggtgtggctttctctgcccttcagagattccaggtcagggttccaggttggcttcctaagtagaaatccatttgtcaaaaccagacaccctcagttagtgaatgtttagggcatgggtttctgcccatgcataggaaaggtcttcccaagtggggcagggctccacaaagaggaggatggccttggaggctggctgacatcctgctttatacctgaacatcttgcaggcagagccaaaagccacaaccaggagagtctgtaccgaactctggtcatccaggactttcctttggctggactggaagaggggaaaggacattgggaggctgtttctcctcttttcctgcagcaggcaatggcttcactgtttaccaagtactgtttgccgtgagctggcctgagaacttccctgctatgtaaaatattccacctcatttggaaaatactttctaagttccaaacaactgatttagaaatgagtttttaacttttttataaaaattgccagataaatatatgaatctattttagttgcaagacattcaaacaacacaatgtaacaaatgaatatttgactgaattactgaattatatagctgttctggatgttttcccctcagacgcataacctggggaaaatacatgaattgtggccaaacctgcattgcacccgactatattctctgtgaagcatccctccaaaatcaaattgtatggaagattaaggaaacagtgaaggtttgtattaaaaacatctgattccactgattttaataagataaggagtcaaattaactattcgcaggcagcatccccatttgtttctcccttcaggaaaatttcaaaatcatatgtgactcagtgaacttattgactaatatgaaaatgctatgtgtaccatagaatatatgctgggagcaaggttgcattggtgttaaatctacttaaactgtctagttgatttgttgatgattagttgtggcatatactttttttaaaaaagttaaataatcgtgtgtccgtggttttgagggaatgttgccaaccctttaggtataatcagagagactctttggcatattggccattgctgctgaaggttatcagtttttgtgtatgtagagggcctagggtggccagtagtttggaggagtgacttaattaaataactacttacagtataccctttatataattaacaatctttcagcgtgtttaaagtaaatatttgcagtgagggaaccaaggaagactgcatgtagagtcctaagccaagacttgaagaaatataggatttaagttggtagaaaggaatgggggctgggcacggtggcttatgcctgtaatcccagcactttggggggcctaggggggcagatcacttgaggtcagaagttcaagaccagcctggccaatatggtgaaaccctgtctctactaaaaatacaaaaaaatcagccggggatggtggtgcatgtctgtaattccagctactcaggaggctaaggcacgagatttgcttgaaccctggcaagaatcgcttgaacccgggaggcaaaggttgcagtgagccaagatcacgccactgcactccagcctgggcgacagagcaagactctgtctttaaaaaaaaaaaaaaaaagaagaatgggatgaccaaatgaccagtgtgactgagttcagcagtgggtgaggatcattaacccctcagatgaaagaaattattggagcagtcactgtttactcgacagatgttaattgagcactaaaaggaaggatcaaaaacaccaaagagtaatgcatgtgatctgaaaatgaaaattgttggccagacatggtggctcacgcctgtaatcccagcactttgggaggccaagacaggttgatcacttgaggtgaggagttagagaccagtttggccaacatggcaaaacccatctctactaaaattacaaaaattagccgggcatggtggcacgcacctataattctagctacttgggaggctgaggcacaagaattgcttgaacccgggaggtggagcttgcagtgagccaagatcatgctactgcactccagcctgggtaacggaatgagattttatctcaaaagaaaaaaagatatgaaaattgtcgccgttgtggtggttcactcctgtaatccgagcactttgggaggctaaggtgggaagatcgcttgagcccaggagttcaaaaccagcctggtcaacataatgagaccctgtgtctacaaaagaaaaaaaggttagctgggtatggtggcacatgcctgtagtcccagctactcaggaggctgaagccagaaggatcacttgagcccaggagttcaaggctgcaatgagccattattgcatcactgtgctccagcctgagtgacagcataagactctgtctcaaaaaaacaaaaaaagagaaaattggctgggcacagtggctcactcctgtaatcccagcactttggaaggccaaggcagacagatcacttgaggccaggaattcaagaccagctgggcaacgtagcaaaatcttgtcgctacaagaaatacaaaaattcaggtgtaccggcgtgtacgtgtggtcccagctacttggcaggctgaggtaggaggatcgcttgatcctcctgggaggcggaggctgcagtgagccaagaatgtgccactggactccagcctgggtgacagagtgagaccctgtctcaaaaaaaaaaaaaaaagagaaaattatgtaccaggaagttcaggacaatagttcactatgtgttccaggcagagtaacttgggggatgaggtgctagggtcttgacatggaaattggactatcatttttagtcataggactaaaaatggatccagatgagcacatgaagggagagttgcccagattcagggtatgtgggaagagagagtggttaaagatacttgtgagattgaaaatatttgggaattggagaatgcttagttgagtgtggtgatgaattcaatttcaaaggaataagggcctctgcctccctttgaggcatttatactcttaacacagtggttctcaagctacatgttaccctagtgagccatttaaaaacaagtttgcaagccttaccctccaaagattcagctcgtctgaggcctccaggtgattctatgatgcattcagcattgaaaactactgttggtgactctcgagtcagagcccaggcacatgcattttagcaagctgcaccagtgattccgaccacccagacttgagaattgctcttggtagaggttggatgaacaatgttcattttgatttgggatgaaattgggaactctcacaaggctttgaagtgatgcagcaattcagtaattttgtttgttttactaagtaaatattgattgtatgattattgacgttcttttaccttggtaatttaccaaagctgtattttgatccttcgggtggtttcaccatcatgtgtaagtggtggaaataccagttcaaagaagaccaaaacaacaaagtggagcaaagattggcaaatggtttctgtaaagggctagatggtaaatatttcaggctttgcagatgttagggtctctgctgtaactaccgaacttactgtagggggaaagcaggcacagccaatgtgctaacaaataggcaactctgatgcagagcaagacttctttccccagcctgctcccactgtcagccccaggaggtgaaggcctgtgggtggactctaagagatccataagaacctttggaactatggacaatgacagatctctgtgtgtgtgcatgctttattttctggtcctcgacctgccaaaaagctgaaacttgctactatcatactactgttaaattacttgaggggtggggtgttagattctgtgaggatataaaaccagattgattttggggcatggctggattttgtacttactgaaattgaattgtgggtctttgtgacatttatatactcctgttgttttaaataggaattttatggagaaaatataaaagagtctcctgattatgaaaggatcatcaatcttcgtcattttaagaggatactaagtttgcttgaaggacaaaagatagcttttggtggggagactgatgaggccacacgctacataggtaatggaaattctccttttcctatgggaagatggcaatttggcagtttttgctgacactacttattaacactagataaactattaaatatatagcatttaattgttaaagtactaaatcctgctttctggtatactgtacctgtagcttttgttataaactatttaaaatgtctgtgtttctgtgtattgaatgatgccaccagcgttgctccagttgttcatatttacacataactccttttttcctcctaacaatcctgagaagcagaatagaacttgatgtaattatctgtagtttgtggatgggaaaacagcacaaagaaggaaatagcttggccactattccacaattaaccagtgacggtaccattccagaaataatgttttggtccatcatgcttgaccttattatttgtgtaccttctttgtgctttttcttctttgccttgaatatgtattactttgaatgttaagcacatttttctacagtaacatataaggtgacagaaaaattagacacattttgctggcaaagaagctgcaccacctagctttacttatcccctttatcagataagatgctataagtcaccaaaaaaaaaaaaatcaactttaaaaaaaaaaacttaaaaatgaaataataagcagaattgattctcttataattagcagtcccgaggttctcctgagctagataattcagtggccccgtggtaccatcaaaaaaccctgattctttgtactaggatgcaaaagaaaacaatccttgtgccttctatctctcttggtggcagcccagattgaattggggaatacatctgtagaaaaaagagaaaacagactctacttgtttcacctctctgttctcccatcctcagcatgtccacattgcctatttctaggctaatgaatggtaagaggaaggggctatcctgattagcttatagactaattaggactttcccctgacttcgagctgggatcatcttacctgagcatggctatgcagaggaagtagacactcagcccaaattgtttctctgacctgaggaagatgtgggcaatggatttggagtggcagtttatataccccctggaagtggtgctgcaagaagctgtccccagccacattgccaagataacctattagaaactgggggtaaaggaaaagtgccaacttgttattgtcagatgacttctcttttggttgacgagccagtttcttacttacagcatcttttggagtactgctagttggtgacttacattggcagcagatgctgggacactttgtctagcctccccagcatctgtttcaccctcctttcttgtgcctcttccccatggtagatggaacagtggactaaggtttagggaattttgaccatttaagtctgttttcttaatctgtctaacagagttataataaaggttaatgagatcatatatatgaaagcactcgagttaagaaaaatagtattgatttgattcacagaggagctgtctttgctcctagaaagacctgtccattcgagaccagcctgacccaacatggagaaacctcatctctactaaaaatacaaaactagccgggcgtggtggtgcatgcctgtaatcccagctactcgggaggctgagacaggagaatcacttgaactccagaggcggaggttgcagtgagccgagatggcaccattgcactccagcctgggcaacaagggcgaaactccatctcaaaaaaaaaacctgtccacagaaaaatgttaagtataatctacagttaaatacatgcatggctgtgaacagggttcaatgtgaaaaagatatatttgagtgtgtatcgttcccttggtttgcacaagtatccgcagggttgtgattcacaggctttggagacattgagtatgtgcacagttcatccacgtgctcaggatttttcaatagatatgacttgggtgggagagggaaaggcatggataagtgacccaatgaaagagatgtaatatgagagttgtgcatttttgtctaataagcattttcattttgtttattttctttttagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataaggtaagctttagagagaacagctagttagcataagcaactgtcaagagtcatgttccttctttgctgtaaaacaatgcaaaaaacaatgtgaaacaatgatggtttcttttgtgtcatgtcagagtccatccactaagtgaggttgtgttccgaggttgctgtcttggttaatgagactctggggttatcacagcatccattcccctcctccctcgggttagatctgagtctgcagggttgagtgtcacaaggtttttgattcacaaacatctcctgtataattggaagacttatatgtgccagcattaaatgcttttctgatgttaatccacagggcattgctgaataacagcctgcacaaaatggcattcacacccactgtgtgggacaaagaccccgacactgtcacataaatggttgtgatatgatggattttagtttctaacatgacgctagcttcttgttagagtggtggaactgcatcacctggttgagcagttctgccactttctgcatggctcactcattcatgtcactaggtgaccagccgctactaagagaccatggcccaaatgttttctggagagcttctgatggtaatgtatagatagtcatgtgacagcttttggagcttgtgagactattgagatacagatagctacaggtatttgaagtgagaccaaatgtgtggggctcagtaaagactgggttattaacaaaacaatggtttgacatttaaaaccatggataatgtgggcaggaaggaaccctgaagccgaaagtaggctggccagggtataagtcaggtgtggagcacttcccagcagtgggtcacccgaggtcactatagtccagacttgacgtttgccatgaacaattgtcaagggcttgctggcacccaagggtaaatgacgtttactagtcaagtgttcttgtgcttttctgagccttaggccaaacaaccatttatttcttaaaaaataggatgctaaatctaaagtcttaaatatttttacatttcataaagactaaataatacctattaatcatgtgttataatttaaagcagagataagaaagaaataataacagtttttaaagctggaatatagtctaagctgtccccttttaaagagtcttttgctgctgtgttggggagtacaactccaggttgtggctgagtaggcccagaggtttggagctgcctccttttgtgcactagatgtgtgtctgagaagttgggtatcagtcactttgctaaattaaccagttgagattgtttgtctatctggcatggtgtccccaaactcgagaattttcactgacacaaagccagaatgtgcatgctttgagcacataactgagcacacagccctctgtgtggtggggccatgagtgttccctaaggggcaacttcactgacctggacacctttggtctgtcctcagctcatcaaacggatgattgatgagacatccagtggaggtgtcacaggcaatgacgtcattatgcacttcacgctcaactctttcccatttggaggagtgggtgagtcttattttctcctgcttgtagtagatatttcaaaagcaccaccatttcatgagtggattgtatgggctgctgaaatagccagctgttgcgtaccctgattgtcctctcctgagggagaccttttcctggtcacccagttgactggttttcctgcttccccacccacccctccagcatagggcaaatgtcttgtcactctctttctgtcagcagcactgactgaccacagctttgttcacttcgttgattttgttatcctgccacatttaggagatttgggaaccaagaatcaggtctcaaattaattaagaagatctctcttcgtgtgtgtgtgtgtgtgtgtgtgtgtgtgtgtggtgtgtgtgtttaatgaagtagcaaatgaaaggttcggaataccagggacagaaggtagaggggttttctaatgtgcctttgttttctgctcagttcttacctgcattgttccccagccctttgttgggaggagcagcctctccttgaattgttttgtgatttgagtaaaacgggactccccctgttctagagaggatgggcagaaagaaattcattccaagtgaagctttgtggacatagcctgatccttgcttttccctttagaacatgacctgcctgcctctcccacatgtgagatgactgactcagctttttatttctcctttgggacctaggctaggtgggcttttctactctctactagagctattacaaaatagccgatatgtaaacattctcataacaaaaacccaaccagaaaagccactgtcttaaagccctgttctatcctctccctttgtaataccgtcctaagtcagttgctccatgggatgcgatggcccagtttggcaggaccatctgttcctggttaaggaaaccttgtcctatgaccaaggagccttgacctatatagccacaggtccttgtctaggaggtaaacatattgccagcacccagcacagtgactgacatgagtgagggacaggcgggaagaggccaattggtaggtattgccagatccaaattggaaatggtggtggcttgtagagggtggtagcaggggagatagtggaaagggaagggggtatttttgggatcaagcagcaggattggctgatggagtgaatgttggaggagggggtgaatgagagaggatgactcctgggattttggctggagtaagtaatagttttgtagcccaaatgcttaaaagattggactctgttgtctctgttcctcagctcaccacataggatcctggcatccactgtgctagtgcagtaatcaactcggtaattgttccatatggtgtctccactgccctctaattgcaaatctaagtgacttgggttcagtccctgtcctacttgacaagatagcctgtggcatcattgactataccatcttatttaaaacaaaacaaggctgggcgcagtggctcatgcctgtaatcccagcactttgggaggccgaggtgggtggatcacttgaggtcaggagttccagaccagcctggccaacatggtgaaaccccatctctactaaaaatacaaatgttagctgggtgtggtggtgcgtgcctgtagtcccagctaccagggaggctgaggcaggagaattgcttgaaccagggaggtggaggttgcagtgagctgagattgcgccactgcactcaaacctggcaaacagagcgagactccgatctcaaaataaataaataaataaataaataaataaataaataaaaataataaaataaaacaagcaacctattatatacccacaaaaattaaaaatacaaaaagaagatgcaaaagaaaaaaacaggtttactctcttagcaaatttcaggcatataatacattattatagtggccatgctgtaaaaaaataaaaataaaaaataaaaacaagccttgacccccaaatgtaaaaagaatacaggctttttaagaaaacttggaaaagatagaagagcccaaagaataaacatttatattacccataaccccactatgtaaagataactggtatatgtcttgcacacatatgcacacacatatacacggtcatctgaatattctattcaaaaaggtatcatactatatattgttctgtaccctgtatgtgacagaatagtgtgacacttttccatgtcaatattcttgcatgtcataattttagtagctgcatacttttccatcatatgaatgtggcatatttatgtaaccaattcccagtattagatttttgtgatttcaatttttttggtattacgattcttatataatgtatctttatgcaatctctgattatttctttaggaaaaatgtctacaagtgtaattactctgttaaaagggcttatacaattttccaaattgaaaaaaatgcttttttcttctaattctcaaagtaatatagacacagtggcaaaaagtctaaacagttaaactttttaatattttggcatatagtttagatttttcttttttttttctttttatcgagactgagactccctgtcacctaagctggagtgcagtggtgtgatctcagctcattgcaacctccaactcctgggttctagcaattctcctggctcagcctcccaagtagctggaactacaggtgtgtgccaccaggcccagctaatttttgtatttttagtagagacacggttttgccatgttagccagcctggtctcaaactcctgggctcaagagatccacttgccttggcctcccaaagtgctgggattacaggtgtgagccatcgcacccagcctaggtttttctttagaaatgcttctctttaagacttttgatagatatttcaagtgtctttgcagatttctgccactttatattcccatgatcagtatatgagtgtttacttccttatatccccaattctggattattccattattaaatttctagacagaaaagggtctcatttcaatttgtactcctttgattattagtgagtttgaattttttttaccactctcatgaattttctatttatgtcctttgatatttttgctgtgttcacatcttccttattattggtatataaatagccttttttataagtaagaaaatcctcagtcctatctgtaatacatatccctttccagattttaatttttcttttaattttatctatgatttgaagcgtttatttatttagagacagagtctcactctgtcacccagggtggagtgcaatggcgcgacctcggttcattgcaacctctgactcctggcttcaagcaattctcctgccccaacctcccaagtagctgggattacaggcacccgacaccactcctacctaatttttgtagttttagtagagatggggtctcaccatgttggccaggctggtcctcaactcctgatctcaggtgatccacctgccttagcctcccaaagtgctgggattacaggcatgagccaccacatctggcctaagcctgtgtggctttttgttttttggtttccgatttggaaagtaggcttagaaaagctttccctatttcattattatataaatatcatctgtaggctgggtgcggttgcacacacctgtaatcccagcacttggggaggccaaggcacctggctaacatggtgaaaccccgtctctactaaaaatacaaaaaattagctgggtgtggcggcaccacctgtaatcccagctacttaggaggctgaggcagtagaatcacttgaaccctggaggcggaggttgcagtgagcagagagtgcaccactgtacctccagcttgggcaacagagcgagactctgtctcaaaaaaataagaataaaataaataaataattaaatattatctgtagtttccttccctccctccctccttttcttcttttcttttcttttttcttttcttttctttccatttaaccatggagttggccaagcatggtggctcacacctataatcccagcactttgggaggccgaggcaggtagatcacccgaggtcagaatcttgagaccagcctggccaacatggtgaaaactcatctccacaaaaaatacaaaaaaaaaaattagctgggcattgtggcatgcacatgtagtcccagctacttgggaggctgaggcagaagaatcgcttgaacctgggaggcggaggctgcagtgagccaagatcatgccactgcactccagcctgggcaacagagcgagactccatctcaaaaaaacaaacaaacaaaaaaaacaccctggagttcactttagaatgccatacgctgcatgatgtaataatttaccttttttttcccaaagagtaaactatgctggcaccattttttgaaataatcatccttataccatcagtactcaataaaaacacgtttgggtcattcttagggttttctcattggttgcattatctttctggtttgttttttccgtgggccagtaccacagtttcaattacagtagttgtacagttagctttataagtgacatttagtaagtgcttattgtatgccaggtactgcggttgaatccacgccttttcttttcttttttttcttgtttgagatagggtctcactctgtcacccaagccagagtacagtggtgcaatcacggctcattgcagcctcaacctcttaggctcaaacaatcttcccgcctcagcctcctgaatagctgggattacaagggtgcaccaccatgcctggctaattaaaaaaattttttttgtatagaggcggggtctcactgtgttgcccaggctggtcttgaattcctgggctcaagcaatcctcccacctcagcctcccaacgtgctgggattacaggtgtgagccaccgtgcccggtcaaatgcacgcattttagagacagacaactaataagtagtaaagccaagaaatgagccaaagttgtctggctccaaaacccacatattcaaccaatccagtagtttgctctttaggacacagtactatttcaatacctaaaagtaaaagctcctcattattactgtttttcgatgttttcttgcttgttcttatctaaatttatttttccagatgatctttggaatcactacctcctcctacttaaaacaaacaaacaaaaccttccgaaatcccctaggatttttattaaaattgatttaaacttaaattattttgggaagaatttatatctttaaaatgtggagtcttaatgggaatatgttatatcatctcttcatttatatagcccttttatatctttcaacaaaactttgtaatttccttcatgtcagttttttgctttttatttattttttgagacagggtctcactctgttgaccaggctggaatgcagtgtggcacaatcatagctcactgcaactttgaactcctgggctcaagcaatcctcctgcatcagcctcccaaatttttcccagtttcttactaccttggttatgtctttggctcgcccctcccttattctttttttttttttttttgagacggagtctcgctctgtcgcccaggctggagtgcagtggcgcgatctcagctcactgcaacctccgcctcccaggttcaagcaattctcctacctcagcctcccaggtagctgggactacaggcgtgcgccaccacgtccaactaatttttgtatttttagtagagacgggatttaacgatgttggccaggatggtcttgatctcttgaccttgtgatccacccgccttggcctcccaaagtgctgggattacaggcgtgagccaccgcacccggccccctccctcattctttaccctccctcagagttagggtttctcatggtcttgtccttgggtctcttctcacaccaggcctgcttcatgaatgattccttcctgcagcctggccttggtaaactgctccctggcctctggtcacctgtgtcttatatcacacatgccattccctctgcccagctcacactgctccgctttgtgcctgtcagtctgttgtacacacaatgaattagagaaatgaaactgtcacagagcatggctttgtggagggcagagatttacacttgcttattatcatccagctgtgcaaccttgttgccctgtcttactttccacaggctttgagaaagcaagtgggtgtgtggggccatggatgaatgaagccacatgggatggtgggaagagagcacatatagcatttagagtctgatccaggttcgggttctggctttgccacttagcagccgtgtgaccctgggcaggttaactgaccctgtaagctccctttccctctctggaaatgaggctgctgataattcaccaagtgggattgtggtgagaattatcttaagagaatgatttaactcttagcacagtccctggcataaatgagagccacagctctagaagaggtgcaagtccttgtcttgctcatggaaagcatcctgtttgacagggaaattgacttttccagggaagttggtaaggacttcctgaaaagagatacttcagctggcagagatgttcagtggggttcccaggcagcagggagtgcatgtgagctttcccggtcgttgttagacagaagtagcttgcatcatctacagtgaagcttgttttgtctgttccctttatttcaggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggtgagtccctataacccatgagtgccattcagtctggtcctggcctgatggctgccagatgcatattctagcaggactctacattaacttgtagagtctaagacagggtcagtgaaccacagcctgctggccagctacccgtttttgtcactgaagttattggaacacagccacacccacttgtttaatcatccacagctgctttcatgggacagtgacagagctgagtagttgcaacagaggctgaatggccctcagagcctaaattattacagaaaagtttgctgatctctggtctaagagattaaaacagcgtagaacttgattgcagaattctgagctgtctgatcaaagggttagccctttgatccttttggtattggactttccttgtcacttacagctttgttcttgaatgtgcatgaaatcagcttaccacagaggtgaaggcaagaactctggtacaacagctttggtgagggatattttattaggcttgagtttttttcctccaaagttcactacctgataaagtttatctttggtgattagtcattatagggatgggcttgcaaagaggccctcatgatagctgccttctcaaagcagtttgcgtattttgagatgaaagaggaaatccgtaattaaagttaagatggaatgaggaaggcaattgtgtctgtggtgccctcagccgttcaactgaggatataacattgaaaatattgaccatatcagtgaagaatgggcttggaaaaggcaatggtaatagttgtgtttatgttttgtttaaaatttgaaagggggccggcgcagtggctcacacctgtaatcctagcacttcgggaggctgaggcaggggaatcacgaggtcaggagttcaagaccagcctgaccaatatggtgaaaccctgtctctactaaaaatacaaaaattagccaggcatggtggcacgcacctgtagtcccagctactcgggaggctgagggaggagaatcacttgaacccgggaggtggaggttgcagtgagccaagatcatgccactgcactccagcctgggcaatagagcgagactccatctcaacaacaacaacaacaaaaatttgaaaggggtttggctcatcttacagtatcccagccttagtggaattggagataccagttgcatttgaaatcatttgggttttctcagaaataccaagctgtgctgaggagaaaggccctgttgatttttctggtagttcacagactgcgttggtccagtaagcagagatgaacaccagatttcaaaacccagccctgtctgttaagagtgaggtaggaactttttgttttctttctatatgtaaggtgggccaagttggggtatgttttcaagggttttttggtttgtttttgtttttgtttttgtttttgtttttatttttgttttttttttgctacagttggaggcttaagggttattgaaaaaagaatgggccgggcgcagtggctcacgcctgtaatcctagcactttgggaggccaaggcaggtggattgcctgagttccggagttcgagaacagcctggccaacatggtgaaaccccatctctactaaaaatacaaacgttagctgggtgtggtggtacgtgactgtagtcccagctactagggaggctgaggcaggagaattgctttaacccgggaggcagaggttgcagtgagccaagattgtgccactgcactccaccctgggtgacagagcaagactccgtctccaaaaaaaaagaaagaaaaaagaatgtttaacttacttatctctagacattttggacctgggcccagagtatcagggtgttaaaactccacttatccacaattttaaaagggtgaagtgacttgctaggaatctaagagaagtgtgcagaggcaatggcttagctgcgtccaggtgaagcatacatcatttcttggaaaagggcagctgagtgtgagcctcatttctcttccccttctactcagctctcctgggggaggtgccagctgactaattcagacttgtcaccatctaggcactgaactctttatgtcataatttaagaatatgttttttaaatcactaagtagttttgatttgttttcatttttaaaaaaaggtttgactttggaattcatggcagcaaatgtcgtgaaatcaaggtgtagtatacaatttaggggctactttctttgccttcctgaggctggaggtgtggtcggaagcttacttgggtctctggtcaatatctgtctcttttgttcttttcccaagacctcggttcctcagtttgataatgcatcttggtaggatagaatattttagcctcatggaaaatacggaggcccaggctgagtctgcattctccaatcttaccaaacccccaagaagcctccctcaggtgcagtgcagtgtgccaggcaggttcgagttcccaaagggtttggcaggcatgtttctctgtgagggtctagagaagcagcaatatataaaagaagcagcaatatataaaacctttagcagaaacaaaaaaatgtggtttgattcctggctcaatgaacttgggcaaggccttttctgagctctttcttgggcctcagcttgctcatctacagggtgagggagtaggtgtcagtgattccccaggccactttcaacccttccgctcaattctcattactaatagttgttaatatttctttggattcaatctggaactaggtagagatttggttttcttttccactttgctgcttttctgctcctttctgagcttttaatcctctttttatcaaattaccttttatttaaaataaatgactttgaatctgtactgtatatttacctgaatagtctatttattgtaattacatttttctgaaatggcttttatgtacttaatagtttccttattttgttacactcttggattttattttattaattaccttactagaattagaagggatttagagcagaagtattgtacacaaagtaaagttccaataaagcttataagctacagaaggcattgtgggagatgtgggttttaaaaggtcgagaaacataagaggttaatgttgataaatttcattaggcctttgacaactaaatatgacatttgaaccttgagattgcagcagcccttcctcagtcttcaataggaaggattaaattcagtactacttttgaattttagaaacaaaattgtataccagtttttgaattccatgtagagacttcagcttcctactgaaaatgctaggataataagttagtactctcatcttctgtctctactctgacattagctagttgacagtggacagaatatagccttcattatcacgttgtcttactcttattgttattgttgttttttgaggaagggcataatcctttggcctaaaccgtgcttcctaggcttcctagggatatgtagtccttttttgtacaatgcatgtagagtctcttcagacaggaggtgtctgagtcccagtgctgagcttgtgttgcaaggctggttgtgggtaggtttttaaagcagctgagtaaactgaatccttttttcctctctccaggcagaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcaaaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtcttt

SEQ ID NO: 37421 - DNA, 149247 bp, Homo sapiens; identical to SEQ ID NO: 36954

SEQ ID NO: 37422 - DNA, 44831 bp, Homo sapiens; identical to SEQ ID NO: 36367

SEQ ID NO: 37423 - DNA, 67815 bp, Homo sapiens; identical to SEQ ID NO: 36110

SEQ ID NO: 37424 - DNA, 11115 bp, Homo sapiens; identical to SEQ ID NO: 37376

SEQ ID NO: 37425 - DNA, 20544 bp, Homo sapiens; identical to SEQ ID NO: 36418

SEQ ID NO: 37426 - DNA, 68857 bp, Homo sapiens; identical to SEQ ID NO: 37369

SEQ ID NO: 37427 - DNA, 35627 bp, Homo sapiens
cgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttgggtaaggacggactggccgacggctctgccaggccggggtggtgggggtgtgagcaaaggcggcgcgcccggaccgaccccgaccccgaccccaacgggcccccggcggcggcgcggcggcgggcgaggagctgtcctgcctgcggggcccgctgccgccgctcctccttcccgggcccggggcgggcgggatccctggtgctcgcgggagacgccgctccggctcccggagccctggtttcctggggcccccggttcgtgcgccccccttcccgccccgattgctgtgacctccaggccgcggctatgccgcgaaaggctcggattgtgcgcggccgccagggcggactggggaccgtggggacggagccagggtttaaggtggccttttttggggggtggatcagggcgtggaccatctcggtggggtgcatgccgcgcctgcgatggacgttggaggaggagagggccgggaaccgggttcgtattgcctagcccggcccgtgtggagcgatgagtcgggaactgagtacctctcttccacccgggaactgcctctccttctctgcgtgaccttgggctgggagccacccaggaaatgttctcgagaaatgaggacttcaattccgaggtggggagtgtcatctcctctctcatgcctcagtttcccaatttatagacaaggtgggcggagccttcttgaggcccccttgggctctgacatttcatgaaccggtaacacccctcccactcagcatgcacctggatgcccaaggcgggtgtctgggagaaaggtctgctcccacagtgaagaggccagggtggcctccagcctagctggggggcagggtcctcagtgcagagggctgagtgggctcttgttcagacgggtggtcagggagaggatgggtcagagacagtgagcacagagggaggggttcaggtgccttgagtggcacctcatggaaagaagccctgctggggtctggagagggggtttctggggctccctgggtttggctggctgtatcccagaaactcccactcgaggttctggcctctgcaggcctggggcccgttccttgtgggcttagactaggaatgggctagactgtcagggaccccaggggctaccccaaggccagctgtgacctcagggtgcccaagcttcctcctttccttggttttcagggtctggttggtaggatggcttgggtatgtatccctggtctgcgaaggatgaccccatttaaagccttttcttctcaaatgccgtcagatgggagctgtttgagggcaggaaagcccagttcctttaacccttgtgtcggtgcctgcacagagccgggcaccccagcacatctgtgtttgtggctctgaattcatttatctgtgccagtctcctgctccccagatgccccaacagacccttgccaaaggtgggagccctggggggcacctgccggatcaggcgggtgggctgcgttcactgctttagtctgcccacccctgggcctctggcctggaagggcgaagccactggctttgtgagggggcttgtctgcttgggtcatttctgcctctgatgccttcatttagcaaagctttattgaatctgctgggccccaagggaaggcagcgtgactcagaagcagcccttgttctcgggaagccacagtcccactggggagtgagccaggtgcccccaggcagaggccgcaagagccaggagaggggtctccctgctgtggaatcaaatttcatggtgaaggtgatgtcagattgggcctggtgggatgagggtttatacatatgcacatccaggggagaggacgtggaaagcaggaggaaggatcagcccctctgagcacccatggggtgcaagaccacacacagctacctagctggttccccaacactagaggaagctgcggctcagcgagcgaggccaagtgcctggcccaaagtcactaagcatgtaagtggcagacgagcatttgagcctaggtcttcctgtctccaaagagtagttctccccctggggcagggaagaatccagaatcctggaatgtcaggattggaaaggacacaaaggtcacctggaccaaccaatgctcaaacgaccccacagcctcccagtcctgctcacacacgtggatacaaggcgctcactacctttgtcgaaccaagaggtgtctgatacaggctgattgacacctttaaaagtagctttttttcctgatcagagtaatacctgccaattattggaaagtataaaaatcacatgtgatggttgcacggtaggaatgtacttaacaccactgaaatggtgaagatggtaaattgtatgttacgtgtgttttaccacaacagaaaaagtttggtggggggtggtaatcatgtgataccaccacttagggagggctgcagtgaatagggtgctgtctccttctggtcttttcgaaactgtgtggcgtgctgagccatttaaacacatcaggagctgcgggggatgcagctggcgcctgctcttggccctcacaccacagggcagagcaagtgaagctgagctccaggaccagggtgacccgtttatcctggtgtgctggaacttcctgcctttagcattctgagaggcccttagtccagacaaacagggacaatttgtcaccctgtccaggactcctggacaacccagacccctaccacagccctggaggggccctaacagcatgtgcacatgaacctgtgattgttttttttctttttttgagatggagtcttgctctgttgcccaggctggagtacaatggtgccatctcggctcattgcaacctccgcctcccaggttcaagcaactctactgcctcggcctcccaagtagctgggactacaggcacacaccaccacgcccagctaatttttgtatttttagtagagatggggtttcaccatgttagccaggctggtctcgaactcctgacctcaggtgatccacctgccttggcctcccaacgtgctgggattacaggcgtgagccaccgcacccggcctggacctgggatttttgtaaaatttgtaaaagaaagatttttttttctgttgcttttccaaaagagggcccccaaatcatgtaagcttcagggcctcaccaacctggacccaccctggaacccaagccctctgagcccctgggtcagcctgcacagaagcagggcctccaagacctggcttgtctcttttttatttttttagagacaggatcttgctgtgttgcccaggctggtctcagactcctggactcaagtgatcctcccacctcagccttgtgagcagctgggacgatgaggcgaggcgtgggccactgcatccggcatggcttgtctcttgactaaggctttctcacctcttggtgtcatcgccccagtggcagatcagctgccactcctggcacccccaggccacagctgtgaccttcagtaagtgtcccctccccaccctctgtgcctcagtcttcccacccgaactgggctgggctgggtcagaagtgcctgatctgttgcgcggtgactgccgcctgtcagtgactcatttctttgttctaaagccagatgggaaaaaaaggagttacagcaagaagctaaactgatttaatagaaaggaccaccttttatttggagtttatattcttttttgcagggggctaagatggactatagggaatgaatatcagtgctggcagatgagttttttgtttgtttgttttttgtttttgagatggagtctcgctctgtctccaggctagagtgcagtggcgcgatcttggctcactgcaacctctgcctcctggtttcaagtgattctcctgcctcagcctcccaaatagctgggattacaggcacccaccaccatgcccagctactttttaaatttttagtagagacggggtttcaccatcttggccaggctggtctcaaactcctgacctagtgatccacccgcctcagcctcccaaagtgctgggattacaggtgtgagccaccgtgcccagtcaatgtttctttaattctctactttgacaaaatgaaaatgataaaatgtttgaaatgttgccattttcagggttcattttttaagggctttggccataataccacatggttctgtaagtggggtgggtatcttccccccgttttacaaatgacagaattaaggctcagcctggagaagtgacttgtgctagctcaaggcctgggcttgtcagagacttggtttgaacccggactgctgggctccacattctgtgtactccctgtgggttctctgcctggatatccatggcaccaaggggtggcctgaggggggcagcttcatacccctggttttattcaccccctccactccaccccccatcatcccaagtgaacactgaataaaaaagctgaacttggccaggtgaggtggctcacgcctataatcccagcactttgggaggccaaggcgggtggatcacttgaggtcaggagttcgagaccatcctggccaacatggtgaaaccccatctctactaaaatacaaaaattagctgagcgtggtggcggtcgcctgttatcccagctactcaggaggctgaggcaggagaatcgcttgaacccgggaggcggaggttgcagttagctgagatcacaccactgcactccagcctgggcaacaaaagcaaaactctgtctcaaataaaaaaaaaaaaaagctgaacgttttttgtaaacacagcagtttcaagataagaccccttgcctcccccaaccaacttgccatgtgccagccatggggccacaggaaaattctgggaccagcggttgttggggaagagggtccagggtagagacagaacctctggccagttctgatgttcatttgttcattccacaagtcccctgctcagtgccagctgagtgctcagtgccaccccaaggcactctcgctccaataacgagaacaggattgagtgggaagcactgtcccagaggctcgggtcactacaagaaggaattcccaaggggtggcccaggagaggcttggatgacagactcacaagctggacttcctctgagggcagtgggaagctggagagagggtcaagggtatttcggaagctcctgtggaagcttggtttggagagggctctgtggctggaaatgcgtggtcacgtccagcctgtcctctcccagtaccgggcacagccctgtcacctagacaggaaggtgggcccacggcccttgtttgttatttattgctgaccaccctggagtctttctcacctcttcacctcctgtggccggccgctccgccgcttcttctctctcaggtctaggacagggtcagctgcaaggagaccgctgggaggtgatagatttctgctgtgttttgggcacttcctcatgtccagggacagcccaggggcggcctcaagagcctgagaaagcctagggcatcaggagcagggccatcagagcgggaccttggaaaacccctacctctttcagccttggttgcctcatctgtaacatgggattggagggcctgggtttggggaggcctcgagagtttataaaaatgcaaattttggccaggtgtggaggctcatgcctgtaagcccaacactttgggaggcagaggcaggtggatcacctgaggtcaggagttcgagaccagcctggccaacatagcgaaaccctatctctactaaaattacaaaaaattagccaggcgtggtggcacgcgtctgtagtcccagctacttgggaggctgaggcatgagtatcgcttaagcccgagaggtggaggttgcagtgagccgagattgcgccatcgcactccagcctgggctaaaagagtgaaactccatttcaaaaaaagaaaagaaaaagaaagaaaggaaaagaaaatgcaagttatttttgtttgtttgtttttgagacagggtctcgctctgtcacccaagttggaatgcagtggcacgatctcagctcactgcagcctccaccttccaaattcaagcgattctcctgcctcagactcctgagtagatgtccgccaccacacccggctaatttttatatttttagtagagacagggtttcatcatgttggccaggctggtctcaaactcctgacctcaagtgatccgcctgccccggcctcccaaagtgctgggattacaggtgtgagccatcttgcctggcctgaatgcaagtttaaaaggcctgccgtaagtctgctgtggtgcgttttgttatcccctccttagatgaaaagctgaggcccagagaggttaactggagtcactgggatcggaacccatggcccctgctccagggagtccccagccatgtggggagtcccacatgagcagcgtgtgcaaagctgttgggcgggcctgagccccagggagaaaaaacagaggctgggagaggaagggaagagaggaggagaagccaggaggaggagggagggaggaagggagaggcagatggcagggctgttggagggagccacacttggcacccagaccggaagaaccagctgtcaggtgggaggggaggcagggtaggcgcagaggagtgccttggcctggagacctgaggctgcgttctgcaccctctctgccagtgattggctgtgtgactggagcaagaggcccatgctctcctggccttggtttccccatctatcaaatgggaaaaggatagttggattgctctggtggatcccgacctttccacccttgaagaaccccactcttgctcctagtggactccaggttgggaactttggattggtcagtctttaaagaagtgatgttggggccaggcgcgatggctcacacttgtaatcccagcactttgggaggccaaggtggttgactcacttgaggtcaggagtttgagaccagcctgaccaacatggtgaaaccctgcctttactaaaaatacacaaattagccgggtgtggtggtgcctaggattatgcttgtaatcccagctactccagaggctgaggcacgagaatcgcctgaacccaggaggcggaggttgcagtgagccaagatcccaccactgcattccagccaggcaacagagcaagactctgtttcaaaaaaaaaaaaagtgatgtttggagccatcccctcatgctttgtaggagcctgcagcagagggggcactgggccccaggtctatgcatgggagtgagaggtgacagcatgctgtcctcacagccctcacttgctctcggctcctcctctgcctgggctcctactttggcggcatttgaggagcccttcagcccaccactgcactgtgggagcccctttctgggctggccaaggctagagcccactccctcagcttgcagggaggtgtggagggagaggcgcgagcgggaaccggggctgcgtgcggcgcttgcgggccagctggagttccgggtgggcgtgggcttggcgggccccgccctcggagcagccggccagccctgctggccccggacccgggcgtgggcttggcgggccccgccctcggagcagccggccagccctgctggccccgggcaatgagggacttagcgcccgggccagcggctgcggagggtgtactgggtccctcagcagtgcaagcccaccggcgctgcgctcgatttctcactgagccttagctgccttccctcggggcagggctcgggacctgcagcccgccatgcctaagcctcccacccactccatgggctcctgtgcggcccgagcctccccgatgagcaccaccccctgctccacggcgcctagtcccatcgaccacccaagggctgaggagtgcgagcgcacggcgcgggagtggcaggcagctccacctgcagccccggtgcgggatccactaggtgaagccagctgggctcctgagtctggtggggacgtggagagtctttatgtctagctcagggattgtaaatacaccaatcagcaccctgtgtttagctcaaggtttgtgagtgcaccaatcgacactctgtatctagctgctctggtggggccttggagaacctgtgtgtccaaactctgtatctaactaatctgatggggacgtggagaacctttgtatctagctcagggattgtaaacgcaccaatcagcgccctgtcaaaacaggccactcggctctaccaatcagcaggatgtgggtggggccagataagagaataaaagcaggctgcccgagcttgcattggcaacctgctcagttccaaagctttgttcgtctgctcgttgcgataaattttgctactgctcactctttgggtccacactacttttatgagctgtaacactcaccgcgaaggtctgcagcttcattcctgaagccagcgagaccacgagcccaccgggaggaacgaacaactccagacgcgcggcattaagagctgtaacactcaccgcgaaggtctgtagcttcactcctgagccagcaagaccacgaacccaccagaaggatgaaactccggacacatccgaacatcagaaggaacgaactccagacgcaccaccttaagagctgtaacactcaccgagagggtccgcggcttcattcttgaagtcagtgagaccaagaacccaccaattccggacacaagagcagagcagacggcatcagctggagcctggaagggcagtcatgccctgtgtttctgggacaaacgtcccttcacagatagagttttgctcatctccccgctgctggtggagcaggggccaggtgaaggggacctggagagaggggcggctgcgtagctgggacagccccaagctgtcaaacccaagctgcaatcatgcaggagctttaacaagttggggctcctccagtacctcacagtgcagggggcaagagtccctgagccttcagcccctcccagaatgtccctgacaccttttgtaaattgcactgtaacctggcctgccccagaccttgcttcctgcagcctgttcagtgggggctgctttatccctcagaccctccctctgctgggtgtagaggtcgacagggtccttctggttcctgaggccacttacaggacattgtcccccagctttgaatctcacaccagcactgggtcgcccactccccttcatgatgagccagctcgaggccactttgcccgttcttcaaagatgcccccccaggccgggcacggtggctcacgcctgtaatcctagcattttgggaggccaaggcaggcggatcacaaggtcaggagatcaagaccatcctggctgagacagtgaaaccccgtctctactaaaaaaaaaaaaaatacaaaaaaattagccgggtgtggtggcgggggcctgtagtcccagctacccgggaggctgaggcaggagaatggcgtgaacctgggaggcggagcttgcagtaagccaagatcgcgccaccgcactccagcctgggcaacaaagtgagactctgtctcaaaaaaaaaaaaaaaaaaaaaaaaaaaagatgcccaccctagcttggtgtcagtcctctccagcactgctcctgctccagtcctggtcattggagtgtctatttctgtgaccctttccacacctggcctcctcttcccgcatggtcttgtccgccagcctcagccaactgtcaccagctggaccctagctaggcctggccctgccttcccagtagcctctcgcactccctgatcctccatccaggcgtctcctccaaccctcctacctttccatctccctctccctcccctgatcctagatccttgggcctggggcctctgaaccactgatcttcccctgtgcactggccctcaccaccccttggtccctcctgtctccctccgcacctcccagtggccacgtgttgcagctccagcccttctgcgcatcacactcgcctggcacagctctggttaaattcagtcctaggcatcttcacacctgcccccctcatcctagactatctcccctgttctggtggcccaggccagcctggctgcagcctcgtgagcctgttcctctcacctactcaaggacacacgtccatcagttctctctccctctctctcctccaccctcagtttcgccctctctactcttggctcttctgcgtcagcttgcaaatgtgcgtgattccccatctcaggaagacactccctcatccatttctctggtccttcagaagagttgtcaccgtctccagggtttcttctgcggtctcccacacgcactccccacgggctctctcgcccctcctcgccatcttctcaggctcattcctgaccttcacattgccaatctcatggccaactgtcattgatggatctctcagcagcgtctggcagccgtgaggggtttatgcatcctcccttgaatccaaacggctgcagaatgtggacgccctcaccccgctcgccgcagaatgtggacaccctcaccccgctcgtcctctctttaatatacatgctgagcacgggccggatgaggtgcctggtctgtagggagggctgacagtctagtggagggaaatgtggtggaaaccagttaaaatatggaggtgagcacagacccctagagagggacaggcaggtgacaccagcgttgagtcagcgttgagagggcaggagccagccaggcagagaagggggaaggaggaacagcgagggcaaatgctgaaaggcctggcagagcagagacgaggctgtcgcccctgctggggtgtacgcttggagggcgagaactgcatctgtcatagccccaggactagattgcttccaggcatctccttagggccccaactatggatggacgtggcgggaactgcactgatcggtcgtccttctagccacggttcttcaggtgtcccatctggcctttagggccctgctcaaatatcacctccctgtgaagccttcctggattctcccaagcttgcgctcccctccctgcttcccttgggctctgtggggatgactgacagagttctcaaaacagggagctttccccttctgtgcctttcttctctagaaggtgaggcagggcctgggaccagattatttccctgatgacctggaatttgcacagcaggagagaaaccaaacaacctcaggcatgcagggactggcagggcgggggcaggcactggggtgaggaaaagcagacagaactggatggttaaccctgcccttttttttttttttttttttgagacaaagtcttactctgtcacctaggttggagtacagtagcacgatcccaactcactgcaacctccacaatcggggtcaaccgattctcctgcctcagcctcccaagtagctgagattacaggcatccaccaccatgcctggctaattttttttgtatttttagtagagatgggtctcaccatgttggccaggctggtctcaaactcctgacctcaagtcatccacccgcctctgcctcccaaagtgccgggattacagccatgagccatcacgcccggccaatcctgcccttcttatcaactgagagacctcacagaacctcagtggccgcatctataaaatgggtacaacagcgcctaccccaggagtctcggggcatgtaaatgaggtctagccctgaagggctctgcagtgtttggttggcatttacacccctttccaggtggtgatgttgctcccctctcccacctcttccctgcctctgaaagggcagaggtgataagacctggggtaaagaaggccctgggggggtacaggattatggggatggtggtccagatacttctgccactgagagtaaggccctgggccagtcaagtgagccctctctgggtctttgtttcctcctttctctcctttttttttttttgtagagacgaggcctcactatgttccccaggctggtctcaaactcctgggttcaagtgatcctcctgcctcggcctcctacatagctgggattacacccatgagccaccgtgcccggccaatttccccctttttcttgaggctccaaggcccccttgaggttactcagccagaggagaggaagatggggcattctggaaagagggaggggcctgcagatcacccaggcccagcctcagcaccttggggaggcaggggtctgctcgcccaggccctgcccagcggagtccactccacccccaccaccgagcactcggggcgacagcttgcggagattacgcctaatccccagtgggtcacttccaaggctgcacaacccggtgtgaggcggggtgggggaggggcctggagcctcacctgccccacccccaccttttccccagagtgagactcttcaggaagacaaggggctgcccaacacccatcatgtgtccatgcggcttcagccattttcctcacttgaccctgggggaagacaaggccctgttcctgtgaaggggggcccttggcagcctgactcatttctcaaagtgtgaccgctcccttcttccctcagcctttccccaggaggcaggatggatgcctgcaccaggacaagggcaggaaggctgggttcagcttgtggggagagggctcggcagcccccttttcagggagtgagctccctgtgcacaggggtgtgcaagcggaggtgccagccaaggacgctcaggaggggatgattctcctttctaccccccgtgctgcctggccctctctgactatcagacttgctgtctactcccctcaaagcctttcctgaccctctccctgggtctgggggagagacgtgcacccaacaactgaaccaacaaataggaaagaagttatattgtgatgttaccaagaaaattaattgaggcactggagaataccttagatctggagtctggtctggagggcttctctggggaggtgtcttttgtgttgagatgtgcgtgttgaggagccagctgaaggaagatctggagaaatacaggcatcccaggcagaggaaagagccgagtgtgaatgccctgaggcagggatgaactcaggagggcttgggaggagagtgttggggagcttcagaggaaggcaggagccctggcgtttggtgggggaaggtctttacctgggcagggggcggtgggtgagcatcaatccaagagtctagacctggggggtgacatgacctgacttgggtttaaggggattgtctggctgctatgaggggacagagtgtgggggtgcaagtggacatatgggctgctgtcattgcctggagaggggtgacagtggcctgccccagggtggagggacttgacagttttgggaggaggttgaagcagctggcccgaatgtcagactggttggaggggtcgagtatgaacccaggactggggcccagcagctggtgctggggaggctgagagagatcactggggaggctgagagagcctggggcactggaggaaggactcatggcccaagcagggggacctcagggccattctagggtgatggactttatcttcagccagcggagggattgttgaggtttggagtgggtgatatccccctggctgctgcctggggactgcctggaggaggctggagaggaggctgtggtggtgtcaggcacctggacatgggcaggggccagctgcctggctgcctgcaccgcagggcagggaccagggctcccccgagccacccagctcagggatgttcctgcgcagggcgaggtagacggttccatttggagctgggaggacagagtgccgtgggctccagatgtcatctctctgcagcttatctggggaaagccagcattgtctaaaaacgtttaaaacgaggcctctaggaggttcctggcagcgttacagtgatctcagccacccccatgctggctgggcacagctcgccctgagccttcgttagccgacgccctgcagtgggtcctaggcacaccctgggtggtctgtctgcagaggggagataccatctcccctcaagtaaagtgggcctgtgcccttttgcactgcgggacacggctcaggaccagcaggcatgcctccttggtctcatgttgaccttagagtttgggattctggaattcgatccttcatggataggcagctggacacagaggtcgtgggtgagctggaggagcaggcccggatgtgaggcaggttccccatctgctgtgggtcagcgagaggcagggcctctctgagccttagcctccctgactgtgaaatgctctaagtataagactgctttgtggggatgatttgcagatttttatggggattaaaatagatgatttaggtgccttcttccattggcaccagctcctgggaggctgtgggctggttcagggtctcagagtggggacagacttgtaaataggtcccagccaggagtgaccaaggctcagggtgggaaagagtgactgggaagtgggttgtccctgaaggtgtctgggagtcactatatcccagcagcgttcagagggcaaagaggagttcgctcccattgaagatgaagaaggtaggaaggcaggtgcagagttgtcagacagcctgaggacaccacccactctcagccctctgtggtggctgcatagggtggggagggggacagatgagatcagggtaggccacaaagggcttggtgcttctggggtctctgtttctatgtgtctctgaatccagtagccaaggatcctgaaatccaagattctgagattccttctgatttgtttttctgagtttgacatagatctccaccaagcgccatctggaatccgtttttaaaaaagactcgggattggattttaaagagggcggaaaaaaaccaaagaggcttggcaggtttaccttgatgcctttttttagcgtttgctttagctcgagggaagcttgttttccctctgcttgctggtgacctgggtcctcccttggccatcaccctccatcctcccctgtttctgggcctctggctctgcctctgaagacctgtctcccttccccacagcagatccgcttgttggatgaattttccccagtgtctcggctgctgtggccagtgtggaatttcattctggtttcatttccggttctccagtgtctccttgtggctgctctgtgtgccccttgctgtccctgcagatctggccttagcaagtgactcagggatgctgcctggcacagggcaccagctttggatccagagagactcaggttcaagcctcaactccactcctgcccagctgcgagacctgtgcaggtccctagaagcggctctgaaatgggaataagaatattgagctggtggagtgaagagcatacatttctgggcacacagcaggccctgggcaagtctctgctcctcctcccatgtactgtgagtggctgaggggcagaaacctgaggcttgtgtcgtgctttgggggagctcccactcagggtggggtacagctgctaaatggagaagttaaacccttgacacagagggcagctgacagccctgcagggggttcaggagactgtaagggactgcttctgtatcctcagtgatgttccttcccttccctgagcctcagtttccccacttgtggaccagcaggctgcaagggatgtggcatttgcaggcgacggctctgctccccattatcatcattgagcctaaaccccacgacttcctcccccatctgctctttttcttttttttttctttttcacacctggctaatttttgtatttttaatagagacaggatttcatcatgttggtcaggctggtctcaagcaatctgcccaccttagcctcccaaagtgttgggattacaggcgtgagccaccgcgctcagccccttctttttttttttttttttttttttttttgagacagggtctccctctgtcccccaggctggagtatagtggtgcaatcagagctcactgcaaccttcacctcctgggctcaagcaatcctctggcctcagcctctgcctggctaatttttgtatttttagtagagatggggtttcaccatgttgcctaggctggtctcaaacccctgggctcacccaggagtgatcactcaccctcaagtgatccacctacctcggcctcccaaagtgctgggatcacaggcgtgagccaccatccccagcttcttcactcttcctctcactccctacgtcggctgtgtctgcagattctggtggctctactttcaaaatatattcaggccgggcatagtggctcacgcttgtaatcccagcactttgggaggccaaggcgggcggattgcctgaggtcaggagttcgagaccaacctggccaacatggtgaaaccccatctctactaaaaatataaaacttagccaggtgcaggagcgcacggctataatcccagctactcaggaggctgaggcaggagaatcacttgaacccgggaggcggaagttgcagtgagctgagattgcgcccctgcactccagtccgggcaacagagcgagactccatctcaaaaatatatatatatattcagcacccaccacttctccccatctccactgcctgcaccagccccaggcctgtccctcacttgggtgctgtcgtagctcctgtctgggctgcttgcattcacctttgccaccacagtcttttctctccatagcagccggtctgattcttctcaaacctaagtcgcatcaagtcactcagctgctcttcagcctgcagtgtctcctgaactcaccctggccctcaaggccaacccatcttcctcgccagcctcgcctcttggtgtctccctcacttgctcggctcctatcgtgcgggcctccatgccgctcctgaacacacacagcttctttgcacccaaggccttggcacctgtggctgcttcttccctgggctcgggtccctcactgagtcagacttctgctcaaaggtcgctgcatcagaggcctccctgggcccccagtccgcctcctcttgccctgcttcgttcttcatgacacttgtctccctcggtaagaacaggaacctcatacatcctgttcccaactgtgtcctcagcctcttgcacagggctggtacatactaggtgctcaggaaatgttgagtgaacgaacggctgatgtcaagccccagaagaggcctcccaggccccagggcagggcaggcagctcactcactccactccagcaaacaaacagcaaagtaggttgtagctcagcctgtagcaggcggtagggacagtcagtcttccagggaggaaaacatggaaaggggcctggggcgtgcaaaggtggggaggcaggtggtagggggagtggaaggaggtgagaccccaggagcggtgggcggggccagcacatgaagggccttgaccccagccttagaagcttgggttgtagaccgcgcgaggtggctcacgcctgtaaccccagcactttgggaggccgaggcgggcaaatcacctgagatcaggagttcaagaccagcctggccaacatggcacaaccccgtctctgctaaaaatacaaaaattagctgggtttggtggcacacgcctgtaatcccagctacttgggaggctgaggcaggagaaaggcttgaacccaagaggcaaaggttgcagtgagccgaggtcacaccactgcactccagcctgggcaacagagcgagaccctgtctcaaaaaaaaaaaaaaaaaaaacaaagtccccaccacagcagctcaccaggccttgtcccgctgcatgtcccatgtacttagttcccgggtcactgctccagccatattccttcccacctcatcgtacaaaaccttttcctgccttcagcctttgcactttctgttcctgtgcctggaacatacttcccccagatctttgcaggcctggctcattcttgtctccaatcggaggccctgcttcagggcccttttccctggccatcactgctccctcctggcgtttgccagggaccgccattgcctttgtgatctgttccatgagtttagtggcagtctagccttctggggctccttactccaggccacgtgcccttccttgcatgcatgacctcactgattcctcacaatgcatccttggtttcggtgctattgttgcccccacttgacagatgcagaaactgaggctcaagaggttaagtcagtggccttaggtcaccccactggtccaagtggccacactgggattcagtgggcccaggtcatctgactcagtcttgctccccacacaatcggctcccacagcagggtctcttggactgaattaccgcctggtgcccctcccagcgcagtgccaggagctgagaaacttgtgacctgtgatgaatgcctgaccgaggcgggtgtctgctggggccatacggccccgcccagtccctccgaagctattctgttcttgctctgcaccctcttggggacacatcctctccagcactttcctcctggcttctctgaggactgcctgcctctgtctcccaagagagcccagtcttaatggttcctcctctgctgtccccagggcccaggcttctgcctgcctgtttcccctcccacctcctctctgtcttcagggagcctgatattgttctgtttttggaaggagatccacacttattttcagcgctggcagcagtggggtctcctccagcccccggaagcatgtgtctgttagtaagtgttcgagaggggccttcctggtgttattcctcttttctggggccttgagagaggaaatgaacgttatgcagcccctatggggcttccaaagctctgctctgggtacttgctctaattctcccatctgccccagaggggatgttaatttttacagaggaccaatctgaggctcggagaggttaagtcacttgcctgaggctacccagcataagcagcaggccttggatttgaattggcgggtctgtatgattcctcagtgtctgaagtctctttctgatcaggagccttttctgttctggtttggtggcatctggtgacatccaggactgggcctcaggttcccaacctgacagttttctggtaggagccttggacttgttgcagtacaccagtgcaaggggttgtgtgactagcagtccctggagttgtgcagtccacggcccaagcagctggccgtgtactgcacatctcccagtgttcagagtctgccttgcttgtcttggtttgtcagtagctcaggagcccctttgacaatggctctgtcctgacttcacaggcgctccccactgtgcctctgagcaccagacttgagactgaatcgagtcgcctgatccccagtcacactgaagctaccctcccggccttcctccctgctggtcctctgcctgatcccttgggtctctgggagtaaattccatcccttcttcagggcccacctccagaggctgagagtcagcttggccaggtggaaaagaacacaggtctgggaatcaggagacctgggttcaacttcagcctgtgctgctgacaacagtgccaccttctctttctgagccttagtttttctactctgccaattgggaacactacaaatagccctctccactctaggggtgatggtgaggctgcagagcctgtgggaggcagagctgtgggccccgatgccctcacgggtctgaagtctcatggtcatggggttttcccaaatcaggactggcaaatggtggctcacgggccaccactgcccacctctgtgcccatggctgaaccatgggctgaacacagcttcagaatcctttcttttttttactgtggccagattagcctaacataccattttaatgttgtataattcagtgtacatttttttcttttttataatttgtaatttatttattgtagagatggggttttgctgtgttgcccaggctggtctcaaactcccaggctcaagcaatcctcccacctcagtcccccaagtagctgggaccacaggtgcatgccaccatactcagctaatttttgttttgttttgttttgagacggatctctgtcgcccaggctggagtgcagtggcgaatctcggctcactgcaacctctacctcccaggttcaagcaattctcctgcctcagcctcctgagtagctgggaccacaggcacgtgccaccacgcccagctaattttctttatttttagtggagatggggtttcaccgtgttagccaggatggtctcaatctcctgacctcatgatccacccgcctcggcctcccaaagtactgggattacaggtgtgagccaccgcgcctggcctatacccagctaattttggtattttttgtagagatgcggttttacaatgttgcccacgctggttgttcctttttatggctgaaaaattgtccaatttatgaatgtaccacactttgtgtccccattcatctgctgtgcacatttaggtcagaatcccccttaacacacaacatcctaacccagaggtctctaaccatttttttttttttttgagacaatgtcccgctctgtcggctggagtgcagtgacacaatctcagctcacggcaacctccacctcccaggttcaagccattctcctgtcacaggcttccgagtagctgggattacagttgtgtgccaccacgcccagctaattttttgtatttttagtatagagacagggtttcaccgtgttggccaggctagtctcgaactcctgacctcaagtgatctacccatcttggtctcccaaagtgctgggattacaggcatgaaccaccgcacctggccggtctctaaacttttaatcgtgctcctttcaggaaaaatgtttgcaccaatcctcccattcaatgtagatttattggtttcatatatgctactactgtactaatatatcctgtgcattataaaatccatgtaaactatagacatcttacagagataagataatattaagaatgcttctcatatttttcacatacctgtcctggaatcattacccatcctgggcatcacccaggaagaaaatatgctcaactcacattgaaattgtagtttctgaggccgggcgtggtggctgactcctataatcccagcactttgggaggccgaggtgggcagatcacctgaggtcgggagtttgagaccagcctgaccaacatggaggaaccccatctatactaaaaatacaaaattagccggatgtggtggcgcatgcctgtaatcccagctactcgggaggctgaggcaggagaatcgcttgaacccaggaggcagaggttgtggtggactgagattgcaccattgcactccagcctgggcaacaagagcgaaagtccatctcaaaaaaaaaaaaaaaagaaattatagtttctggccgggcatggtggctcacgcccgtaatcccagcactttgggaggcttggggctggtggatcactggaggttaggagtttgaaaccagcctgacaaacatgacgaaactccatctctactaaaaatacaaaaaattaaccaggtatcgtggcaaacgcctatagtcccggctactcaggaggctgaggctggtcttgaactcctggactcaagtgatcctcctttctcagcctcctaaagtgctgggattacacacgtgagacaccatgcccagccaaaaagcgtgaactttagagtcaggtaccctgggtttgaagccaggttctgtcactgaccagttgtgtgactttgggtgtgttaacaatagctgagccttaactgtcttatctgcaaaatgctgatggtgcaggatgtattggcaagctattgctgcacaacaaattgccctacaacataaggcttataacaagaaatatttgttatctgacagtttctgtgggtgaggaatctgctaagcttggtgccactgcctcagggtctctcacaaggctataatcacagcatcaggtagggctgtggtttcatctgaaggctcaactgagggtagatccattctttttttttttttttttttttttttgagacggagtctcactctgttgcctaagctggagtgcagtggggttgatcttggcacactgcaacctccacctcctgggttcaagcgattctcctgcttcagcctccaaagtagctgggaccacaggcacgtgccaccacacccagctaatgttttgtatttttagtagagacaggatttcaccatgttaaccaggatggtcttgatctcctgacctcgtgatttgctcacctcagcctcccaaagtgctgggattataggcatgagccaccatgcaccacgcccagctcttttttttttttttttttttttttttttttgagacggagtttctctctgtcacccaggctggaatgcaatagcacaatctcggctcactgcaacctccgcccaggcccagcaaacagttctcctgggctcaagcaattctcctgcctcagcctcccaagttgctggatgacaggcatgtgctaccacacctggctactttttgtatttttagtagagacagggtttctccatgttggctaggctggtcccgaactcctgacctcaggtgatccacccacctcggcctcccaaagtgctgggattacaggcgtgagccactgtgcctggcctgggtggatccattcttaagctcactgacatggtattggcaggattcaattacttgtgggtgttggactgaggggctcagttccctgtgggcagttggctaaagaccctcagttccttgccatgcagtctttccaaagggtagtccaaaacacaacagctttcatcagagcaaccagggagtgggggagaagaggacgagcaagatggaggcagaaatcctttgtcacttactcccagaagtgatatcccatcacttcttgccatatcctgtagtggggtcagtgagatagcatgtgtaatatacccttgggatcatgcagggtgccctgtatctggcaggattgtgtctattgttattttctatttaatacacacacacacacacacacacacacacatagatagatttttttttttttgagagtgtcttgctctgttgcccaggctagagtgcagtggcttaatcttggctcactgcaacctccacctcccaggttcaagtgattctcctgcctcagcctcccgagtagctgggattacaggcatccgccaccatgcccagctaatttttgtattttagtaaagacggggtttcaccatgttggccaggctggtctcaaactcctgacctcgtgatccacccgcctctgcctcccaaagtgctgggattacaggcgtgagcgaccacgcctggcccgagagttttttgttttgctttgttttgtttttttgagacagagcctctctctgtcacccaggctggagtgcagtggcatgatcacggttcactacaacctccacctcctgggctcaagagatcctccccctcatcttccctggtacctgagactacaggcacgcaccaccatacctgggtaatttttttattttttagtaggggcggggttttgccatgttgcccaggctggtctccaactgctgagctcaagtgatcctcctaccttggcctcccaaagtgctgggattacaggcatgagccaccacccccagcccactgttattttttcattcatcactccatctacttgccaggcctgggtaggggcctgagaccccagaccagcccacagctctgcagagggaaggagaacacaagatggggcccggcacatgccagcatctggaggagtcagcctgggggtgggggctgggcaggtccacagcccaggagggcctgtggctccttgttctttgagagtcggtccagtcccaggatatcttggtgtcagggcccaggaagacctttaggacctggctgaggggtgttggaaggggccacatctatggtcagagagtcctcagtgcctgtggctgaggaaggaagtgattgacccccacctggtgctatgtgacccacataagttaccctccctctctggggatccccctctgaaatgcctgcttaacccgggtcttgtagctcacggagggccaggcagcaggcgagggtggcagcctccccgtcccctgggtggtgtgaggcaggggtctgcccaggtctaaggtgtggccccacccccgacagctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcgggtgagccccacccagcaggtaccccctgcacagagtctacagagggctgtcccggccataggaggcggctgccacccttcttcccatgtttcagatgaggaaatgaggtgcaggcgggtgaagggatggactcagggtcacatggctggcagcaggaaggatgggaccaggacagggcctgggaccccaaaataacccatgctgcccacaggcaggggagcgtggatgggattctagttccttctagtctaagggacccatggatggcactgggcatgtgccagcccccatgggttggcccgtgtttcagtggcctcttctgtgccacctccctggggcagcctcatgaggactaagcaaggcggtgactgggtgcccagtgcacagcaggggccctggagcctcagcctccccacgcctcccagccagaccttggcaggaccagggcctggacctgtggagccaacctgacctgctgccctttgcccttcagaagcagcctttggcagaggcaccctgacctctgctccgtgacttccaggaatctgattggtggatgctctcagtcaggggtccgaacccgaggcttcagcctcgctgttctgaggcttgggtccccggactgggaccaacccctagttctaagcctggagctctcaggataagccaggctgaaggcaggtcatgaggtctagttttagaaggaactagaactaaatgaatggttctcaaacttccacagagcctcagggttccctggcagtgcctctgggaggtgggctgggccccaggtgggcaccccacctgcttggcagatgcacgccttgtcctgagcaggtctgggcttctctggggagaccttggcactcacaggagattgcgtggctatgaggctcccactgctgacgcccccaggctcggctctcagtgggcccctcgctaaacctggggctctgtggggtcgcagcacgttagaagtcgaagcccagacccacccagccaagctgccatccttgccccagcctcgtcctccttcccatacctcatttgtctggcagcctgagggttggggtcttcctgcctgcagagttgcaggcatcaggggtggaccgggggggcccacgtcagcggtgtggctggacatgggggtttggcagaggctgcagaaatgcggcctgagttgattaccttctttctctgtctctccctccatcctcccctctcactgcccgtggctctcctctgactggccctgaccctgccctgtctgtggcctcctcccccctgcatctggctggcttccctcttctcgcctgcatcttctcttggctcccctctctcttcccctaccccctttgcctgtccctttgggggtgggggagcatgggagatgcactcttgaatgtccctctgttcctcggcttccccattttctccccactcaccctctcccccatgtgtggcactgcctattctgcccggtcctgggaccccccagccttctgggctttcctctggttcgtgggattctgctacctggccaaccagtggcaggtctccaagcccaaggacaacccactgaacgaagggacggacgcagcccgggccgccatcgccttctcctttttctccatcttcacctgggtgagtacagccaccgcgcaccagcccacactcgtcccctttccccactgagcccctggatgggtggcctttcgctagcctgggacccgctctgcctctgggagcccacactaccctcgctccctcttctgcctgcctgtctgcggcgctcacagtggtgctgcctccctcagcaaggaggctacagccctcgggggtagcatggtcactggagatggcagaccctcactgtggtgcagagcagccttcctgggggtcacggaccaccccccccccaaaccactctgggtaaatggtgtttattatcccctttcacagatgagaaagcagaggcctagacaggaaggtgaggcttacagggtttgaggctgggaagcagccctgcctaggagtcaggagacctgcttccgatcggggctgcctctgattttcctagcctctgtcttcccatccataaaatgagagggtaggatctgggggacacaggtgtcgacatcagatgcacatgggccaggcagggcctgagagccgtgagcaggccgggtgacacatgcgtgcctatcctaagtcctaagagggtacctctgctcggctgccaagcaggaatagggacctagagaaggcagaagtctgaatttttacatgaaatctgatcttgatatgttggaagtttattcaggtttaaacaatatattgtgtgtgtcaaacaaagtatgtctctgggcccagcaggccctgggctggcagctcggctggcccctctttcccactggtctgggtcatgtctgtttcttctctcctaatcacccttctgcagagatctggggccacatcacctccatagccccatcccaagagccctccccataacccacagctgcctcccctctggaccggcgagcacttctgggcccagcctcctgcaaggagactcttgaggctacatacaggccgccagccgtccctgtttcccccatccttctggtttgccccgggttgacgtctttttctttttgagggcccctggatatccatttttgaggggtacacccatctccccaacaatattagaagatagcatttggagggggagacccgtggttcaggccctagtgggccagccttggctgctccacccctcagtgtcctcaagactgggtaggaagaaccaggtgaccccaggggatctcagtccagagaaggtgccccagaagtggggaccacccagcctacagggaggagtttaggggcggggctcacagaggagtagtggatgatttctagccatgggtctgaagtacctgaccaacaggtgcctgcccggccccctgaagccagcctccctcctggcacctctgcagctcttccccactggcctcacccctactctctcctggcagagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtgataatggaccaacctctcaaggctgttgtgccaatgaaacaaaggccagcccagggcttagcacaagcatgctcaataaatgtaagctcttttgttcattcattcattcattcattcattcttctctccagagagtcaggggcacctccagaatctctactttaagagtaattctcatgtgatgaatccttgttcctccaaaggattttggtctctggttctacacaggtttcctgcttgaggcccccagctgcctgggcaggaactcacccattcctccactctctgctggagttgaggaggctggtggagcacagacagttcccccaaagcaatgcctcaaccctgcgagggcctgagcacatcgagagtgagcttcctggcactggaggcatcccagtgcagatgcagactgcctgctgcacgctggagatgctgcagagagagcacctacactgagaaagtggggccaggggaccaccaggtccctgggctctcagtagaactcccatcctccctctgcagcccaggccagcgggggcccaggcctctcctttgctcctgtcttgtggccccttaaactggttgcccaaatgaagctttgacttagtgagggcagagagctgaacacagagacagtatgagtgcctacagccagaggcatctccctagaaggatcagtaggggtcatctgctccagccctctgcctctgtacaggaaaccagcctggatagtagagccagggagctcggggagaaccgcgtctacagacattgctctcaaggttcattcagtcagttcctgtgggctggccagggctcaagtgtaccctcagggggctcttcacctcccctgcttcttcaggctccggcgtctgagcccccagcagccaggacctcatgctaacatagtgggaaaccccagagggctacaccttatcccttagcccaatttctttagacctagtctgcctttcccaaggtgctggcactttgctttaaatacccacctcccagaaagtgcttcccctcagaactttggtcaatgagtacaatcaaaaggtaatgccctagctgggcatggtggctcatgcctgtgatcccagcactttgggaggccaaggcaggcggatcacctgaggtcaggagtttgagaccagcctggccaacatggcaaaaccccgtctctactaaaaatacaaaaattagcttggtgtggtggcgggtacctgtaatcccagctacttgggaggctgaggcaggagaatcacttgaacccaggaggcagatgttgcagtgagccaaggttgtgtcattgcaccccatcctgggtgacagagcgagactctgtctcaaaaaaaaaaagaaaaaaaaaaaggaaatgcccagtcactgggtttctggaactttgtggaataaaacgctaggtatattcactctctacctcttcactaagtggctctttaggttgttggttgacttagtgcctcgtcaggggccagtgaaagggaaggaggtgagggcgccctgacctgggaaggggtaggaccccatgtttagggaagggttctagcagtaactctgccacgggcacttccttttctaggcctcaatcttcccagccctaaaacaggggtctggagagtatcagcacattcccatcacaggcagattccccgggccgggaaagtttctggagaaggcttttgcaataaacctctaagctgcttttctaatgacaagtttgatttacttaaactttgacttagctcagtgtggtcagtgtcattgtccttaataacaatgtaattgcttttattgaaaaataatttcctaaccatgcatgtgtgctgtagacaagtctttcccaatctgagatctgtgaaaaaaaaaaaaaaaacggggcggcttcaggctaggcgcggtcacattgaatagtcagggctctgccaagtcagatgatcctgaaacttgtttcactctatttaactcagtttctcacttagaattaggttcagcagcaggtgaccgaaatcccagataacagtgatttcaacaaagtccaaggctgtggaagtggtccagggctggcatactggctccagaggtcttcggtgacccaggcatctttccttttttttagagacagggtctcactctgttgcccaggctggatcatagctcactgcagcctcaaacccataggctcaggcaatcctcccacctcagcctcctgagtagctgggactacaggccagtaccactatgcccggctaatttggtttttgtggatttttttggtagagatggggtcttgctatgttgcccaagctggccttttttttttttttttttttttttgagacagtctcactttgttgcccaggctagagtgcagtggcgctgtctcagggtactgcaacctccgcctcctgggttcaagcgattctcctgcttgcacctcccgagtagctgggattacaggtgatgccaccatgcccagctaatttttttaattttcagtagagatggggtttcaccatgttggccaggctggtctcaaactcctgacctcaagtaatctgcccatcttggcctctcaaagtgctgggattgcaagcatgagttgtcgcgcctggcctctcctgctttcaagaagaagatcagattgttattgtgcctgctgtttttcaagtgcctttaactcaacatagtcaatatgccagaggtgcatattttagcccaggctggtcttgatctcctggcctcaagcaatccttccaccttggcctatcaaagttgtgggattacaggcatgagccgcggtgcatggcccccaggcatctttcattcctacagacttggctcatggtctttgtggtcccttttggcaattagagctccagccatcacatctgtgttccaggcatcaggtcagagggtgggacagagaacatgagggtaccccattggccaaaacgtagtcacatggccatgcctagctgcaagagagacaaaagaatgactcttaggagatgctaacagtcctttgtcccgctgagaagctttttttaagaaggctgttgtgagcctttgagccatcttaacactccataatggagatctagaacttttggtagcccagactgacctctgggattgggagacaggggcaggtgatttctggggtactttctggctggatgatatggttctgggcatttccgggggtggctgcgagaacagccttccttctccacagccaagcttggtctcatgtttggtgctttgaggatctttaaccctctcctgcctgtgtcctgtgaactaaccaccactaacccagtgctcttgtctgtctctcccctaaccaccccctcccgcctgtccttgtcctcgccggcctttgtccccaggcgggccaggctgtgctggccttccagcggtaccagattggcgccgactcggccctcttctcccaggactacatggaccccagccaggactccagcatgccttacgcgccctacgtggagcccactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcatacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcagggccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttcctcctcccctggggacagccccacctccgggtccctccacccacatccccctggtcctacccctggcccttggcctcctccaagagggctcaccccgggtgctgctctgtgctctgcgtgtcccacagacgcttgttccagggggctccagcaaaccccttcgtggtctctcaaaggactgatcactgtccttgcctctaggaggggtcactaagcccttacctagggctgggtggacaacaaggcacagatgagggtgtgactggcccgaggtcacggtgagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagagacactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagcacaagagagggcccaggaaaaaaggtttcacataagtgtagagtcgcaaggacgcttagagtcggcagagtctggggtagggagacagcgacttgtccaaggtcaagcacagagggagaggttcaggagtcaggtcttctgccttctgagttggctcatcctgggcagtcacagactgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcccccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaaccca

SEQ ID NO: 37428 - DNA, 4323 bp, Homo sapiens
ggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggtaaccgggccccagggcgggcaggcaggcggactcctaatctgggcgccccagcttgaagcgagagcaagggtgggaaggaatggatcaggagagttatgaagagggatgacccggagacccggagggacaggtcccctgctctttgacttacgtggccattctacccccaggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggtcagggcctcaggacacccttttctcagcccagaccccctccatccttcccttgctgccagcaaatgcagcatgaagtgggctctggctgcctggcttaaatcctgccttaaacaactgcctgtataaccatttctatttaccatctctaagccttgatttccttgcttgtaaaatgtacaatgtagataataatagcacttaactcacaggactgtaagaattaaatgaaaaagaggctgggcgcggtggctcacgcctgtaatcccagtactttgggaggccgaggctggcggatcacctgaggtcaggagttccagaccagcctgaccaaaatggagaaacaccgtctctactgaaaatataaaattagccgggcgtggtggcgcatgcctgtgatccaagctacttgggaggctgaggcaggagaattgcttgaaccagggaggtggaggttgcgctgagccgagatcgtgccattgcactccagcctgggcaacaagagcaaaactccatctcaagaaaaaaaaaaaagccaggcgcggtggctcacgcctgtaatcccagcactttgggaggctgaggcgggcggatcatgaggtcaggagatggagaccatcctggctaacacggtgaaacccggtctctactaaaaatacaaaaaattagctgggcgtggtggcgggcgcctattgtcgcagctactcgggaggctgaggcaggagaatggcgtgaacctgggaggcggagcttgcagtgagctgagatcgcgccactgcactccagcctgggcgacagagcgagactccgcctcaaaaaaaaaaaaaaaaaaaaagaattaaatgaaatcaactgtgtagagttcttagtgtaggacatagtacaaaagtatactgttatctcccagggcacccagtgcaaggctctttatctcatcccgcttgggtgtacctggttaccctcagtgaccctcattactgccagacgtatgttgtttacattacccctgcctactgttcctttccctcactaaggctgattctcaagagggaattcaagagagaatgccaatctaacactgttcttttctgtcctcgttggtcactcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcaggtaactgggggaaaagaatgttgggggatggaaggggtggttattcccattttcaccagtctccatgtcccctgcctgagacctcccaacctgactcctgaacactttgtatttctctttataatgcccactgccttctcttgaataatatttcctatttatcttctccccttcaagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaaca

SEQ ID NO: 37429 - DNA, 36652 bp, Homo sapiens; identical to SEQ ID NO: 36608

SEQ ID NO: 37430 - DNA, 9902 bp, Homo sapiens
gccgggcagccatggctgagacactcttctggactcctctcctcgtgggcaagttggggccttgttcagcggggaggcccaggatgagggggcaggatttaggggtggtaagacggaggtgtggagggcccacagaagagggatctgggttgggtgaggcaggcgccagaagggctttggggtgttaatgccatggccagctggggatccagggaatggggctgggagctgggctctgggatgaaggggctgggagctctgagggctggaggtgtcctagggcccgggtgggtctgacagcacaggcccaaagggtcgtgggccctttaatgagctggctgggccgcagcttctaagcccaggctaaatttggccctgggagggagggtggagctggcggccaggtcctctgctcctctcttggacttaggattccttttgctcagctcctactggcctctagggcaggccttcttcttccctgtattttaggggaggaaggtgggggtctccaggcccagaatggctacccttcctcctctgtaggctcctggccccgtcttcctctcctctgggctcttgggcatttagcatgggattcttttcccagtgcctttcacacatacacaccctcacacacacacacacccacacacaccctcacacacaccctcacggcaccctcacacacacaccctcacacacaccctcacacaccctcacacaccctcacacacacaccctcacacaccctcacacaccctcacacacacaccctcacacacaccgtcacacacacaccccacacaccgtcacacacaccccccacacacacccccacatacccccacatacccccacacaccccccgcaaacacacaccccccacacacaccttcacacacacacaccctcacacacaccctctcacacacactcacttgcacacacaccctcacacacatcctcacagaccctcacacataccttcacacacacacccccccacatcccctcacacacacacacaccctcacacacacacttcccagtcaaacatcagtccctgcccactgcaccattaataggggcctaaaacaaggaatggaaaggttgtgggagaggttctccctcgaatcccgaaacccagacgattaaaatgtctagcccagcagggcttgctcccccatccccaccccaatcccttcctgggaggcagcaaaggaagcgcttctctcggtcccttaggggctccaaggacttggtggggaagggagcttatcccctgcccaggactgaggctggcctgtgtgtttgggacttgtggggtccccacagttctcctggcagggctgggggacaccgaggcccagcagaccacgctacacccacttgtgggccgtgtctttgtgcacaccttggaccatgagacgtttctgagccttcctgagcatgtcggtgagcggcctgacaggcacccaggcgggcgggctggggtgtaccccgcagggctcctgctgtgactcgaatcccctctcctcgcttccaccagctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtgccgtcagggaccctgagaaaatcacaggggtgggccagagtggcctcctaggagcagccctatgaattgggattgggtgctcattcacagtcatttacatataatttacatacctctaatttggtatctgagtcctctcctgccaggcccccgctgtgccacgtttctcccctaacccacttctcagatgtctttcccatcccccaggtcacagcctacaatcgggacagctttgataccactcggcagaggctggtgctggagattggggacccagaaggtacctctagctgtgccccatcccttccccaccaatgccagtcttggggaatctctcccggagggggagggggctgtggacaggagaggcttggagaggagtggagcagggcatcctggaaagtggggacaaggctctcagggaatgggtgctgggctgggattccaggctctggagttctgttactcgctgcgttgcagagactattgggacttggcttgttggggtctgtgatggatggggcattgaggggcctgaaggggtgtgcagggatgtggggaggagcttcaaggaggctttgcggggcagagctggggctgggtgcagcctgaggtgtccacctggccttcccaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggtaggtgtgcaaccctagaggacttcctgaaagaggaggatgcagcttgtggcgggcatagaacaagggtctccctaatttccaggtggggctttaccacgcacatctccacctcccagcttcacacccctcaccactctcctctggctatacccgcatctccttgtccttccagagcctagaccctagttaccctgaactctgtacttcctggtgcctcatgaggacgtaccagatacatccattaaaagacattccttagtagggagggtaagaccccctagaagaatggggtgccctgtgtactctcaccatgatctcagatctctgggaggactgtgactcctgccagaccccagctgtgccatgttcctcccttaatcctccctcttaggcgtctccctcatcccatccccaggtcatagcctacaattaggaaagtttcaacaacccctggcagagtggtgcctcgtgccccctgcccccactctgctgacagtgacttctatctggtcccagggtatacattaaggtgggttctgcctcacctttttctacttgcctgaagatggtggcatcccccgatagccacgcccgctgtgcccagggccagcctccacttctgtcttgctacgacaccttggcaccccacttccgcgttgactggtgcaatgtgaccctggtgaggagggaccctgggtccgggggtggggtggggcatggcccccatcccagtcccccttccctcccatgctgcttcctatctccgtctctctgattgctccagtcaccatttctttccctgatgctctcagtattgcccacaggcttagtctgaggatacacacacacacacacacacacacacacacacccctgaagttctacctttcccccacaagagggcaacagagtccgcaatccgcatgtggggtctccaactcccgcgccccagatctgcccaggtcaacagctatatcacagtccagttcccaaaccctttccctaccaagggcctctgcgtgacagctctgtctgcttttctgtaaggtgccacctagcaaacccacttacaacaaggatctgatagctcttcacactataaaccaaagatgctcacaacagctctttggatactgagctgaggttcacaggatcccacggctggtgtacactgttcctgtgaattgaccaacagagcagggactcattcagggtccacagccagcgactggtaattgacaacattcttgagcacttgctatgtgcttggcactgtcccatcaacatattttatgctcaccaccactccaggagacaggtgctactattatccttctgacattacaggtgatgaaacagaggcacataatcatcctagctaagcacttgtctgagtctggattcaaaccaggaggtcagaccctagagctgtgcgctaaccagtgcactgtcccgcctctgctggactttgtgtctcctgcctcctagtcctggcccctgccatgttcctggggacctctgtgtccagccagccacttcctgcgtcagccctgagctctctgtgcaggtggataagtcagtgccggagcctgcagatgaggtgcccaccccaggtgatgggatcctggagcatgacccgttcttctgcccacccactgaggccccagaccgtgacttcttggtggatgctctggtcaccctcctggtgcccctgctggtggccctgcttctcaccttgctgctggcctatgtcatgtgctgccggcgggagggaaggtgaatgtgggcatgaagggcgggggagcacctgctggagctcacacccatgggactcacagtggcacttgtgctgtatgggacccagacaccatgggaatggggttctcaggcacaaaaggagtgtggggcccctttctaggcaacttggggcttgagacctgcctggcctggcaccaggagggcattgtggataattgcacacagacctccactcacattggagccctggggcaccttggggcgaaacccagagctgggctaaccctctccttcacttttccacaggctgaagagagacctggctacctccgagtgagtaaaggaaagctgggggtggggtgggagcccacctagacagttgttggaccccgccaccaaactatgccatgaacagcagagacaaaataaataactccagggtgatgctcaccccttcccttgacctctgtaatcccagcactttgggaggctgaggtgggaggattggttgagcctggaagtttgaggccagcctgggcaacacagtgagaccccatctcaacaaaaaaaaaattttttaactagccaggcgtggtggagcatgcctgtggtcccagctacttgggaggctgagataggagaatcgcttgagcctgggagattgaggctgcagtgagccgtaatcgtgccacggcactccagcctgggcgacagagtgaaactctttcccccaaaaaagaaaagcctgttgtgacacaggggaatgggacctgctgccactctgggggaaagggcttgagaagcaacttaagagactcccagtatcagtatgagtcagacacctgcggtccaggccaggctctgccacacaattactctgtcacccttctttctggcttcagatgctccacctgcaagatcacgaggttggactagctggtgtctatgagtgcttccaattctgccagccctttccaaatccttcctctcttattttggcctggtttcccctactcatggccttacccctcctatgtgcccccagccctcttcctctcccaataccctgaaccctagattccaggaggcagatgtgaaataagttatgttccttttattcccactgcactgagccaatggcggtcttggcacccctgactgcttgcctggcctgcctcattaattgcagtggcacttggccacccttcgaacccccttgataagccgcttgtgcccctgtttggagcccagtagtgacctgtgctgtccaaaggggcgctgcccagagcgccacctctgctgtcgttgcctcttgaccttgagcttggacttggaggcctgcttcttgcccagggtgaaggagcctgaggcccccctgccggtcacctgctgagcccttgtccaccagccccttgagcacacgcttgaagtgataggcatttcgggccatgtcgtagcccgtggtggaaacagccttcttcagggtggccagggacacatacttgcaggtccccttgtccgccacagccctcaggatcaccttggacgtgctgggcttctggcagggtttggcacaggtgcgttgcccagtcgctgtcttgctagggacacgctgccctgctggcctccacccatggcagtatttgagttcaacagcactgatggagacagtggcgaagtgcctttctgcttctctccctggggtaggtgaagtgtcttgggtgcaaggacctccagggcggctggaagtctccactgggctgcccctcacaggatggctgaggtgtgtcccggttcctggtcctcgctgaggcttcctcttgagctccggccctcacctttacctgtgtggccagaaagaggatcaaggacggtcacccacggctggcctccacagacttgtgctcttggtgcaggggttggtgaggttatctctgtggtgacctcagaggctaccagaattctgtgtgggtcacagtggccccattgtttcctccggggaggggtggaccggagatgccagatggtggaggcatgtaacatgccaggtgtcctggggaggagggctgcgcttgtgggccagacagcgggcctgcacggtgcgtgcacatatgcatgtgtgtgtgcacatgcctgggcggattttattttttaaaaaatttttagagagagggtctcactttgtcacccaagctggagcacagtggcataatcatagctcactgcaacctcagactccctgggctcaagcgatcctcccatctcagcttcctgagtagctgggactaaagctactgcacctggcctggcccccagttttaaactcaccattttgatcccaccatcttgacccactgggtttttgagccactgggttgaagaatacaagctttgcaggcatcagggttataccaacatttatgaatttttatggggaatatagtttccaaagtgaacagagatgtacgctaagttgacttacgctaagttgacttaattcctcaagcaactttctatacaaagcagttaaaaggctttgcttttattttctgttttcaattttatagaatttttccccatggggatcagtgatttttcatgtacatttcactaggaagattttattcctcaatttttttggactgaaccaaatttaaacactaacatctactggcactggggatattctcttgtgaccagtatttcctccacatccagccttccccgggtcaactctgtagctctgatgttgtcagaaaaatctgctgcctcagtcaatgtgaaatcaataaccgttttaccatgtgcaacgttagccttggctggtttggatttcacgttgatgtatttctacaaaatccaatttttcacttgttcaatgtctgccacttttcagattatccacaagttatgattctgctgcctgcttttcacctagatcagatttcagcggtcacagagtcctccaggccccacgaccctctcctggggatttctgtgccagaggcagtgctttcgggactgtgtgttggtggtggagtgggtgtgggtgagacctaggccacgtgtgtgtgtgtctgtgcgtgtgcctgagtgtgtaggaatgcctgccgtttgtctgtctgcccaagtgctgatgtggaaggaccgtggggaagccactgcggggtctggcctctgctcttgctctagaaaaacatccccagcacatttttccacctgtgtgttgccagagtaatgaggtccagatgtggggctgggaataaggagggggcccactgactgaggccttcctctgccagggcctcacctgcccagctgtctctatctcagcatccacacactggttgctttctttcccctcagtctccccttgcctgggaatagaaaattgggtttcggacaactcagctcactgaattccagactcaagagctcatcttgaccctcccctggccttagatggtgactccacctcttcctgctggcctccccgcaggaggagcatggcccattcagcgtgaagctaggtcttttctgcagtctaaactgtcaggctctaaccggagtctgtgtccactaattgggacctgaacatgggtggggatcacttctcctccctcatctcatcagtaaccaagtggcaagtggggtcgcttcagccctgcctggggccccagctcctctaagaaaaccaattcttggctgggtgcagtggctcatgcctgtaatcccagcactttgggaggcagaggcaggagggtcccttgaggccaggagttcaagaccagcctgaacaacatagtaagacacctgtctctacaaaaaaaattttaaattagccgagcatggtggcttgcacttatagtcccagttactcaggaggctgaggcaggagtatcgcttgagcccaggaggtagaggctgcagtgagctacgattgtgccactgcactgaagttggcgacaaagtgagaccccatctcttaaaaataaataaataatataaaaacataatataaagctcagcaaacactggcttctggaagaatatggcccctgtggatgtctattcatgtctccatatcttgtgagcgcttatcacgtggtgggcactgttgtaaacactcagccacattttctctttcaatcttcacagcagtcctaggaggtaggttttggtttttttttttaaatagagatggggtttcaccatgttggtcaggctggccttgaactcttggcctcaagtgatccacccgcttcggcctcccgaagtgctgggattacaggtgtgagccactgcgcccggcctggtggtaggtgttattatctccatttggccgttgagcaaactaaggcatggagtggttaagcaacttgcccaagacacacagccttgaacccaggctgtctacacccacagcctatgtcttgaccactgggcactgagcaggcaccatagagctttcttttttttgttttttttcttcttttttttactttgagatggagtctcttgcgatctcagctcactgcaacctccgcctcccaggttcaagtgaatctcctgcctcagcctcctgagtagctgggattacaggtgcccaccaccacacctggctaatttttatttttattttttgtagaaacagggtttcaccgtgttggccaggctggtctcgaactcctgacctcaagtgatctgcctgccttggcctcccaaagtgctgggattataggcatgagccaccacgcccggccccatagagctttctgtttgttttctgcccctgcatcatgtgtctgagtctctccccacataagtggtggggaggaccgcagggtggctcagaggcagttccaggctgtactccagggcagctgactcccagagctgatgactccccacctgtgcctccagcatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccaggtaggtctggtgggtgatgccagccttatttctgggaacaagatggcctttatcacaaggctggggcaaatggtggggtctgggagaggtcaggggaagaggcacatagacttgtctgcccctctgaggccgctgctgggggtcctcaccagtgccagggctatgaccccaatgccaagcactcgcagttggagtgtcagggtggggaagtcaggagaaccagcatctggccctctcagccctccactctctcttcccacagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtcctc

SEQ ID NO: 37431 - DNA, 4478 bp, Homo sapiens; identical to SEQ ID NO: 36894

SEQ ID NO: 37432 - DNA, 34606 bp, Homo sapiens
ctccagtctgtctgtgctctcaaaaactttagtcgttataacaactgtgactgttgagaaatttcactgttttcctgcattcctggcgcgggactctagccagaggctccgaggactttgtagcgactgtcccaagcgtccagttcgatgcttctcagggcggcttgctttaagggcccacccctaaatttgggttgtaaaaatttttgaggtaatgcttgttcaagttcgcttaagtgttcactcagcccaacacgcgggttgggcttgaggttcggcacccgggcagcctcaccccccgcgtcaggcgcgcgcacacagtaggtccgcgacccttagccctccactaggcagcccgcggggatgggtggccgggccgcccacacgggcagcaccggcactgcgcatgctcggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggtaacctggccagggggctcgagggtggacgccgcggggcgggagcgtggtgtgcagaggggccgggcctagggctgggggtcggcggggactctggggaggagtgggagcttcacggctgccacccgttagagggccctggcctgagaaggagtgcgtcggggggcggggggtgccaaccctggcttctccccaggattccttcctgctgagcctccccaacccccgccgagctcgatgtgaggaggagggtttgcaggacagccggggaaaatgtcccttctcggctcactgagtatattgaaccagtctcggtcctctcaagggattttatcagaagcattgagcatagattgaggtaagctgtcacagcgcctgaattcgggagggagctctggcaagaggagacacttgttgattgctcttctgcggaaaagccaggcccaccgacagtccctgccggcaccttgaggagccctgggtgtaggacgcatctgccccgcgaggcgtcattccctgggaggatgttggcaggcggtcctggcggagtggggttggagggttcgtctccgcggcgtcggtgccgtccaaatgagagactgagctaagttgcagagcttgacagtgcagattccatgagactgttccatattggaatacgtagtctctgccctatgcctttctttggtttagaataaattgttcatctgagaaactaatctctggctggggcttaaagaatcagggatgcaataattccaaacgatttaatttatagtggactcaaatatttattgcataaatgaatggctgaatttatttttattaaattaatctggaggatagaaaaggcaattgcccctgcccctaaactttcagaagtagttctctgaccgggattaagtacttagcctttataatttattaatcgcacctgtgaaacaggagtaacatgatgaagacatggactactcatacacatgagctattcaagtgaaggtgatatttaggtcaaactcgattatgaaaaataaaaggaaaacctccaggtggcatctgaggccctacttatttcaagtagtagttgaattgaccaaatgtcaactcagccgatcccagatataatagtttgtttttgtgatcatactgtcaaaatcaaagtaagaatggtttagagctccactgtaacacaggggagaagaaagatgctgtctatattacacttctcccatttcctttcctcatccttcagatacacattatccagatggcattttatttgtcgattcagccaatatttttgagtacctattagcctggcatagtgtgagactctggtacaatactagatcttcaatataaccaaacctgcaaggtgatttatgataaacttttaatcacagaatgtcacatgaaaagggacctcagtagatcaccatacctctttatagatgtcccatagacatgacagctgaggcctagacaggcctttactacaaatcaagcaatgtgtttgaccttatggttacagaggtaactgagatgtgttcctgtcctggatgccttaaatctagtaaatgaaacagccaacctcagtacaaatgttgtgataaaagtaagcacaagtgttatgggaacacaaaaatgttgaaaaatgcttctgactaagatgaaccctgagctgaatcttgaagaatgagtagaaatagctaagtgaggaagaaggcattccagatagagcaagcagcgtatgcaagccaactggacagagcaggggaagctcttgaagtcagtttagaatgactgctaggcaagagttagaaaactaaattacaaaggataccccacagaactcaggtcccctcgcattacctgtacttagagtttgcaataataaagcagactcttgagaagagagagaaatacacttctcagtgggatttatacgctcagtctttcattacatattttcctactaatggtgttcttagtaggaaaagctcccaacttaaagaaactaaaaaataatgtatttgacaatacattaatccttaaattttccatttttctagaaattcatctgagttcttgatctcatttatttcttcacagatgtgtgctttacagtgtgcccagcattttaccatatactaactggttcaagtctgaaaggcacctctgctttgagtctgcttgccagagataagataggaggcaaggctaatttatgttctgtaatatagtgcaagtatatctggtagctgtgttaaagatgtgtgttaatataaacattaccctcccccccctggccgccctgaaataacatatgactaaaatttgcaattgtaaaacttaccatctttggaaccagtaaaattaaatgggttttattattatctagcttaccttgaaggccatttccctgattgccacatttctttacagtaagtgttgagcaagtttcatttcctaataaatctattagctaacagactgaactgaggcaacatgccattttcactggaaggtaggatttagtttaatttagcaaacatttattgagaataaaaggataaaattaaagtcatctgattgaaacctttattaggctccaagtcacacacagtaattccagtctagctttattccactgaagccgatccaatatataaaaattggatttatagacagataaaatagaaggggtttctttacaaaagcatttactattaaaagtctttgactaagctttcctagtacatataaaatacacagaagtcatattttcatagaacacatttaataacatgctagctgtataaaagaagtgacatcatcttacggaatatatatatatatgtgttttttttttttttttgagacagggtctctctctgtctcctgggttggagagcagtggtgcagtctcggctcactgcaacctgcatctcccaggctcaagcaatcctctcacctcagcctcccgagtagctggggctactgtgtaccaccaccccctggtaatttttgtattttttgtagagacggggtcttgccatgttgcccagccttgtctcaaactcctgggctcaagcagtccttccacctcagccttccaaagtgttgggattacaggcatgagccaccacaccctgcctggactgtattctcttaagtgatccatgaagcaaaaactatctgctacagccaggtatggctgcacaagcctgtagtctcagctactcaagaggtggagcagaaggatctttggagctcaggagtttgaggccatcctgggctgcataaggagactctgtcccaagaaagcaataactatttgctgaactccataggacaactaaatgttactattttctgaaacaaagttgttatttttagccacctaacaatacattttaacctagaacccagtggatttgtttattctacagtatcaaaaaaaattcaagtatcaagttatatctgattggtatcattaaacttacctgtgaagaagataactataaagaagcaatgttgtatttcattaacatgaaacattagagtattttctgttttgggacttgtagaagtttatggacactaaaattatttgggctttttgccttagactcaattatgtttggaacatctgtcacagcaccttgtcaactgcattctagaacatttctcctcctgatggaaaatacaacatgacctatgaggcagtcttgcaaaagaaaaaagaaatagcagaatctaatctagcctttcaagatcctgccacaatttataggaaataagagtaagaggtcaaaggaacatatttattgacacctcagcaaaatctagcttctacagaaaaacgacccagtttcatcccaaataaattacaagaaaaaagagtgaggattacaaaagacttgagacatatcaagcaattacaatgtggactttatttgaatcttgatttcacaaactgtgaaatatatgtattttacatatgacatcttgagaaatatgaatactgtgacttgatatttgatctaaggaattacattgataattattgaagttgggtcatgagtacttagggattaattctctttaagtgtttttctcataaaaagttttaaagtcttgtagaactaaaaaaataccaaagatgttctaattttatttcatttttttctaagaagaataatatttttcttttcttttttcctttttttttttttttttttttttatgatggggtctctgtcatccaggctggagtgcaatggtgcagtctcggctcactgcaacctccatctctcaggctcaagcaaccctcccacctcagcctcccaattagctgggaccacaggcgtgtaccaccacgcctggctgattttttgtatttttagtagagatggggtttcactatgttggctaggctggtcttgaactcctgacctcaagtgatgctcctgcctcagcctcacaaagtgtggggattacaggtgtgagccaccgcacctggccagaaaaagagaaaataatttttattatagattatcagtagttatgtatattaatgaagaatttggcttcatttacctaattagattaatcataaatcatttatgaatagtaatagacttgaattgttactttatattacacagttggccctctgtacctgcaggttctgcatcctgggattcaactgtggatcaaaaatatttgggggaaaaaaagcaatacaacaataaaaaataatacaaattaggaaaaatatactacaagaactatttacatggcatttacattataagtaacctagagatgacttaaagtatatgagaagatgtgcataggttatatgcaaatatgccatatgagggactggaaaacccagggattttggtgtcctgggggctcctggaactaatcacctgtggatactgagggacaactgtaattaaattgatttttggatggatgcaactgatgttaaatttggcgggggggaaatgttaggattcacaataacgtgagtactgtgggttggagtagagaatatgcttttcagactcattttcctttggaaattaatagtaaggtctcaagtgccccctacagccttgctactcaaagtgggttccacaaagtgttgacagtatggtactaaatagaaagtggctgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcatgtttcttcaattgtgtctttgatttttattccattgttcccatacatatgcagaaattgatcataatcatgggtatttgtaggttattactgtttgcatggaatttaactgtttccatactggtttatagaatacttaaaactatgttatggctttctttgtgaaaagaaatatcaataatggttgcttgtagtttaacatgggtttaaagtattcaaactaaggcttacgcatgactcaaaacccataatcttaaaaagattgatgggtttgaccacctaaaagtttaaaacctgtgtataagaaaaggcatcataaataaagttaagagaaatagccagctggaaaaactgtttattatatatgggcagaggattcatctcattacatagagcactcatatatttggaagaacagaggataaaaagatatgagtggactgttaatggcaaaataatacaaatggccattaaatatttgaagagataattagcctcattaataatttaatcagattggtgaataatgtgcatcgctgtccaagctgtgagaacactcatgcagtgtacatgaaaatgtaaattggtacagctttctggagggcagactggtgatatggatcaaaatgaaaaacatgcattcccttgatacagcaattctacttccaggaaattaattttaaggaaatagtggggaaagtaaatatgcaactataaagatgtttagtatagcattgtttatctggaaaaacatcatacaacttaaatattcattacctgttattaagtaatgatgcatccatacagtgaaaacactacagccatttaaaaggatgaagtaaatctttatacattaaaagagaaaaaaagttgctgtaactagttaagtgtgtctcactgcacttgtaaggttaataataattatttggaacagctcatctagtagacattgaatgctgctaaagattctgcaggtcagagatctatgtgtaacaggttaaaagcgtagcaacaaagcagtgtacagaatatagagaaaaattaatttaaaacattctagatacgtctttttttaaaaaaaaaaaaggaagccaggaataacatatgcatccctgttagcaatggctgcctttgggcagaacgtgtaacccagtttgggttccccaggaagcagactaggtgaagattgctgtgcaggaagtttattaaggagtattcttgggatcaacacctatggaagggagagagggaaacaaatgggcagggagaagaccagctgcaatgcagtcttaatggactgcttagccatcctcgagggagttctgaagatgaaataccctttcagagatgacctgagttgcaaagagccaagactttattagccgttgatcagtcattgggtggggattgagaggacagtgtgattttgctgaggcaatacccaaaagggctgacaactcaagtgttttcagatagaactctcagcagtttgggtaacaagttctttatttctgaaagggaatctgggcaacacaccagagtctaccttatagggttcactttttatgtgcttttaattttttttttttttgagatggagtctcgctccattgcccaggctggagtgcagtagcacgatctctgctgactgccaacctctgccacccgagttcaagcaattctcatggctcagcctcccaagtagctgggattacaggtgcccgccaccacacctggctaatttgtttgtatttttagtagagacagggtttcaccatgttggccgggctgttctcgaactcctgacctcaggtgatccgtctgcctcggcctcccaaagtgctgggattataggcatgagcctctgtgcctggcctttacatttttgaaataacaaatatttgaaaaaacattttctttttgaaatacagaatgttaatagattttgggcttacctacagaatttttggcagcattcttaatgtctactagatgatatagtcattaaaaaattattggaagcttataacttcagtctgtaagtgatggcttatattttcaattctaattaaaatttggttttccaatataatttgacttttggtgtactgacatgtattttatgctaattttcttgattctttaagttttgagcagaaaattattttaaaagatgtatttaatggatatttaataattcagaagacagtgatttctggacttagagtaataagtatatacgtggaagtagatagatgttggacatattgatacattgttccagagttgagctacccttccttgatgagtcctaaaatgctgttctccccataggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaagttaagtattatagatattgtaacaaattacatttttttttttttggcacatggaaattttcactgacacagtaagtaggcattataaccagactttcgggacataaacacatatcttgtaaaataaaaattttgactagtatactagtttatatatttctcacaatttcttctaggtactttggatggtaccactactcctgcatggcttttttctctgtgggtacactgtcttcattgagctgtcttttgttaatttatagacctctgggattcatgtggttcctaaaagattggtgtctctgaatttattaacagaaccaaaaagaaaaaacagaattttctaaatttattaatagaaccaaaaagattgctcacatgttaatgtctttccagaggtcttaatttcatgcagtattttgttatattttgaattgatcagcttacaataatgcattaatcatttccttattctggaaaattttgaaatattttcacactgaaaatattttgaatgctgtctaacattcatatctcttctggtacttactcacacagagtaggcacagcataccatttcatttcttattcttcttccatagaggctgccatctttttaccatcagatccaagtttgtgtttataattagtcatcaaataattggcattaccatgatgacttaccttctatctcctcttaatttttattttgaaataattacaggtccacaggtatagggaagtcctgtgtgccctttaacctcctccgatggtaacaacttgcataactatagtacaatatcaaaaacgaggaaatagacattggaacaatccacagtttacttggatttcctgagtttacaagcacttgtctgtgtgtatgtgtataaatagttgtttgcagttttattacaaggtagcttcatgtaaccaccaccacaatcaagatacagaactgttttatagttatatactccctttccctagccattcgtaaccactggcaaccactagtctgttctccattttgtaattttgatattccaagaatgttgtataagtggaatcatccagtatgtaaccttttgagattggcttttttcactaagtataattccctcaagatcagtccaagttactatgtatcagtagtttgttcctttttattgcagaatagtattgcatggtatggatgtaccccagtttaaccatttattggttgaaggacatttgagttgtttccaatatttggctgttatgaatggagctatggaaatatgtgtgtaggttttctcatgaacataattttcacttctctgggatgaaaccccaagagtacaattgctaagttctatagtaagtacatgtttgattttaaaagaaactgccaaagtgttttctagagtatcttatattaagttcccaccagcaatgtatgagtgatccagttcatcctcatcagcatttagtgttgctactttttaatttaatttaattaatttatttatttattttaagacagagtctcactttgtcgcccaggctggagtgcagtggtgtgattccagctcactgcaacctctgcctcccgggttcaagcgattctcgtgccttggcctcccaaatagctgggattacaggccccgtcagtaacgctgggctaatttttgtatttttacaaatttgtattttgtatctagaatgcaaaaagaacttccaaaacacaatattaaaaatattagcaatctagctgggtgcggtggctcacttctgtaatcccagcactttgggagcctggggtttcaccatgttggtcaggcttgtctcgaactcctgacctcaagcagtctacctgcttcagcctcccaaagtgctgggattacaggagtgagccactgcacctggcctttaattttattaatagccattctgataggtatgtagtggtatctcattgtcattttaatttgcatttctctaatggcttgtgatgttgaacatcttttcatgtgcttatttttcatctattaatatatattctctctctgaaatatctgttgatgtcttttctaattggattacatatatatatataattatttttttttttttttttttttttgagatggagtgtcactgtgtcaccccaggctggagtgctgtggcacgatctcagctcacagcaagctctgcctcccaggttcaactgattctcctgcctcagcctccagagtagctgagactgtagacgtgtgccaccacaaccggctaatttttgtatttttagtacagatggggtttcatcttgttggccaggccagtgtcgaactcctggcctcaggtgatctgccgacctcagcctcccaaagtgctgggattacaggcgtgagccaccgcgcccagccagatgctaatatttttgatgttgtgttttggaagttctttattctagatgcaagtcttttattgaatatgtggcttgtaaatattttcatcctcttaacagggcatttcacagagcaaaaatttttaattttgacaaggtccagtttatcagtttttccttttgtgaatggtgcttttggtgtcaagaactctttgcctagtcctaggtctccaagattttctttgttttcttttcttctaaaaggtttatggattttacatttaagtccatgatccagtcaagttaatttttatgtaaagtatgaggtttaggtcaaggttcattaatttgcctatgaatatccagttattttgcacaatttattaaaaaggctctccttctgccatccatactaatttttaatgcaggttttcaaaaatttttactttatatttttataggctcgagaactcttcctaaaagcagtagaagaagaacaaaatggagctctctatgaaggtaaaaattcagagcccaggttcatatcataacatttctgaataatgactctgttattaaccatatttttttttctataacttatttggtatagaacatcacttttcttaatacattcttccttcagtactcattggaaattggttccaggaccctttgtagataccaaaatgctcaagtcctttatatgaatggtgtaatatttacatataacttacttattatgtaaatagttattatactgtattttttttttaaatttgtatttattttaaatatttttgatctgtagttggttgaatcagagaatgtgaaacccatgaatacagagggccagctatatttgaaattgttttttaaaaaataaaaaatagaaattgtttttctatataacctgtctttttgcaaaaaaatattgctgggaaacatcatcatgttggtaggatgagcaaaataacttttttttacatttagctttagttattcttcattaataaagtatttaaaaattattcattttaaaatatgctctttttataggtgaaaattgcttcagaggatgggaatataaaggataaattgaggaaaaaatacatgtttttctttctaagttccaatttacatattaccaacagaaatatgtggtaatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagaaatatgtggtaatatatgtgtcagctttgtgtcttttattaacccaatagaaatgtgtaaataaagtgataggactatttgccatattaggtttgtaattatgctttccttttgtgatagtaaagataataattgatgcataggaaaaatccttgtgcttgaatcgtttgaaaatgccccaaaactaacatcattcagagttactgcatttatatgcaagtttcttctagtgatatttttctttagatttttagaaaggcccagttgatcaagtccctgtgcagccttcattggtttgtgaaattcgcatctccacttagtgtatggtgtaattcatccagaataatagaacatggcagaatatattgaatcataaactcctttgtagggaaaaagaactagtcagcctctacagctccaagttctactggtgtatctctgtggggagagttattgaatattacagctctaaactacctgtctaggaaatttgtaaaaaataagttttgaagattacttaggtaaataagaggcagctgggctaaaagaagttaaatttaaaggataatttaaaaacaaaaacaaaaactattctttattccacccagtaggaagcatttaattttcctcaactctgtgtcttagaaaagtttgcttagaagtgtttttggccaggcatggtagctgacacctctaatctcagcactttggcaggctgaggcgggaggatcgcttgaacccaggagttcaagaccagcctgggcaatatagcaagatgttgtctctacaaaaaatttaaaaattagctgagtgtgctggctggggcatgcctgtagccccagctactcaggagactgaggtgggagaatcacttggacctgggaggtggagtctgcagtgagccaagatcgtgccaactgcactccaacctggacaacagagtgagaccttgtcttaaaaaagagagaagtatttttgttggctatagcaattgcatcttcagagcccaaagaaagacaactatttaaaaatcatgatacgtaagagggtgaggaaaaatatgggaagggctaatatataagagtaaaatacaacatcttaagtttagggaaaagtttctttctgagcattaaggtttggaaatagttttgtgtcactgaactgctgttgcatgtagaaaaacagaatttggccgtttgtaaagaaagttaccaaattaaaccacagttaagggtaatcaaaggaaatgacaaaaatgtgtggtcacagctaatttagctttatttcttcttttagccatcaagttttatcgtagggctatgcaacttgtacctgatatagagttcaagattacttatacccggtctccagatggtgatggcgttggaaacagctagtgcgtatataatttgatagatagtaatgcatagagtttgttaaagttaagcatctttgccctgttgactcttaagatggtgctaattctgttgagctctatactctttagtatatctttgtttataaagttgtagaaattttttaattagggaaattgcaagataacacatagaaatgcaccttttaaacagatacaaaaataaacagatacaaaaataaacagatacaaaaaaacggtttaaaaaaataaaagcagtagttactgaaaggagtaaattaaaggacacatttcaactttctgaaacctatttgaagtagaaagttttaaaatgtaattaggctaaatttggcaaaatattaataatggttaaaattgagtgatgggtacatgggagtttattacactagtttccttacgtatatgtttgaaattttacattttaaaaaaggcttctaattaggaaaatgctgaactataaaagatgttattattctcttaatgtttttagtaaaacattaaaactctaacatttatttaaaagcacaggtgcagaatatattcctaaaagaaatcatgtttgaattgtatagttgccactgcatcaaagccatgaagtagcattggttttatatggataaagatcaagaaaacttatttttaaggcaatacttttgcaagacaattataaaattgttttggcttaattgcactatctcccaaaactcaatttgctgatattagaagagaagggagtctgtacccatgagagaatgtcaggttaaaaatagacagtacagagaaaaaagttttggtaatgaaatattatattagctattatattaatatattccctctgtcatgaaataattgtcacctttattgataacatatgcttattgccaatgttttttaactgcatatggtattaacacttaagctttggataagtcatattaaaaacattcccaacaaggtcaatattaatagcctgtttaaattttcagctaataatattgttcaccaaattagagttaacagtatgaggtagttcatacttaaaatgaatcacttgggttttttctaaaccttctttaaatttgggtagagtcgtttagactcagctcttagccagttttataaatatgtgccagatgctgttaagaaagattgtattaaaatattaaagaggcatttcttttctttcccattttttatacaaacccagacgctatgaaagttctttaaggattcatcttttttttttaaataagatctgataagccctaaaagtttgcctttttttttctttcctgtaacatgtttgtagaatagccattgagtccatctagcctcaaccacacttatattttgttgtattacaaaatgcccttcctggtttttttttttgtttttttgttttttttaagtctacatcacttgaaacttcctggttttctaacttcgccttcatccaatcctctttgtaagtctgatcatctttaaggtttacttcagtaaaaatagaaagctcatttttctagcaccattcactacacatttgtgtatactggtagatgatttgtgaaccctaagatgttttcaaagtaggtattttcctctctaaaggtaggctgataaggcaaatctgttagaaaacccttggtaagtaagtacctcagatgacgtctgtagatttggtttttatccagttagaataaattaaggttaaagaacatactacgttaagatttttgaaaccatttgaaagcttgcagtaactcataaaatctctactttacaataaaattagttaaatctcaacacctgtatccaaaaattctaattctttctggatgataattactgaagcttttttctttgaaaaacttgatacagtattcctttgcaagacaggataaattcatcacatttaaaaatgtatcacatgttgaataagctttaggtgactttttgtaaagcaaatttgaaaatgctatgaaaaatcagtttctaaactgtacgcttgtagactgaggcacttaatttattcacctcccttttttcagcattgaagataatgatgatgacagcaaaatggcagatctcttgtcctacttccagcagcaactcacatttcaggagtctgtgcttaaactgtgtcagcctgagcttgagagcagtcagattcacatatcaggtgtgaatacttgtttttcataactcagtgagaaatatcttaaccttaaagatttccaaatttataaggtcagataatttgccagataactgctgctttagttcagaatatggtggaagatctagttataattatcatttgcatatactattaagctgttttgtgttttgttttgtcttgttttgttttttgaaatggagacgtgccctgtcacccaggctggagtgcagtggtgcaatctcggctcactgcaacctctgcctcctgggttcaagcaattctgctgcctcagcctcccaagtggctgggattacaggcgtgtgccaccacacccagctaaatttttgtatcttcagtaaagacagagtttcaccatgttggccaggctggtctcgaactcctgacttcatgatctgcccaccttggcctcccaaagtgctgggattacaggcctctgaggcactgcgcccagcccagtagtaagctgctttacaatctgaagcagaacagtttgtagtgctgttgtttaaggatgccatacctttttcagtaaagatctaacagggtaagtctgagttgttgaggtagccctaagaaaactggaggaatactggtatcatgaagcatttcagccatgttggacaattgtcctgagacagactgaatgtttaggaattaatggatttttgttcgggcatggtggctcacgcctgcaatctcagcattttgggaggctgagttgggaggatcacttgaggccaggagttcaagataagcctggccaacatggtgaaaccccacctctactaaaaatacaaaaattagctgggcgtcgtggcgcatgactgtagtcccacctacttgggaggctgaggcacgagaattacttgaacccaggaggcagaggctgcagtgagctgagattgtatcactgcactccagcctgggcaacagagcaagaacctgtcacaaaaaaaaaagaaattcatgtatttttaatatgttaaatattgtttggttcggggctttttcagaggaggacaattaaaagttttcaaggagatgaaaataactttagtgttaatagatgcaatatggatcacacacacatagattattttcctaaaacatttattttaatatgtctggcaaaataatcttatgagggaaaagagtgctttataaaaagtagcttcagatctatactgaaaaaacaaagatatttatgtcttgatgttaagaaccattattattattgagtagctaaatacattcatgctttagctctgagcaatacagagggtgtgattataaatttctaggaaggtataaatgtactgggaatgtagttgtgacaatagaatgacatagaggagagtcactgaaggatgattttcttttgcagtgctgccaatggaggtcctgatgtacatcttccgatgggtggtgtctagtgacttggacctcagatcattggagcagttgtcgctggtgtgcagaggattctacatctgtgccaggtactaagtttttgtttttgttttttaaacaactgaggcaatggtgaaaagaaagatggtcctttgccaatcctgataaaattacttgattggtgttctgagttaaagcttagaataaacaagttttgctaagctgtacttaactttctcaaataacttagaatttaaaggctagaatatgctaggtttctagggtatagaataatatgtaggacagatgtagtaacccatactactaccatagagtttacatgctagcttaactgatttgggaaaaagagttatattagaaaaatatattcaagtcatttttacactaactgtaaactcattgtggtaatggtttagattaaaacagcactagcattttcttatggctcattaaaagttattctatattttgaaaattttgctatgtgtgggaaaggactctattcaataaatggtgctgagataagcggctagccatgtgcagaagatggaaactggatcctttccttacacgacacacaaaaatcaaatcaagatggattaaagacttaaatgtaaaacctaaaactatatacttagtccttatatagaatttttaaaaacaacttgttcttaaaattcagatgcattatttttaaattaattccatttggaatcttgtagttttcataaaatatttgaatttcttgaagactctttttcacaattctgtgtgctagtatatttaacaagtacctattaaacacctagtggattgccactagagtctctagcactgttatgtcaacctaaataataagcagatagactctctaaaagacatttatttgagaataatacattgcaatgggaatacacatgccatagtaaactattcagggaaacaaaagtttttaaaggaaaaaatgaggattacataattgttttgaaatacttaatccttgactacaaagatcagtaacaagggggacgccagtctgagattggacagacagtttcttgggcagatgtccttgcagcaaaaatattttttgtataaggctgtgatggcctttgtgcagagctgtgttttttatagtcttttttgttaaccagtcatagaagcctgagaaccttctcttcatggccttcctcagctctctttgtcagggttttcttaacattagtggctccatttttattttaacaactttcacattttccccttttgatcagtatctttctctgatcagtcatcctgtagttaggttttgacatcccatagtaccagcatagaccagtcctggtttctagtctcatcccatgttggggagaatgattagcaactaggagtccgtgtcaaaatgcttttaagccacatttgggcaagaagggacgtctgaagggaatgactctcaggctgtgtctacctggattccattattaagtttgatttttgtctattccatagtctttgttactcaaaatgctgggccagcgttattgttaggtgtggtacttctgcagaaatttaacaagtaacaaagttaatagtaatatgacaattccaatttgcataatggttttgagccatgaacctaggcttaagaacaactaattgagtagaccagtgaccacagggaattaggtgagaccatgtaatcatgctacctgttttcttattttgtgtacatgggtctcaactttatcagagggatttatctaggtacagcatgtagtactagcaatagcacagatattttcttttttaaccaatgaatactaaaggatttcttgggttaggttctgttaagttaccagcagaagctattgattatgaaatttcaattacaccattatcctgtcaagtgaaaaaagtagcattaagtgggggtaaaagtcttatgatatggttctgatgtcatgggaaaagctgtctacagctttcacaaaaacatcagattctcctcctgatttatgtttgaatgtctctggtcatgatattgttgtgtggctcatatatcaggcatgagacttgtttcttaaaatttgaatagtttcagcttaaagggctttacgaacagaagcttttgtttttagttggcgtgttgtagtccaatcctggaggaaactaggagaattcatcaaacagtccggtgtacgtgtggataacaacaggtgtattgcagttttttttttaagaaacgtttttttcctacattgatcatataggaatttcagatttaaaaatctcttgaggctaggaagtcaaagagaggtagactttaggcttcacttagggtcttaaggttcttgggcctgctaggaagtgacaggttttactcacgataaggctgagaactcttaaagccggatgttttatgcacattcttaaatatgacattttcagtcaaagccttggtaatataactaatgtttctaattgtatcctcatataaagggattagatttttattgaacttatataaataaaaataatatgaatagtttctgaattttggagaaatcaagtagggagaaaaagcaaatggttccaccttggttcacaaaagtcttctaacgtcataaagacattctcttcatcatttacatcaattttatgtaattttttattatgcttgatctttattagcagttcaatgaacccatgaatttattagagttctggaaatttttatttagtccattgatcttaaagttagcaaaaatctttgttcaagagtactgctagagtcttttccataaacagcagttttggactgtagctgattgcaaatgtttttagagaattcaaaataataattgtgatgacaaaaacttagaatagccatgtaaaatctgatgaaagttctcagttgatgagggaatttagttatttctagtacatgtagcattttaagataaccagaatcatgactgacactgtcacatcaggactatcagacttttatataaatttcatctagtctttagaatactcacattaataacatctatacaaatataactttagaaaatatttgacataatagaaatttataactaatagcatactagatttttatgagtttacatagttttggaacatttatatcaataatatacccataaatgtaactgaaagaggatctaatacttattatttaacagtgcctcccatacagtttaccaagtgaggttaatcatttgatatatctacaggatgagagatacgttctttgaggctttccaggagcccaactagaaaatcccaaagttggctgggtgtggtggctcacgcctgtaatcccagcactttgggaggatgaggcgggtggattacctgaggccaggagttcgagagcagcctgaccaacatggagaaaccccgtcgctactaaaaatacaaaattagccgggcgtggtggctcatgcctataatcccagatacttgggaggctgaggcaggagaatcgcttgaacccggtaggcggaggttgcggtgagctaagatcgcaccattgcgctccagcctgagcaacaagagtgaaactacatctcaaaaaaaaagaaaaagaaaatctcaaagttaattttagattggaaagccttaatttaggatcttgactctggggaaacctgccagagatgtcaaaggttcaaaacatttgatcaaaacaaaattgctggccactgtgaagttacttatttaaccatactgataatcaaaagatcttaaaagcaatgcagaaagttacatggatgtaaaagccttaatccttttaaagctcagttttcgtaagtaaccaaaaacctaataaagcacaggcgttatattgataaaacaataaattttttttttaggccagttgccaaaaagataaagaaataccttttatagggtatttgcttctccatgtgggaaacctgtttagataacttgtaagttaaacctgattaaaagggtacttgaatttacttagggacaggaagtatccagggttatatgtctacattagagaggaatataaacaagaaaactagtaacttgagcaggagaatacatggctcttaaatagcataggaagtttcctggttacatggagtaattcagatgtcacataaagccaagagtacagaatcaagttatattggaggaaaacattgctcttctagacctttaaactaaacatttcaggccggacatggtcactcatgcctgtaatcccagcattttgggaggccaaggtaggaggattgcttgaggtcaggagttcaagaccagcctggacaacatctctactaaaaaagcaaaaaaattagctgggtgtggtggtgcacgcctagctacttgggaggctaaggcaggaagatggctgaagcctggctgcagtgagctatgatcatgccacaccagcctgagtgatggaatgagaccctgtctcaaaaacaacaacaacaacaacaacaaacacaggtgcagtgcctcacacctataatcctagcactttgggaggctgatgtggattgatgggttggacccaggagttcgagaccagcctgagcaacatgacgaaaccccgtctctatgataaaatagaaaaattagttggacgtagtgtgtgtacctgtggtcccagctactcaggaggctgaggcaggaggatcacccgagcccaggagttcaaggccataataaaccgtgatcatgccactgcactccagccaagatgacagagtaagatcctatctcaaaaaaaaaaaaaaaaaaaaaagagataaacatttcagtgtcaggctattaacagcagagctagaactggagggaaaaaattaagaggagttgacaaaaaggttgaaagagagagttatcaccctagccaagcaaaaagatacactctttcaaggggagagagaacagaaggcaatggtgtatgacctgcaaatcatgtgcaggagtggtacagcaaaagttgaacttctgatataaatctgagaagcttcagaaagaaaaattttaccttgagaagtgaaattaccattctgagtgaaaaagacagcatttccaacctggaactagggaaattaattagatcccaggaagaaatagaaactgtagttttgcagatggctgttcaacagattttagaatttaaaatcaaaacctcttatagttttattaatactaagagcaaattaatactttaagaaaacttcattgttctaacagaggaccaagttttttagttttgtattagtgtatttcttatagcaaagctcaatctttagaaagacttataaacaattctcttcaattatagccaacttgaccacacacaaaatcttttatgaaccttatcacaacttatattgatgacatgcttggactttctgctctgttgtataccttcctctttcttaaccagtcattttactttaggacaaaaatctaccatacaagattcttttttatacaaaattattctctttttcatctttttttaaccaaaaatatatccttgtaactttcttcacatctctgtctcctacttactgatttgtttcttatgccatattttgaaataaactttaaataacttccaaattacacaaaattcttcattatttaatcttggttcacatgtcataagcagtgagttttatctcaacatgaatggaaaagtcagcagattcaaagtgtgaagaaaaaaaatagagaacttagactatatatattctatagttgcaggtttttgaatgatgataatttgagctgtaaatttttcttgatgtaattttgcccatcagtttaaaaatgtgcacaacaataggctataagatgtagtcagctggaatcccagaaaacctggcatgttttaacatttgagaatcccattctgtttcttactactctctccagaggaaagaaaattctgcaaatcctgtcagagaaagtcaggagtttagacctgtgttttaggtggtggtgactgacctagtggtttgtctttttttttttttttccttttgaggacagtctcactctgtcgcccaggctgcagtacagtggcacgatcttggctaattgcaacctccgccttgcgggttcaggcgattctcctgcctcagtctcccgagtagccgagattacaggcatgcaccaccaccgcctggctaatttttgtatttctagtagagacggggtttcaccattttggctggcctggcctctaactcccaaccgcaggtgatccgcccacctcagtctcctaaagtgcaggaattacaggcgtgagccaccgcacctggccctagtggtttttttctttctttctttgtttttttttttttgagacagagtctcgctctgtcgcccaggctggagtgcagtggcgcaatctcggctcactgcaagctccgcctctgggttcacaccattctcctgcctcagcctctgtagccctagtggggtttttttttgtttgtttttgtttttttttttccaggcggagtgtcgctctgccgcccaggctgcaggtgcagtggtgccatcttggctcactgcaagctctgcctcccgggttcacaccattctcctgcctcagcctccccagtagctgggactacaggcgcccgccaccaggcccggctaattttttgtattttttagtagagatggggtttcaccatgttagccaggatggtctcgatctcctgacctcgtgatccgcctgcctcggcctcccaaagtgctgggattacagacgtgagccaccgtgcccggccagccctagtggtttttaattagccatcttctgcccaccattcagaatctttatttttgcttatggaagattttcagaagaagcaagggaaaagagtcaaaccaaatcaaaaaccaaaataagaacattcacaaatattttatcccaggcatgcagatcaaacaaaatattaaactgaatgcacagaccaaatcaaaagtaaattcaccagaagacgtgaacagaatgtaaatgctgtagaaaccaagaatacccaatctaaaaagacacttttctttacaccagaaaggacttaccaggaaagacaaaaagtttatcatctcaaaagggatgtatggtcctttattaaggtgaccttatccaaaccagatcccaaatgatatcaagaagcctctaccaaaaggaaggaggctcagcctgaaagaagattcaccagggcagaaaaggcaagccgtggaagtagagtgctcagagcactcaagtaagtactgcacactggttccaagaatctctgattccttcagttaatgatcttttcagatcccgcttctgacacttctgtatttcaacctaaataacaaatgcccaaaagttatttgggattagagcatcacaatgggaatacacatgccatagtaaaccatgtgcttattcagggaggtaaaggcaggcaggtttttaaaggaaaaaatgaggattacataattgttttggaaataattatccttggctacaaagatcattaacaagggtaatgccagttcaagtttgcacaggcagtttgctgggcagatgtccttgtagaagtattttttgtataaggtttaatggcctttgtgcagggttgtgttttttgtagtcttttttgttatcaggcatacaagcatgagaaccttattttcatggcctttcccagctctgtcaggattttcttcacattcatgatttaattttgattttgacaactttcatagttattccattaacttgtaattgtatgtgagaaaatactataaagaaggaattgggctggtctgagtgcagtggtcgtttacatctaattgatcacaaccagttacagatttctttgttccttccccactcccactgcttaatttgcctagcttaaaaacaaaaacaaagaaagaaagaattggttaagcaaatattcaggaataaaacttcatgtgtcatcataaaagtaactttaaaagcaaacattttaaatatacattttaacataagtttgaggggacttatctttttcaatctgacaccgatctaaatagtttttgcttcatttacttatttatgaatgaatgaacaagacaaggtcttgttctgtcgcccaggctggagtgcactgacaccatcatggctcactgcagcctcaaactcctggcctcaagccaccctcttgcctcagcctcctgagtaactggaactacaggcatgtgtcaccatgcctggttaattttttttttcattttgtatttttgcctagttaattaaaaaaaatttttttaagagacagggtcttgctatattgcccaggctagtttttacatctttaaaactgaatacttagctgggtgtggtggtgcacatgcctgtagtcctagctgttcaaaaggttaaggcaggaagattatttgagcctaggagttctgggctctagtgcactatgctgactgggtgtccacattaagttcagcatcagtgtagtaaactccaaggagctgggagccaccaggttacccagggaggggtgaactagcccaggttagaaatggagcaggtcaaaactcccatgctgatcagtagtgggatcatacctgtgaatagtctctgcactccagcgtggacaacatagtgagacctcatcactttaagaaaaacaaaccctgaatattttaagttagagatggagttagaaatacttttagttatagcagaatcatgtcaatttttagtacatcttttacttagctttttgcacacttttttttttttgagacggagtctcgccctgtcccctaggctggagtgcagtggcacagtcttggctcgccgcaacctccgtctcccaggttcaagcaattctcctgcctcggcctcctgagtagctgggactataggcacccaccaccatgcacagctaatttttgtatttttagtagagacagggtttcactatgttggccaggctggtctcgacctcctgacctcgtgatctgcctgccttggcctcccaaagtgctgggattacaggcgtgagccaccatgcccagcccctgcactaattttttaaacaaagtcctgttggtgctcccttcaaaatttatctccagtctgaccattttaccacttctgcaacaacccttctgactcagccactgttctgtttggtttgggttacatagtggcatcctacctggtcttcctgtttccactcttataccactagaccatattctccataaaccaccagagtgatcttttaaaataaaagcataaattatgttcaaaaccctccagtggcatccatctcatgtaaataaccactccttcctacaagatgccacctcacctgccccgactgcctcatcatagtttcctctgcacaatgcccactttgccacagctgtgtgctcctgctggctcttggatgagcccaccagtcacacttctgcctgagggccttgcacatgctctggttgctgcctgagatacttatccccatcactatgatcaccttcccagagaggcatttcctggcctccctatttcctcaccaccatcatttctgtctgctgactctactttgtctgttggttgatttttgcactaagcgtactaccagaagctttcctctcaatttgctttcccacagtaaaagagcagggcctttgccttgtccattagtttctcctcagaacagtgcctcccaggtgttcaacaaatacttgctaaataaaagatggctgatagcaaaaatatttatgtctatgtatagggacttagtttttattgacattgtgcttttattccctagagaccctgaaatatggcgtctggcctgcttgaaagtttggggcagaagctgtattaaacttgttccgtacacgtcctggagagagatgtttttagaacggcctcgtgttcggtttgatggtaagttggattctgtagaactcagcagaaatactgatctataatgctgatttttataaatacgccgtttaaattttctgtgatgaatgtgagtactgtaagcatgtttaaaggaaaccacagtaaatataatgctgggaatatctgaatattataatttttaactttttaaaattattttcataggcgtgtatatcagtaaaaccacatatattcgtcaaggggaacagtctcttgatggtttctatagagcctggcaccaagtggaatattacaggtacaactgtagtacactgagtgagtggaaaattctctctctccatgtattagttaaatggacatctgttctttgttgcttttgattgacccgcaaaatggccctcagtatttttatctagtactcaatgtaggaattgcactaaaaaaaaaaataggctaatataaattacagaatttcttctggcctcttttagatttcttcttgtcttttgccctgggtgtatttacttgccttttcaaatagcttgtgcttttattccaccttattgcttgccaaatattattgtcatttagaaaaaaatagacatgttaaccgttgtgtgtggctctcactttgtttgaaattgttgctttgggaaaaacacagaactttaataaaacaatatttgacttttattcagtgagtaaaacttaaaagttcaacagtttcccctgaggaagataaaatatctttggttctttgttgctggactaacaggtagtcagtaatatttgttttaatgttttagcagttctttagcccgtggtatttcagtgttggtttcatagctatgaataggcataggtactaatagataaggacatattttatactttgtgtggggggtgtgttttggtcttccttttcttattacataggtacataagattctttcctgatggccatgtgatgatgttgacaacccctgaagagcctcagtccattgttccacgtttaagaactaggaataccaggtagcatttgttttttaaatggctttccatccagtctatgttttatatggttccttgcaggttaaagtaatccagtgcttctttcacttaatactggatgattttaaaagcaatcattcagggtcttaggaaaaataccaatttctgggcttttccttagaaaatctacttcagcaggtctttggagccttggaattgagttttactcaatcctagctgattcttttcaagcaagagtaaacactgttgtaatttgttacttcttagattacttaaatccacttaataactgatttagattcaatttgttttttttttttaaggactgatgcaattctactgggtcactatcgcttgtcacaagacacagacaatcagaccaaagtatttgctgtaataactaagaaaaaagaagaagtgagtatacgaggtgtaattaatagttttcttatcttaatagcctattcatccaagcagtctcgattagaacaacaacaaaaaaaaccctttctgattatttatactgttatataaaatgtatattaacttctagcaatcactgaagaaagctggagagttttctaaaatgttgttattttttattggatcagcttttttgttttttaccagatagtttgttttttatatatgaaaatgtaaagctgaaatctcttgtgaaataactagtaaaattatacctgaatatgtttttggctctgctcatgtcgaatcacaggggattttttttcctaaattagctcatatagataattctttccataaggatattgttagaacttcagtttctactggaaataacctaacttcagataattttcttcttcctgttcttaaaaaaggaaaaaaatgccaagcaaatatgattactgacattattacattctagagtgctttaaattgtcctaacagattggtagcctaattttttcacctttctccatatgcacgttttcaatcctggttaaaaattgttatatgtacccaagaagccagttgtatggtatttggaataaatattaatatttacttgttgcctttataattaatacagcttttgaaggatatttctcttgtatgaaattcccccttctctaacatcatatgtccagacagggcagagtttcatctgcgagtcctatcaccttgtggccacctgttgctggcgtctccacttccctctgatgggctcctggagcctgggcagcagcagcctgagagacagagagagttgctttgactgtgactgcaggtttcctgaggtcaaaattgggaatttggaaggccttagttgctcaggttttatctaattaaaagagtttaggaactcccatgtagaatgtcaattttctcttcagaatatgatgaaatattcatagtgtttacatttttttgtttttagcagcagtatttgcagaagtgtaattctaatgaaccttgtcacagctgtttgctcatttattttactgttattgcaaaagataagttatactctgtgctttttcagcatccttcaccaatttatcactttccctcttaaaaaatgtccaagtgttttccagtagaaggaaatactaggcttagagataggagataataattttacatcccatctatgtaatgttggttacatagtagttttacctccctggatcttcattttttaagctagtaaatagaaataatgcaatcatatttaacacatgaggttattatgatgattaactgagatgatgatgatggggaaaaaaatctgatatttttagagtatttaacagtttttaaagcactcatacattcttgtgatagtcaaaacgactctttactgcatgcaaatattatgttacttttagtgtcactgttgcatactatttctgtaaacatagaagtgaggtaaggtttcattataacttatgcatcttttcttttgcagaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaagtaggtgaatgcaataaaaataacaaggttacactataaatgtatacttcgtatccagcttaagaatttcagatatgtttctaatttctcagagttaacactacattacaaactaaaaccagtactactacaaactactacaaaccaagaaaatggcccaaacgaaaaagactaagcatgcttgaggaagcagagcatctggaacactcatatagtacccattggaatgtgaattggtaccaccaccactttggaaatgaaagtagcattccatgggaagaatggtacttagtcagctgtgagctgtccatgtatgacttaaagccattttaaaataccagatcatttttcttttcccacagttaccattttttgctttatttccatttgttttatcctcagggattatacactgatttaataaaattgtagttaggaaagtaagtctactaaaaaaataagaggtattccaaagccaaatttgttaggtgattcctatttaaaactctttgttctatgcagtagcatttacctgtacatcataatcagtgaactgaagaggggaggtatgagaaaggagccatacagaaatatataaaacttaaaaaggaaccagggaagtgaaatatcaagtcctgtggcaattaaggttagctcttgttcaatttgaaagaatattggtacatgactgaaggctcttcgttctgcttgaatctaaaattccgagagagaagttttgaggtcagcttccattgcctctttgcaaccttaaccacattgttgaaaactgtgtcacatttccactttaccgataacttttccctgctcatttggaaggtcctgacaacagaacgtttttctttctcatctttgcctacaaattctactatatctcctttttgcttctctctctaatgctgtgggattttttttttctacttttcaaagaaagaaacctgagcaggtgtggaggcttatgcctataatcccaggactttggggggccaaggcaagaggatcacttgaggccaagagtttgagaccagcctgggcaaaactgggtgaccccatctctacaaaaaataaaaatatttgccgggcatggtggtatgcatcttgaagtcccagctaatttggaggttgaggtgggaatatcatttgagcccaggagttcaaggctgcggtgagctatgatcacaccactgcactccagcctcggtgatagagcaagaccttgtatcaaaaagaaaaaaagaaaccaaaccctgaagtagagccaagcaaatgaacaatggatggttatagtttatacttgacccattagaaaaacattgtttatttaggagaaaaaaggacattaccagaggcattatttgtagctgctaattatcacattgacttccttgtaatatttataaaatcacttgaattctctgctttcgtttgtctctctcagtggtagcataacttaccacctactttccctcccccctgcctataattatgctgttgatcatgcaattattaaataatcaaattatattctaggaatatagttatttctgaaacattttaagaagaacctaatgtctatagcttctgacttaaaaattctatcttaggaatctctgaaggacatcaaaatcacataatttttaattgagaaatagtagacacaacctaaatctccaattaagtaaactgtggtacaagcagacagtgaaatatcatcctgccactaaaaatggtttctgaaaaataatgatgtgggaaaatacaaataattaaatgaaataaaaagaattactaagtttgatctcaagaaacactagaaaatatccttcatatggctctgagtgttggaattgtggtgatgtttctgtatacatttctaaatttttcgagttttctacaatatgcctatattatatagaatttcctaagatgaattaaaaataaaaaaggctaaagcatagaataaccttccccaaacacacaaggattttaaatgaattgaaatttcctcatactagtaattttgtgctttttttttacagatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgcgtgtgtgtgtatatatatatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcataatgtttttgcactaaaggctcaaagtgtgagaacctgttctggatttgtttgaaattatttcaccaataaagatcataaataaatgtttctttcaagaaaatatatttggatggcctttttaaagtaacaggatatttaataagagtcctagatagccagcggagactttaagaatcattgcctctagctgggtgtggtggcatgcacctgtagtcccagctatttgggaggctgatgcaggagaatagcttaagcccaggaatttgagtctgggagtttgagtccagcatgggcaacataacaagaccccatcccttattaaaagaaaaaaaaataattcctcatttcatcattggtctttatatgtagccacaaacactgacctcatgtaggcaccttaccaatatatgacattaagtgagagtgaatcccttaggactggaacacttcaagctcaaccaactgactcagttgtcattcttcacaaaagaatagtagaggatcatgtaaacctgagcctaactcttgttccagtatgaaagttgggggagagcaccagccacctaggaaaactgtatgttacctttttactcaaaggagtcccccctgcccagtaacagtcctattagtgtttaatttcagagtttgtgtctggtagacctctacctgattcagatttggttttgttgtttcaaccatagttagagacaaattctcatgtactttcagaaatcaatatctgcagccactgttacttttaattgacattaagagacacttcataggttcccacaattcagtatgggataggctttttaaaaagcacatacagaccaggcgtggtggctcatgcctataatcccagcactttgggaggctaagacaggcagatcacctgagctcaggagtccaagaccagcctgggcaacatggcaaaacaccgtctctacaaaaaaaaaaaaaaaaaaaattagccaagtacagtggggcacacctatagtcgcagctacttgggaggctggggcaggagaattgcctgagcctgggaagtggaagttgcagtgagccaagatcgtgccattccactccagcctgagcaacacagtgagaccctatctcaaaaaaataatgatgatagtacacgttatgttaaaggtgaaatgtgcatacagaaggaagagagttggccaggtgtggtgactcacacctataatcccaatactttgggaggccaaggcaggaggattgcttgaggtcaggagttttagaccagcctggacaacatagcaagacctcatctcttctaaaaattaaaaaaaaaaaaaatagg

SEQ ID NO: 37433 - DNA, 49746 bp, Homo sapiens; identical to SEQ ID NO: 37057

SEQ ID NO: 37434 - DNA, 46171 bp, Homo sapiens; identical to SEQ ID NO: 37099

SEQ ID NO: 37435 - DNA, 12097 bp, Homo sapiens; identical to SEQ ID NO: 36116

SEQ ID NO: 37436 - DNA, 64294 bp, Homo sapiens; identical to SEQ ID NO: 36971

SEQ ID NO: 37437 - DNA, 13619 bp, Homo sapiens
atggagaagctgtccgcagcgtctggatacagcgatgtgactgacagcaaggcaatcgggcccctggctgtgggctgcctcaccaagtgcagccacgccttccacctgctgtgcctcctggccatgtactgcaacggcaataaggtgcccccactggcccggggcggaggcgggtggcctgccccggaagtcctgagctgtcccctgcaggggtgggagggttccgggggtggctgtaggaatgggcctctgcaaaagatggtgctgggcgtggggccagcttgaagacctttctaaaggcctggccggctctcctaggcctgccctactcttctaggtctgccgcacactttagaaaggaggaccagtgcggctggttccctccacccctccagccaggcctgagaagattctgggcttctctgagcctcagggcaccgcctccccctcggccacttgtaaacaccgcagacactgtctcccttcttccttacagcatccctgtgcagtcagcacagtgctcatgagggagaggctcagagcaggggctgtacccacggtcaccccactgggaggtgggagccaggccttgaggcagggctggtcctgggccccacggtagcctacacatgaagagccacgcccagaccgacccccagctgctctccctgcatcggccttcaggcgggatgggcagagtttagaggcttagagaaccgagtcgtggcgcatcggagcctggctcggccttccctagtatctgccgtcctgggcagccaaggcccagctccgcagatcagacgctgcaaggctgtctatccgactgcaaatgcgattcacccgtggagatttctgctcaggatccaagttttcccactcgccacctgtctcctgatagcatgtcccttaacgaaaatggcataagttgctggtgcaaaacaaagctttccagggaagctgttggaagccagtttccgggcaggaggctgccagcaactccctgggatggtggccagcccattcccggggccctttaccatctgatggtggaggtgacggtcttgggtgttctcagactgccagctcagtgggttgcgtctgcctctctcaggatggaagtctgcagtgtccctcctgcaaaaccatctatgagagaagacggggacccagccccagggaaagatggaggtattacggttccagatgtcgctccccggccacgaggactgcgggaccatcctcatagtttacagcattccccatggcatccagatgaggggccttcttgagtcccccactcctggccattcctcttcccaccccgcccacgtcccagcagtctgcccctggatcaaggctgaggatgcccatgtggccaagctcaggcccccaggtcccctaaggccagggccatggagggctgggaatggggaggcagtgccggggcttagggtaagctcttagggctgtggcagcaaaaggctggccctccactctttcctgaaccaaggaagccttcctagaggaggagccatcttagctggacttgttctgggcagaagggcaggcagttcagtgggaggaaccctgcggaggggctggagaagcggggccacagcagggtgtgcgtcgaggaaccttgggttgggagtggcagggccaggcgtgtgggtgtcaggagcccaggcacaaggccccagagtcccagaggagactcagatgggccctagccctttcggtctcctgtcttgagccaaggtggatcgtagggcctggggcagggtgggaagataacggggcagcaggcagcgggcactggctgccagccaaggtccacctgtggtggatggaggcatctttttgtcttgttgaaccatgagcctttcccctggtttccctccacttctccacagctcagagggaaattcaggaacattcggggttggcatctcggagcgggggaggagctggagctgtgcaggggcctgtccctgtgcgggctctcggagcaccctatcctggtgtctgttcctcccgcagggccctgagcaccccaatcccggaaagccgttcactgccagagggtttccccgccagtgctaccttccagacaacgcccagggccgcaaggtgagtgccaccatgcgccccgggggtggacggggccctgaccaggcggcaggaggccaggcgccacactggactctgtttctgcagcggaggacagaggctgaggccgggccgagtgtctgctgctcttttctggggacctgctgtaggtacagggagggcagcctggacctcacatagcctcgagggaggaggagaggccatcaccttccagcaccctgccgggtggggtcaggagctcctgagagttagagtgtgacaggcagggaccgggggctgtgttagaccaggtgaccacggaaggctggagcagtggtgtctgcactgtgacatgaatagggactttgtggctgcagccagacccaaggggctgggggccctgctggagtgattggaccctgggcgcccacccccctccgattgggagaggcagccccagggacccccacgcctgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatggtgcggggactgctgtggggcctgggtgagggtgacggctgaggagagtggtgggccctaggagcccctcaccagcaagcgccttcaatgattgagcccctgtgggggcctttgggagagtaggtgtggatgaattgggctttatctaaaggggtaatatgtgtattgaaaaatacacacgtagtgaacaccaaatcctgggagtagtgcaagtggtgggtttgtcagctgtcaagggctctgcaaccctttctctgaatccaagtagttcttcctttggacagggaaccgaggctgcgacctgggaggatgtggcctcctgtggggcagggccggtgcactgcgatggggctggggctggcgctgggcaggttgggactgcccgctgctccccactcctggctctgggtggggacaaaaggccagagggaagctccccttcaggggtaacaaagtcgactgggtctggactatctctgggggccctgagggaggaggtggcatggggggtcagggctggagactgggcgaacacagaaccccctcataaggacaaagctgctttctcccctcccacctccatctgttctctcctcctgcagcctccaggggcttccagaacccggagacactggctgacattccggcctccccacagctgctgaccgatggccactacatgacgctgcccgtgtctccggaccagctgccctgtgacgaccccatggcgggcagcggaggcgcccccgtgctgcgggtgggccatgaccacggctgccaccagcagcccttctgcaacgcgcccctccctggccctggaccctatcggtgggtggtccccaccggagccctgggactggggctgtgcttggggcggacgcattgctgggaccagggatgctctctctagcatctttccagggaggggtcccccgaccccggtcctccccttggcaagcccgggctccttccactgtagagtcagcaacagtgctcacccccgctggggccgggcaaggcccaggaggagcgggtgggcaccttggggaggcgggatcttagtcaaggtgggagggggcagcttccccaaagtctaggcccctgtcccccaccacgggcagatctggcaggaaactcgggggccgagttcagacccagtctcgtcggtattaggcagggagcaggagaggtggctcctacccgctcttacagatgaggaaactgaggcacaggaggtcaagtggcctgccaacatcggggtggagccgggatggggaagcaggcagtgtgtccaggtcaggactgtctggacacaggaggaggcggggtgacctcaggaagaccaggcccaggggaagccgggaaggcagggcgtggtgaggctggaacagcaccccgctccgcccagcccccttctgccctctcacccactctccaggtccaccctctgccctccccgctgcctcaccctggctcagccttccagctccatgccccgccccatcccccgcagccactcttttcaatgccaacctgccaggtccttccccgcttcccaggccttgcagagctcccagccctgcaaagagacaaaccgagcccctctgcggggctcctggtgccctgggtcctcaggctgctggtgattgagccccctgccccccggctactgctgcccctccgggaggcctgtgacccctgccccatgtgccctgctaagccaccttcacctgctcttttggcttgtgacatttaggaaccagggcccctaaaccagcatccccggcccaggtctggtgtctggagagcaattgctcggggggatgaggggtggtggcacaggccaagtggctggagacatctgagggggattctcagagcagggccaggccatgggctgctgctcttgacggcacccccactccacatccatgggagggccccagaggagctgcctggagcttggccctgcccagggtggtcccggcctctgaagctctcccctcctcccccaccacctcccatccccagggtgaagtgataccctgtcttgaacgaacaggccaggcgcagtgactcacacctgtaatcccaggactttgggaggctgaggtgggcagatcacttaaggtcaggagttagagaccagcctggccaatgtggcaaaaccctgtctctaccaaaaatagaaaaattagcagggcatggtggtgggggcctgtaatcccagctactcgggaggctgaagcaggagaatcacttgaacccagaaggtggaggttgcagtgagccgagatcttgccactgccctccagtttgggtgacagagcaagactccgtcttcaaaacaaaacaaaacaaaacacacaaacaaacaaaaaaaccccaccacggtggagcccaggtccctctgcctggaactgagagagagttaacagacgggcttggtgtctcatgcctgtaatcccaactttgggaggccagggcaggcggatcacttgaggtcaggggtttgagagcagcctggccaacatggtgaaaccctgtctctgctaaaaatacaaaaattagcctggtgtggtggtgggtgcctgtaatcccagctacttggcaggctgaggcaggagaatcacttgaacctgggaaacggaggttgcagtgagccgagatcgtgccactgcactccagcttggacgacagagcgagactccaactcaaaaaaaaaaaaaaaaaaaaagacagagttaaaagaccacctccctgtcagtgactcttcagcagagactgtctcacgctgtcctatccggacccaagacagttggctaggggcccggccccagaggggtatgacagggagaaggagggggccgttggtgtttgctgtgtgaaaagatgaattaatcctcccagggttcaaggaccagctaggagcaggattgccatggcttttttgttttttttttaacgtggagtctcactctgttgcccaggctggagtgctgtggcgcgatctctgctcaccgcaacctccacttcccaggttaaagtgattctcgagccttggtctcctgagtcgctgggatcacaggtgcctgccaccacacccagctaatttttgtactttcagtagagatggggtttcgccatgttggccacaggcttttgcatgtcctgcggcccttctgtgtttgttcttaatgtcacaatccgtgctgatgccaggcgcagcgccagggacttcccatgcgagcctgcagctgcccctcccttctgcacagcctctctgagcccactgaggagctgccgtcaccctcaggagccgcctggaacttgactttggaaacaccctctaaacagatcttggaacctagggtgtaaagactgaatcatagtccaggagcccaggggaggctactggcccccactgagagccaggggggcttcctaggggttctttctttcttttctttttctttcttttttttttttttttttttttttttttgagaccgagttttgttcttgttgcccaggctggagtgcaacagtgcgatctcaggtcactgcaacctctgcctcctgggttcaagcaattctactgcctcagcctctggagtagctgggattacaggcgcctgccactacacccagctaatttttgtatttttagtagagatgaaatttcaccatgttagccaggctggtcttgaactcctgacctcaggtgatccatctgccttggcctcccaaagtgctggggttacaggtatgagccaccacgcctggtccctggggttatttctgagctgactctttttttttcttttcttttctttttctttctctttttctttttctttttttttctttttctttttctttttctttctttttctttttctttttctttttctttttcttttcttttcttttctgatggaatcttgctctgttgcccaggctggagtgcagtggcatgatcttggctcactgcaacctccacctcccgggttcaagtgattctcctgcctgagcctcccaagtagctgggattacaggcgcctgccatcatgcctggctaatttttctgtatttttagtagagacaggatttcaccatgctggccaggctggtcttaaattcctgagttcaacagatcctcccacctcagcctcccaaagtgctgggattacaggtgacagccaccatgcccagccttgagctgaattttgaagggcaaatggaagaaggaggccgaggcaggaggatctcttgagcctaagagttcaagaccagcctgggcaacacagcaagaccccatctctaaaaagtttttttaaaaagagggaagaaggagagaggaggagagagagctactcagagagaccaggggtgtatacggtcctgttctgcagtggcacccatggtggccaaggggtggtagcagggattgtgggctgggaagaaccagatctgaaccagggcagacacagaggattggagaggaagagttggattccagaaatatgcaggaggtggccgcaggaattgggagataaggcagagggaagaggccatgcccagtttctgatgtggcctgggcgtgaatgcaaaaattggggtcttctgtgctttgcaagtgagtgcaccaccacagtttgctttacggcaaggccccaggaaaaggggttctggggatgtcatctcaacggcaggtgtgttccacaagaacattaatacatcgttaatatttttgaaagacaagactgggcatggtggctcacacctgtaatcccagccctttgggtggctgaggcaagtggatcacttgagctcaggagtttgagaccagcctgggcaccatggcaaaaccccgtgtctactaaaaatacaaaaaatagccagatgcggtggctcgtgcctgtagtcccagctactcgggaggctgaggcaggagaatcgcttgaatctgggaggcagaagttgtagtgagccgagatcacaccactgcactccagcctgggcaacacagcgagactccatctgaagataaaaaaaaaaaaaaaagaagaacccaagggagggggcactgcccagcacaggcacagtcccatcaggccctggggagccatgccagggcgttctgcccagcacagtcacacctaaaagggtcctcagccgaaccccatccccttgaataccagctcatgacggctttgagcagaacatgtcacgggaacggcattgtgtagaactttttattaaatggcatttaaaatattccccaggactgtgtagctggggaaacaccacaaaatccattggcccggaacataatggctcaatggtacgaaacaaatgcattgttaaaaaggaaaaacagcaactgttgcggggtaatgacttgcagatgactcagcaggccaaacatcaaaggaattcggatggcagcaggtgggcacaggcagccaggaagcacccctccctcgctctcacttccagcgatcgctttacctccctggagtgtctaagccacccatttctctccatcatccctgcaatccccaagcaagaaccaccttggtctcccgctgggatgtccgtggttcctctctagctgaactctccatgtccactcctgcccgtcgcccattcccctctcagtatccagagggaccaggttctttgttctttttttttttttttttttaagatagagtctcactctgttgcctaggctggagtgcagtggtgtgatctcggctcactgcaacctgcagcttcaggttcaaacgattctcctgcctcagcctcccaggtagctgagactataaacgtgcgccaccgtgcctggctaatttttttgtatttttagtagacggggtttcaccatgttgaccaggctggtctcaaactcctgacctcaggtgatccacccacctcggcctcccaaagtgctgggattacaggtgtgagccactgcacccagccaggaccaggttctaaacctgatcacatcacacctctgctcccaacattcaggaacttcacactgcaagaacagaatctaggttcagacaggtgtggcggctcacatctgcaatcccagcactttgggaggccaaggcaggcggatcacttgaggccaggagttcgagaccagcctggccagcatggtgaaatgccatctctactaaaaatacaaaaattagccaggcatggtgatgggcgcctgtaatttcagctacttgggaggctgaggcaggagaattgcttgaacctgggaggcggaggttgcagtgagctgagatcacaccactgcactccagcctggacgacagagcgaggctctgtctcaaaaaaagcaaaacaaaataaaacataccaacatctaatctctataaaatatttttagaagttatccaggtgggccgggtgcagtggctcatgcctgtaatcccagcactttgggaggccgaggcgggtggatcacttgaggtcaggagttcaagaccagcctggccgacgtggtgaaaccccatctctactaaaaaaaaaatacaaaaattagccgattacaggcatgagccaccccaccaggccatgctttcagttttcaagaaagaagacaccattgttgccaaaggttttggtaatttgagagatacaatgtatgttttctccatgtggatcctagatagtaaggatctgttgaatttgaagtatctatccagaagtattttgggtacatgtttaaggattgtaaaacagtgtttctatttctggatataataaatgtatttgttaatataataactgaacagattagacccataaactatttacagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccagtggtactgagtctaagcactgcagtgaaggagttagtagaaaacagtctggatgctggtgccactaatattggtaagtttgggagagttttaagccacaagaaatgattagtgtgtgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaggccagagttcaagaccaacctggccaacatggtgagacctcatctctattaaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgttttttttttctttttttttttttttgagatagagttttgctcttgttgctgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatatacatatatatacatatatgtatacatatatacatatatatatatacatatagacatatatatacatatatacatatatgtatacatatatatacatatatacatatgtgtatacatatatatacatatatacatatatatacatatatacatatgtgtatacatatatacatatatacatatatatacatatatgtatacatatatgtacatatatacatatatacatatatatacatatatacatatatatacatatatacatatatatacatatatatatacatatatatatatatttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattattatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtga

SEQ ID NO: 37438 - DNA, 15989 bp, Homo sapiens; identical to SEQ ID NO: 37146

SEQ ID NO: 37439 - DNA, 96336 bp, Homo sapiens
ggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgtgagtcctggggcttcttccttcccgtgcgggttgtcaggcggggacagcggccggggctcttagcggggcgacggcgggagggggccgggctgccgccgcctccttccccttcccctcggggccaggagtgcctccgtcgcgttcccggttcgctcccctccggctcctggccggagcggcctcctgggactggaggttgggggaagacacgcggcttctgggacccccacctcctcccttgcgggagggtgctgcggcctcccgctcccaccttccccggctcaggatccgggggacaaggatggggggcgcccgggatcccattgtccggatccaggggaaggggacggcgttcaggacctgccccttcggactgcgatcctctcctcccgtgacccgcggatcctgggggccggggaagggcggagaggggttgggggtgcctagatgcccgagctgggtctgcagggaggagacagtgctcgggacccctctggcccaggtcggatcccggaaggaggggcggcgctcgggacccctctaccctgctaccggatcccgccgagggtggaagggtgggggcaaggggtggggagggaggaaggggtgtcgggctgactccccaccctccgcttcctctgccgccggcattttctttcttattattgaatgttaagtgtaaaaataacttctatattttctatttttttttttctctcttattccaggaagagcaaccgaggtttcaatctgcggtacgtctcctactctccatttcatttttatttccgttcagttctattcctttttggggtcagagagaaaaagagatcgtactattacttttaatattgtagtaaactctaatgttaaccactaaggtgaggtggggcctggttctggagggtgggggggttgcaaatcccattattctagattctcaggtgataagttcagtgattctaggtgagtaagaggagctgtatgcaaagaattgaattgttctgtagttttcagataggggatccagatgccactatgtaagtggaaatgagaaatgcagcattctggtctggtagtattatttcagggcaaagtggtcagaagatttatttaggaacaagtaggttttaaaccatatctgtataattgtgtgaagctgaagccacatgcggtaatcgcctttaaccaagtcatgtgactgctatagacccgtagaatctagcacaacatggtattctaatgcaaaaattggaaatgtagaggagccaaacgttacatcatcaaagtgtcacataaagttattatggtctgattctctgtatttgaagaaaaggtataaagaaaattaaaaaatagctgaagaaaagtggcattgcagagacagctttgctgaaaggtgatggatgagaccatagagtgttatcaataatttcttagggttttgatattaatgttctcagtagatggttctgtggatttagataagcactaattccatgtctttggagtctgagacagtaatatggatgtttcatgaatagatttgagggaaaaaagaatacacacagaataaatcagaatcagcgaggggaagagaaataagtatatcagagtgtctaatatttgatagttgggagcagtaagaaatgtatagaatgggggtaaaaagttcaaatgcccatgagggccataaagaataaagaaggaagaggtgagggcttgggtactggagagcagtgcctcttctaaaaagtcagcactactgaactccagtggtttgttagtaggagtgaagggtcagtattgccagatcttcctatttttaattttattttatttatttatttttgagacagagtctcactctgtcaccaggctggagtgcaatggcgctatctcggcttactgcaacctccgcctcctgggttcaagcgattctcttgcctcagcctcccgaatagctgggactacaggcgcgtgccaccacacccagctaatttttgtatttttagtagagacggggtttcaccatgttggccaggctggtctcgatctcttaacctcgtgatctgccagcctcggcctcccaaagtgctgggattacaggcatgagccaccacgcccagccgatcttcctattttttaagaaagattagaaatctaaaactttatgttatttttctgatttttaaaatgatgtgtggaacaactgtttgggggcttgttagaatttgcaggatgtcactttgatacctctggtataagaacttgataaccacagggtaaaggcaagccatctcagttatacctgctcttcattagagcaagcaaagattgtgcaggttgtctaagcagataggcattaagaaaacttatttattgagagctgatatttccataaaatccggggatgtagttgttccaaaagtcttaaaaattatccctgggtaatagtcattaaagataatttgttttattttatttatccttgaagtattctcatatacttatgcatatatttgaaaattgaattcctttttcacatttacttttatccttcatgtttggggcctagtctgttgaaaactttttttttccctgcaagtctccagttgtaaaatctgtgctagggcttgatcagagctggagggtaaggatcgtttagccttcctttgcagaattatcctttgaattgaaattatactgacttcccagtaagagaaagttgtgttttttttgtttgtttgtttgtttgtttgtttttttggtgaaattttggctcgcagttcttgaaagctttctgcttttcaaaattttcatccatatgatcgttgatataaatttgttattaaattattataatgtttctgctttcctggaatgctaatctcattgttttgtctagatgtttttagtttgctgttaaggtgcctaggatttttccttttgattttgggggtaggcaaaggaagttggtttgacactttgtttttaatttaacacatctatttgttgatatttctaaatattactctgcacaatgtaattacaacagcatggagagaaaaagcagatatgttataaacaaattttatagtatatcaaacaactattgtgactgtgtagggtaaaaaggattccattttttcccctctgtgaatgcatctgcttacttctcaatatttaatatggataataaatatattttttaaaatttaagagggagctattcttaagttttgccttagaaaaaaggtttaaaaaaagatgtggactgtgaacaaccaaatacttaggtattcaggactacagaagatgttgaaaaagttatttgaaaagggttctgtggatcctaatataaaaacattcatgtatgttttataatgtcactacaatatataggccttactacatgagaaatgtaagatactgagaagagagttaggaagttaggctaactctaacagaaagtgaaactgatttggcaaatatttttttctattgcttcagtacaaacggaaaacagcttctccaatggccagtaagctttgttaaaggaagtaaccccaaagagtattcttactactaaattcagtacatcgcaaaatcccactgatgttatttttattatattttggagggaagaggttgcattttaaagataaatttgtgggacaggtatattatattgcaagggcttccttttgctttatttctgtttgggaaatttctttaggaaagagtgtaagtatacaggaaatgtatgggttagtgtgttggtcaggaaatgcaattttttttccagtgaccatccttgatggcacctgactgagttgcagttgcagtatacttgtgaggggtttgaaaacagatttgtgcaattccacttctggacctttctggcatgaaatatttttaacttctcagagctctttgcttctttaggaatattcagaagagaacgagcttggtagcctccgagattggaattcactcaggaaactactgtctgttttacctgcagtcagttgcatggcaaaagtgctgcacaatgcatgtactttttctctgcttagagtgttgacagtgatgcttacagtgataacaaatgccagagttagttcctaaatgtgcctgtgttagggtaaaagttgttcttatgtctaaaagaatttttccaagatgccagtaacggtgaaatagttggtcaaagaattcagcttggtttttaattaaaatttcctgaccaaggcatccttctctgaaatggctatagtatgaggccctgtttggattatagcatttgccagttattttaggcaccaaaagaaaaaagtttgaaaacaaatacatacattagataatgttggaaatgtataccaggcaatcagctacaagcaggacaggtattggaaaattgaaatccatgtctttctcttagggagcttggtgagtttatcccatcctacctgcctattattttatgttataatttttgggttgattaaaatgaatattttaagttgcttagaaattgagctttatcctatcttgttcttatctatcagaagtaagaaatagatcttttcggatgagatttttgggtctgtgtattctcgtgtccttagtctctaataagaatagcttgataagaatcataagcaacacaagcttccctctaaaatacaaccttcacattttgtaaaggtagtaaatattgagtgggcaactaattccctatatgctgagaattttctgtattagaattgagatggttccccttataggtggggttagctgtcaggtagcctgtaagacatggcattgttctggagaaccttgtgcatcctggaataatgaagcatttatttccccgtgctatttgcctagaacttggaggaaataagattactgactgatgtgatgccttgaacaaagatgcagtctctctgcagtaagttggaaggaaataattttaagagatttccctcaattttgaacagacctccttagcctagatgacttcttgccaacatagcaacttcttggctaacaaaataatgtttgtcttcaacatctaacaacacttaagatacacgtgcttggtagtgtcaaagatggacaaattgtaggtgaagatttttattctgtctaccagtgtggaaagttgggtagaaatataactgagaggctgaataaaaactttggcagagatgtcaaagctggaagtgatttggtgcgggagtttctgttgagcatctgtggaccactgcatagccccttagtatttctgttagggatgccctggaggaagggttttctggcagacatccagacgtacaaatccagcgtactagaagagtgggcagcatccagccactgtaaccataggatgtgtaggggagatgtttgggagcctgctgtacagtccaagaatacctctgtggtctcctagaatagggcctaattaattccacaagggggttttccgtaccatttgttttcattactgaacatcattctcagtacaggctcatctgagtagagttttatttgttcaagacaattgtttgggcttgttttttaaaaccagttttgcatttgggggaggatattagatgccttacactgggagtcttcacccagtttttcttcttcaactctgaaatcttggccctctcaaaaagggttgccagcaagcaaagacagttaacaaggcagtgataaagcctgcaaactagtcctccaatgggggtggggatgaggcgcgggcagtgttattggtctgggtggatctgtggtttggaaatgtttcccacagagaattctcagccttgtgtaaaggtttttctgtttttcatgtgctctttcaaaacattagtgataacatttaattcacagttgcctggaattaggcttgttagttctgcatgtttttaacttgttctttcaaatcaagcttggggaagagaaaaatacatccttgccattgtctctgagagatttaaaattgactccactagtagctcagggatggacatggcagcagggattggtgtaagattccactcttctgctagttaaattgggcctggaaccactacagaaattccatccactactttgagaacaacagtccccagcccaggctttctaccaggcagtggactgctgcctttccttgttgagccaacttctcaaacttggctggctccccagatgagaagccaagatttctgctcatgatctacagccaagttcacttacaatcctccaaccgagagacttgtccatttgagtcctttcagagctcagtgaatgggagggggtagtgcattgtggggatgattttggtgttagattatacttagctccacccctttagtgcaggtccacgtgaaaccaagtgcaacttcattctagctgtttgagatttgcagggctctcccagaaagaaaacagacaattagaattttatttgtatcaacaagagggattgtgggtaattctggtgcacagctcttagctgggaggagggccaagaatcagggtgatttagtagacaggagtatcttgggctgctctggagaccaaagatgggcaattaatttgcatgtaaataaaccaccttaggtagtatatagcaaacaggagccgcagacacatgccaaatattgtctcttggcctttaagctccttaggtatagtcgcagcccaacttatctttatgtagatgatcagagggaacaacagtaagttcaaaaggactagatacttaaataggttcaattctgtcgcactatttcatgctactgttagaaggcatctataattttgcgctaaagttgtatgatacagagtacctacctctaccctcaggttatgtggtgttccaaacttgactgtcctctcagcttcatatttcatgtcactatagttcagtaaacattcattttacagtgaatccagacttaacaagattaggacaactttagaagtgctccaggcatctgccccaaaaagagagatatgctatggagaaccatggttgtcatgggaaccacatgtccagttcaacagagctgtaggtgaggtattatgtttaagagaccaggaagtaactcagatgactacaggtgctcccagtctcctcttcctctgtaatgactgggacttttaggattaaataacaggagaatttcaagtcctttcgttttcacaactcttgatagatttttgtctgtacatcttctctagtacaaggattaatgtgaggcagcattattcttgtgctaagccaagttatttactcttgttccattttttgaatttctggccctctgtttgtatagatttaagctacctgaacttcccatgtacagactggctctctagattagctcagtgcaacgttgtgcattcaaggtgaatgttcagagcataatttccgtaattcctagagtgtaggtgtgatgaagttcttcttgctttgggttgtttgtgttccatttggaggggagacccctctgatggggacctgctgaagtgctcttatcatgctctccagcgctatctcttctgcctgaagccagagcattttgccattcctgatttggtgttggcagttttggtccatctccagctgaccgttctttgtgattccaagcaggctaaggctttgacttggatatttagatactgccagttagcctgacctgccacaggtacctgagagaatttattctgagtatgtggtgtcagaagttgtgccctctaagaactgcctgtcaggcactgcctgtgtgcaaggaagcccttggcaggatagcaccttggatctacttttaaaaaataggaactcagaattcagttgtcatcttatcagctctgtcataatgatctcagattcatgcatctaggttttatagaggttttagcttctgttgtatgatttggtgagaaggtcttaaactagtgccttttagtgggcttgggactcatggtgatggtttcacattaaagaagcaccagtgacttaactctttcttcccctggacacccatctggggaatctcttacagtggaggtgatcacatcttaagaaggggccactggagctttctctagtcacttcctaaccacagactggtggctcttctgtcacataagcaagttgggggggaccactgatgttacaggagagtcacactttgtccccctgaataacttttattttacttatgcatgagctggatgcatcgagctactttggatgttcctgtcgcaagcgttgctcacccctttctccccctttagcagagcctaattctggagactcctaactgcccacctcgagaaatccttcccagtccactcgccagggacagtgctgacagcgtgtacttccaggctgtaccccacccaccttgtaccaagcaaaaggagtgacattcctaatgtgttctttctcccattcttctaggctgacaaacgggctcatcataatgcactggaacgaaaacgtagggaccacatcaaagacagctttcacagtttgcgggactcagtcccatcactccaaggagagaaggtgagtttcctgagaaagctgagtagctggccactactagcttggaacttgttgcagagcttagcagagcactcacctattgggaaggaaatgtagtcagagatattcaggtagcatggttgccttatttttgactgtttggaggatcactgcacaccttacgtactccagtttatccttaacaaaatatgtcagatataatggagctatttgtgagataatggtaggagttatcttttaaaatttgtattatttgtaataaattcaagaaattataactatacactatagtataaagagtggccaagagttcgtttgggataacagtaaagattccagaggtcattaataccctagacctccatgagaattcctttcctatggttcaaagttaatactttattgtaaatgagcacttgcagaaatgtgtgtaatgtatgtgaaaaacaacctgggcaccattgattttccagccccaataattgttatttccaaggcgtataaagagcattttaagctgtgggacaaaagacttgagtgaagagacatgttcatgtgaaacagaaaaaaaataaccattcttccccactcccttctggaacctagtgttttccctggagggctaggcaccagctgtttctacatttgaaaaacaaaattagaagctttgagtaaaagcctatgggttagggtcactccctggaatttggagaaaacatctgcatggctagttccatccttgacagagagtgtagttgtctgtagcaattcattggaataactggcaagctgggaagaggacctgtgtttttgctttagtgatccagtgttttataaagaaggaactattctgttaagaacaatctttgcttttgggtgcactttgatttagttctgtggtgggggtcctggatttgtttggttatccaagatcaaatttggaacccttatgctttcattttttatattgtcactctggtaagttatggcctctatactttatctaaggtgtggctttccatgtggcgtaaacatggagaagttctgacctttataaagaacaaaacaggccatgtacatacctggtattgcaaaaccagaatttgccatgggttaagcctacttagtgtggacttgatttaatgaccttaaaccaaggtacttacctggaataacaaccttcctgggtacaacactaagtaccacggaaatctttatgactagagacagactcacccctttagtcaaagtaaacacatgccaaagattatctcttaggcttctttgacctgttgacagttggtgcttattcctgtaccatagtatcaattaaaattgctttggtaaactatatggaaaagagctgccttctcctaagtctcacctaaccaggagtggcactggggcagtgtttctcaaggggtgagttgcggaccacccacatacgattcactactgaatcagcctttctggatggaaacctgggaatctgtatttataacaagcagtcagatgattcttaggcattcttaagtttgaatacattgggagaggtgggtcataggatcacaactataccttttccttatccagcctattttacaatgccataacattcttccttaagtccttataattacattattctaaatcctattttctcctttctttcttcaaggaagttaaaggtttgaatttggtagtcttacaaatggaatagtctgtcatttgttgtggctcatttatttactcattcatgccattcaacacatacttactgagggtctgctacatgccaggcactatcctagatactgggagtacagcagtaaacaaaacagacaataacaggagctcttgctctgatgaggaaatgattaaaaaatgaagtaagaatttaaaatatatgtattatgtcaggtaagtaccatggagaaaaacagagaagaagagttgcaattttaattatggcagagaagaagagtgttgctggcaaggtgacattttagcaaagctttgaacaaagtgaagcaaagagtagtgcatctgtctggtaatgagcattccaggcagagggaatgcaagtgtggtagcactgagacaggaacctgtaagcattcctgggccaggcagggaaaacagaggccagagtgggtagagtggaatgagtgaagggatggtggcaggagatgctggcagaaaagtagcaggactaggagagaggagtggtccaggggaaccagattctagagccagtcaacaaaaccccaatttgagaatttactagataccattctaatttcagaatcctcctatcctgtgttataatccaaatatgtcctactgacagtgaatgaaggaaatgtctataagctctcaacctcttcctctttaaaaagcgagctgccagcgctgtttcataggtgccgtgagtcgaacagaatattttggtcccttagacttatcagttctcactaaacctggcgtttttttaagtgtggtatttgaactaaaggaaataggctcattcttagattgtggtaattaaggttatgacattatgtaaataatcatgaaatgattattttaccatgtgagttttgggaaacttagattcttaaagggaaagcctttgatttgggtctctctgtgttccagtctcctttgacttaagcatctttatgtttcagctgacttctcccttagcatttggattatctgtcatatgcgtcctaagccttttgttttttaaagagaaagcaatatgttaattgaattggatcctaaccaataataggggatacttgtgtaaaaaagaaagaaagctttaaatgtgggacccaaactctatttaccctttgttttctgtatttctactataaattaaacattttaaaaaatggttggctgggcatggtggctgatgcctgtaataccagcactttgggagacaggcaggtggatcgcttgaacccaggcgtttgagaccaacctaagcaacaaggcaaaactgcatctctacaaaaaatacaaaaattagttgggcgtggtgatgcttacctgtagtcctggctacttgggaggctgtggtgggaggatcacttgagtctgggaggtccaggctgcagtgagctgtgatggcaccgctccagcctggatgacagagtgagaccctgtctcaaaaaaataaaaaataagaattacctttttcttgaggaaaaaaatcagtaataattgacattgtattgcaatgtaaaattaaatccacacagcagttgtataaggtatggtactgttatttgacagttagttattactgctgttgctcctgtcagtgttgttaacaggctcaagatcactatcccatctgtaacaggacaggggctagaactcaggattgccagttgcaagttccatctttttcctataccatatgtgtaagcagtttaaggatattttaaagaaatcttgcttaaatacttgtatcttgtcattgtcctgggagcttcccctggataggcctattaatcttggcagtgtgtcataccacggctactacagaaatgctatcctctgaggtggcgtatgtaggtaacactgaaatgcagggtattaaggatcatttaaagcctataatttctttctgagttcacatagttgctctgagctcaagaaaatagaccattacagttggtggttcatttgggttttgccataggtcccagagttagcaagtagaccctcgaactctgttgtttgagtcttttgtgttccttgcagtttctcaactgtatgtggagttccactgttgttccactgggaacaataggatggaattagaatcatcagccagccaaccagagtaatggagtaagggcaagatcaactgtggccccctccccgctttttttttttttttttttttttttttttttttttttttttttttttacagagatgctacttttatagaaagtattatttaagtgtccttgcttgggtactagggagtgttacacaatggttcactggcactaagctcaccatacttatgttggggagcaagacctgatagccagcctttacatgggagtataattctgtcctccatctcataagccccagtacctgagccagaatgattataaccaaccacactgtctctttatcatggatggctttagcagtaggttattttcatcattgccatttgtagctctacagtggtttatagtaatttctcatcttttaagtctctccctcagtgcctgttgttatcaaactcattgctctctcaggcagttgagctctgcatttctcccttatggggagagctgtgttggagagagagaatataacttcaaatgaaaataaagaaaaacagaatttcttgattttgaggtgagaatttgagggcactgcctctgtcagttcctatcacagattctggcacatagtaggttctcagttagtaaattgtggtggagagagagagccagaggaaacagcaggcttgctcagccattaaagaaaacagcaacagtcaatattatgtgctcaactatataagtaagaccttgtgagtgctgtagaggttaaaagacataatagatggtgtctacccttgagggtcttgctctgttgttgggaaagaggattacatctaacaattaacaataatgagataacatgctgagcatcagataagagctttacattgagttaatctcagtttcatttccattaaaatctggttttcttaacaggtagatgttgaaaccaaatataatagttcccttatggcagggaacatgattcttaaggataaaggctctcatagcatttatacttttatgtacacacatttatatattatacttaatatatgaggttttatatatatttgtgtgattattaaatgactgtctgctggcactacactacaataagtaccgtgaaggcagggagaatgtctccttttggttatatttcttccctcagtgcctgcacatagtagggagcatagtgaatatttattaactgaggggaggaatcccccatcaacctggccacattattttgggagatggctcattcctgttgatgcgtttaaggctgacagttcattcggtaacctatgtctatagcatatctgagctgctagagggattgtcgtttaaatgaaatgtaaactatagccctatccacttctcctcattactcattaaggttatattagctagtcagactccaacttgggcaattatctttttaaagtttctacatcttaaattgttgcccatagttgcccaagtctcccttaggctccaggctcagcaattgtaaatgcatttaatttcttataaattatttgcatgctgctgaaaacctccaagggcttttcattgcccatttaggtaaggactggtattccatgttctgtaaataagatacccagcttacctacctgctttttcgcctccttcctgacattaaccttccagttactatacacccttgtattagtccgttttcgtgctgctgataaagacatacctgagactgggcaatttacaaaagaaggaggtttagtggacttacagttccacgtggctggaaggaagcctcacaatcatggcgaaggcaaggaggagcaagtcatgtcttacatggatggcagcaggcaaagagagagagcttgtgcagggaaactcctgtttttaaaaccatcagatcttgcaagacttattcactatcacgagaacagcatgggaaagacctgtccccgtgattcaattacctcccaccgagttcctgccacaacacatgggaattacaattcaagatgagatttgggtggagacacagccaaactatattattctgctcctggcccctcccaaatctcatgtcctcacatttcaaaaccaatcgtgccttgtcttaactcatttcagcattaactcagaagtccacagtgcaaagtctcatctgggacaagacaagtcctttctgcctatgagcctgtaaaatcaaaagcaagttagttacttcctagatagagtgggggtacaggcattggataaacacagccattccaaatgggagaaatcggtcaaaaaaaggggctacaggcctcatgcaagtccaaaatccagcagggcagtcaaatctaaaagccctgtaatgatctcctttgactccatgtctcacatagaggtcatgctgatacaaaaggtgggttcctttggtcttgcatagctctacccttgtggctttgcaaggtacagcctccttcctggctgctttcacaggctggcattgagtgtctgcagcttttccaggtgcacagtgcaagatgtcagtcagtggatctaccattctggggtctgcaggatggtggcactcttctcacagctccactagagagggccccagtagagactgtgtgggggctctgaccccacatttcctgtctgcactgccgtagcagaggtcctccatgagggccctgtcccttcagcaaacttctccctggacatacaggtgtttccatactccatcctctgaaatctaggcagaggttcccaaaccccaattcttgacttctgttcactcccaggctcaataccatgaggaagctgccaaggcttggggctggcaccctctgaagccgcaacctgagctctgcattgggccctttcagccacgactggagtggccgggatgcagggcaccaagtccctaggctgcatacaacctgtggaccctgggcccagcccacaagaccagtttttcctcctaggcctctgggtctgtgatgggaacagctgctgtgaagatctctgacatgccctggagacattttccccattgtcttggggattaacattcggcttctcattacttatgcaaatctctgcagctggcttgaatttcttctcagaaaatgggattttcttttctatcacattgtcaggctacaaattttctgaacttttatgctctgcttctcttataaaactgaatgccttttacagcacccaagtcacctcttgaatgctttgctgcttagaaatttcttcctccagataccctaaatcatctctgtgaagttcaaagttccacttatctctagcgtaggggcaaaatgctgccaatctctttgctgaaacgtaacaggagtcacctttgctctagttctcaacaagttcctcatctccatctgagaccacctcagcctggactttattgtccatatcattatcagcattttgggcaaagccattcaacaagtccttaggaagtttgaaactttcccacatttttctgtcttcttctgagcccttcaaattgttccaacctctgcctgttacctagttccaaagttgcttccacattttcaggtatcttttcagcagtgccctactctactggtaccaatttactgcatttagtccattttcatgctgctgataaagacatacctgagactgggcaatttacaaaagaaagaggtttaatgacttacagttacatatggctggggaggcctcacaatcatggtggaaggcaaggagaagcaagtcacgttttacatggatggcagcaggcgaagagaacttgtgcagggaaactgctgtttttaaaaccatcagctctcacgaaatttattccctatcacaagaacaacatgggaaagaccaacccccatgattcaattactgctcactaggttcctcccccgacacatgggaattgtgggagttaaattcaagatgagatttgggtagggacacagccaaaccatatcaacccctcttctgtttgcccaggaatttcattctcagcttatctgagtgctttgcttttctcaaggtccaaccccagccacactgcccaggtgacttgggggttccatattgatgagccctgctcacaaggcctacctgcagcctgtcctctatttcctgagttccccccttccctcagtctccagctccttgccttagaggccaatatcaaatactgcccctcccttagaactctcccttgaacctctgtggccttttgtgggacctctcctcagtctccctaatttctgtgattaacttatcacctaattaaatggtatgctcctgtagggcagaaatctaattattccttctgggagactgtcatacagaatgagagaggtctcactcccccaagagtactagagagctcttcacctaacatttttcgcatcttgagattcggaaggatagagattgattactaggccttgcctttagcatttttgttttctccaacaaaattgcaaaaactttagaaaaatgggaagaagaaaaaacatgaatccctccttcctctaacacaactacagccttccctttggctatgacaaatgctgcccaacagaaatttagcatgagtcacaattgcattttaaatataacttaaatacaattaaattttcgagtagaaccaattaaaaagttaaacaggtgaaaatttgaataatataatttatttagcctaatattcaaaagtaagtatgatctcaacatgtaatcaatatatttaaaattatttattcaccaagtctttaaattcaacttaacagcacatctcaattcagagtactcacatttcaagtgtttattagccacatgtggctagtgactatcagatcagatagtataatccaaaaatagactctccgtaccccccctgccccatttaatgtgactaaaattagacatcatcttaaagtggatgtgaaaagaaacctgcctcctttttttctccccaaaagctgctattgttcaatccatggatttattgatggagtctaacaagcaaggaaatatagtgttatcaatttgtgtattccttcctggtctcttcatctacatgctccccacagggaaagtactatttatagcttgctgcttttacataatatattttttcgctaggtcatacagtgtgctcatgtttagtcattaggcatgtttcttttgggcaattggggttgcattcaatttttaaaatttaaaatttataattataatatggacatctctgtatatgtagccatttccatagactccaagaagttggatttctgggttgaggggtgcgagcatctgacctttttccgtgtgttgccaaaatgctttccaagaggattgtttttatatcctctttcttccatttctttctttttttcaagcaaattctaaagagtagtcttttggtagtgttttgagagtaccagtttcattatcactggaatttttttttttggaagagggtaactaattcagtaaacaaaagttagtaattttgtattctatttattacttgtgaaattaattgcttttccacatgtttatttactagctctatttcctcttttggaaattgtgtactcctgtccttcatcgtcaaagtttgatgcagaaatgccacaccttcatttcaagctaccaagtgcacaagaaaaaagaatgcaagatttaaaaaatgattgttttgaccccttacacaaatgtcttactcctggctttaattaagctgcttgagggctgatagctctgccttaccctggtaatcagcaaaatggtcctgtggctggggaggccctggcagcaggaagccttcaaggagccatgggtctgtgctgactctggccttacaaccttccagcctcctttgctggcattgatggggttccatttttgaatgaactagtttaatgtggatccaaatttattgtgcatattctttcgttttggttttcaaaagatggcttattcacatggaaatgtacaccagtttagccctgggccctccctttaccttcatatgtgtaaaagcttacacaggtttcagaaaataaatggtttcattttctctaaaataactagtacaaaataaaacagatgtcagttgttgagtccagcagtacctcttttttcatccctccagatatggcattttggttcttaggggaacaagacagctgtaacatcagcccactggcatctgttttgggcactgaagaggaaaagtgttcagtagagttaagattattgtttctcacgtcagcattgggaccctagggaagggcagtggtgttcctaatgttaacaatctagcactactattcttttcctcacctctccccacccactttctaaaacaacttgaagttttacagaaatccaagttactgtgataaaatttataactccagaaatatttggaactcttgccttacattgaaaatttttgagaaccattgctttaaatgagatttaataaccttggacttcgtctgaagcatcagtgctaacaacttcaggagtcatttggggccttaaacggttctatttagaatccaagtcttttgggtctgaggccttttgtgacatatgtagtcagttcttgctgtgatgtgtggggtgggtggatgctgttcaaaagcagaggtctgacagtgggtgcctctgcttgagagggttggccttccctctgtctgcttactgccttgggagggaatgcaaatggacacgtagctgcagcataaacagtaggagggacaggaacctggcagaccctctgccacaccctgggtcccttctacattattcattttgcttttatccttctgggctgccaagaggtaatgaagccagcagtgtactgtgggaagctgacatcccccacctaaccttccacttctgccctccagaccagatggttaggtcagttctctcaagctcgcttgcatcttgaggcttttcctttcaatgtgtttctgctagaagcctgtttagttctcacctgtctttaaaatagaaagaaaaataaccttccttcaatgctgctatcctgctattacaaactaccatttttcacttttttttttttatacagggtctcactcttttttttcaggctggagtgtgttggcacaagcctgtctcactgcagcttcagccccatgggctcaagagatcctcccacctttgcctcccaagtagctgggaccacattcgtgtaccaccatgcccagctaatcttttgatttttttatagagcccaagtgtcttgctgtgttttctaggctggtccccaacacctgagccctagtgatcctcccacctcagcctcccagggtgctgggattacaggcatgagccactgcacctggcctacttcttacttttcaaccaaattctgaagactagtcttcatcattgcctcacttgcaactcaattcttatgcctgttaccggtgcagagacaatttaccattgggcttcggctgtcactcctccaagaaaaccaccttcactagggtcttccatttgacgtccttgtaggcaaatcaggtgactttcgtagtccttttcctcctccaactttcccctccatgacaacagtgtccctgcaattctattgatctttttaaattagttccatagcttcccctgtgttcccaaagtatgagtgtcctggaggcttggattcaaatcctgactcaacttcctattagtttacataacattgggtaaattacagctctgtgtctcggtttcctcatttataaaatagggaaaacatcagaaggttgtgtgaggatgcctgacacttagtaagtactcagtaagtgttagtgctgccattgttaccacccccatcatcattgtcacttgtgttgctatgtgcagccatggctttggagcaagatctcgcaaggctgcccagtatccctttgtgtggctcccagaggtgagagagaggcctgctgagccctttgcgtttgcttacatggctacatgggaggcctggctacctcttcagtcccttcagccaccatccaccctgtctcagggctccatccaagccatttaaagagccatttctgttcacaaagacagactcaaaattatgattctgctaattataaaaactatcaggaaaaaaattttcaggcttttactgagtacccaaggcagcacttgctctgtggacatgttgacttaccaagttctatctgatcagtcacactcacatgaagataggcagttgactcagctgacttagagcaattttcagaaaacagaaactgaaagtccagggttattccatagtccatgccataaatcccagggtttcttgctggtttcgtgtttgctggtcacatattataaactcataaagacaaggaaggccctgcccccaccttcatcctgtgtttggccacatgatcttgtatggagtggaaagatgggaggggaggattgcaggtgagtctagcatttttagcttcagccttttgctttttctttcctggactacatgcacatgcaaatttggggtatttctgtattttgtgctttaaatttttttcttgttgggccttaattcttgttgggtaccctgggaagagtaaaataaagttaactctgaaccattcttttggacttgctgagggatcagggcaccctaagtgaccaggggcacttctgctttcagcagaggatggaggaagggctgtgcttagcattctgaaggcctcgttctgagtttaaaccaatccagccttctttggactcctgttgttcccaagacactatgttctgaacatctatgaattttatcttcatccaaaaattaccctgaaatggaaactgccatccctcacagatctttttctctcttctggcttgttttgctgtgcttactgctcacttttcacttcttgatcctaattccctggtttcatgtataaatatttgaaggagaaactggtagcaaaaaggctgttactcagtctggtcattcattaaaagttatcactgaacatttgcaagtgctctctggtttcagagattgtgcattttttcccttgtcccggatgcacatgggtagttaagagctaatgttgccttctgggaactattagttgaaaaaatagcttttacataggcaaatttaaatagagggatgtaaattacatcagtgatggaaagggtagactttggagggctagatggggtcttagagaatttctagtcagatgaggaataggcaaggtgagaaatgtgtctgcagctacagaacccattaatgacaagcatgcagagcactcctctgtcctctaattcccaaattcttccttgccactctaccacctcttatcaatactaatcatttttcattccatctccagtatccagagaggaaggtattttaattagtcccttctaattatgtgctccttttttccaccccattttgtcacctaataaaccctaataaggtccctttgtagaaatgggaaacagtgtctgaagtatccattgctaggctaggaactctcattccttctgcataagctgactgactcaactaaagaaacgcatctcactttttccccatcccatcttgactgtgctattccaaacgccaccttggtctaacacagggctcaccatttcagataggagcgtgttgcatgcacacatgcagcaccaaggccaatgcgtagcacacagtaggtaatcaccccagccagaagccatctttcccgtggtgtctctagtctctgctagtcaggttacgcttgtcagcactgccctgtgatatttccatgtatagacatatttatctcctcaactagatagtaagtaagctttggggcaaagaagccatgactaatacattttgtttccccacagtatctgcctagtatcttgtacgtaatttgcacctgataaaaatggttgattatgaacaatttccttgaggaaattaccttaagggtgctaaagaggaaagcctggaaattctagtacttgtgaggacttatgaataagcacgggccttacaaacctttctgaaactcagcccaaactgaggcctataaattgagattgttaggatttaatatgagtagatctggttttgctagccacggtgtacatgttttctttgtctttctcccgctgttgtgttctggttgtttaggacccattgggcttgtaatacagaattgtcaagcactccctaccctgagtaagaagctttccggctgctcaggagtctctggctggaaggccatacttaagctactaggctaccccgccttgagcttcgcttggctttgtactattctaccagtttggctggctgcctggccataagtaactctgactatgtttgtagcctggagagaatctcccagacaagtttgatgtctaggggcacagtaacatgacatccatgttattgacttacgaacttactctagcaaggcagtacccaggcaacccacagccattgtagaggtgtggttgtttcctgaaatggcccaatctcatgctcttcctgtgttgacatcaagcaccgacagctttttatgaaagtctctttagccaggaaggctgaagtagtgacacagcagcattgttcagttcggaatagttaacagtggtttcagagtttggctggaatcttgggtcttgatgaaacacattgtacccattcctgtctcaagccaggccctagcagaattagtgacctaaagctttcatttaagtagtattttaatgtttccagacatagccaagctaaagactttaaagcaacctaaagaaccagaggagatgggaggagtacagttcaggagtcggatggctctgagtttaaagccaggccatgctactgtgcagctggtgattttgaataaagcggtgtacttctctgatccttgggttcttagtagagctacctctgagactaatcttgtgagttaagctctgtaaagcacttggcaccttgtatgtcacaaagaaggccttcacggatgcagtggctcacgcctgtaatcccagcagtttgggaggccgaggtaggtggatcacctgaggtgaggagtttgagaccagtctggccaacatggtgaaaccccatctttattaaaaatgtaaaaattagccaggcaacgtggcatgtacttgtaatcccagctactctggaggctgaggcagaagaatcacttgaacctgggaggtggaggttgcagtgagctgagatcacaccactctactccagcctgggcaacagagcgagactacgtctccaaaaaaaaaaaaacaacaacaacaacaacaacaacaggctgggcgcagtggctcacacctgtgacctataatcccagcattttgggaggccaaggtgggcagatcacctgaggccaggagtttgagaccagcctggctaacatggtgaaaccgcatttctactaaaaatacaaaaaaattagatgggcgtggtggcgcacacctataatcctagctactcaggaggctgaggcaggagaatcacttgaacccaggaggcggaggttgctgtcagccaagatcacgctgttgcactccagcttgggcaacaagagcgaaactctgtctcaaaaaaataaaaaaataaataaataaataaagcctacagtagccattattgtatttcttcagccttttcccaccttaccctctcgtttccagccacccaagcagttgctgcaggccaggttccctcactgcctggattgggtttttattttgtcccctgtgctttttctcatattgccacaggcatcccgggcccaaatcctagacaaagccacagaatatatccagtatatgcgaaggaaaaaccacacacaccagcaagatattgacgacctcaagcggcagaatgctcttctggagcagcaaggtgagcacccgagctcgtggggcagctggccctgctgtgctccagccaggtcaggctttggcacctgggcctgcagagtcagagccagtcatggagtatgtgctcagtagcaggcttggtcctgcttcttggggcctgagtaactgagtgttagagccgtcctgaggaaggacctgaggcgccagtgaggagacagtggaagctaggaagttggacatctggagacttgtatcttttctggcctgacctctccccttcttggggctcaggtgctctgcctgcagtagggatcacacctggcatcaggtgtctgaaaagagctttgaggtccttggagtggaatgtgctgtgtaagtaccagagactccaggtgttcagggacagtgagccctccccattgtcaatggtagtccaatcagggcagcctatgggctaggcccatgctgttctcaatgctcacacccgccttttcctacaaccacaggggaaagcgagagctgatcaagttctttgttcctggggaattcacttctcttcctccctcatggaagatgcaagtaaaaggaaatgcaagtaaccacctgggttagaaaacctcaaataaaataaaataaaataaattaaatgggttgaccttccaggctcaagctgagctgaaccaagggatgggcagtgggtggtgtcagtgggttggttactgggccaggcagcctgcatgtaggggctatttgaaaagcccaggtattttatgtgtattggtgacttgcttccaagtgtccagcttgtcattccaagtggatcttgtacacgagagctaagccaaaactgttctttggctgatacgtcttatgtcatcctttcctgctgttgtgtggcctcacaccttgtggagcctcatgctcctgggccagcttctcctctgttattgcactgctgaatcccacagggagctcacgctccagtctctccacggggcttccacggcaggacggtgacatcacaagccttctcttcagagttgggtgggattgcagagtgtctgctggctcccaggtccagctgggaaaggcgggagggaaatgaagtgtgtgagtgaacagccacccgaagggagctacttctgagcatcttgagcctcgggggccaacaagcaagcccttaggaagaacaggctggaccctgagtctgagactcggttactccccaagtctccagaaggcagtaacacactcccttggttgccttttagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatccttcttggtggtggtgtcttcttacccttgttaaggccaaggtggttgatgagagacccctctggaagctgttagggcctcaatgtaagtctgagtgagaagtggaggtggcttacccggtcttgcagaaccaggagcagccataagccagagttgcttcccctttctcagctcagcctgagagagtaaatgggtggtgatggctttgttcattggatgaggcttttgaggttcaacagggatgtagccttagctgtggcaacatttctagatctagtttctgctaagcaagtgacctttgggggaattggtagcccagagctgtggttcaggttctcctggtaatgagtgcccagttcagaggtggctgttctccaggacctttcagtttctagatagttccagtttattaagaggaggcagcagagctgccaaggactggaagtcaagaaggctccaactgcaccgagttagctctactcagactgggacccaacaccagcctgaacttgtttgaccttggaagaaaaaggaattatggccagaacgcagctcagtgttggttttcctgtctggctgacaggaaatactgctgttcctagacccagagaggaagtcaagtcaaatcagttcttggatttgtcaccatctttagagtggtggagagcactgtggctcctatcaattgtatgtcaaatccgtaatatctttttttgtttaatgggagctggggcagatgggtcttgtcaatttgaaacatgatcaagcctccaaaggccatgattacattaaggaaaagaaaaatgctgggaaagcaagatcccatttataaaggcacttcttttcaagatagaggaaagaaactgcagtaaggaagaaatggaaatgagaatcagcttattgcctaaagccctcaaggttaacatgctttcctctttttcattgcccttaactatatctctttgtatatctgggcttaagtatacagttggtttgcttagtattggtgttagaagtgagctgtgggtgaagccatgttgatgcagagatggaaggcatgtgaagctggcacccagtagggagatagcaaacaggaaggggcagtcaagccagcatgaggacaggtggtgtccctgagagccagtccctggctccagtgtattggctggacaaaggattgagtttaggcttctctagatttcagtaaaccagttcagacaaggggcacagtggctaggtggctggttcacctaggaaaatccaaaccacctgattgacatggtgagcggactttggcacagggtggaggtaccactggaagcagcttcctgggcaggaacacagggcaggggagctccgcctggaaactgctcagctgaaaaggccaagtcaaagtcacagccaagcaagccccttctggtatgtgtgtctaggaagcgagtgtgagtattccctcaggataccaaagtcggaccatagcttactctctcacagtaatggtaatctctggtttattttttatattactctggacactcacttacacaaaaccagataagctgtagatttgcttggtcactgtggcaggtggcttcactgaggagtctgttaagcgtgctatttccctacctttacagttgccccaagtgcaagggtatttaaaatggcccagtttttaaagttcttgatacgctaaccccattgtaaaacatcaacaacttcttaggtaaagaatctaagctcacagagctgtcatcttagctgagacaggtttaaaaaacaagactgagtagacaataggagccagagccctgaactgggactgaagtaagcagaattctgtttctgatagtatcatgtgtgttttatgcttggcctctgaaagcagactggctgggttcacagtcctgtctctgccactcggtggctgtgttacttctcccagcctcagcatctttatctataaaatgaggataataatagcactagcctcatgagatggttatgaggcttaaatgagataatgcttataatgtgcttgacctcaggaccaagcaagcactgaggtgcctctgctgtcattatctacacaaagcatgtaaccagggctgactcagcaaggtggaaaaagccagctcccagacacctttcctaaagtgagtaagggttgacttcttggtatatcacaaatgcttcccactcctcagagatgtgccccatccttaccaggcacagtgactaaagagagcaaggtgacaccaggactggactgacaaactcttcgagactaaagcagcccctgtgggtacattaattagatctggtgtcaactcgagtgaggctctgcccattccctcccaccacgattcagtggcatctctcaggtttggacacttttggaggcccaggcagaactgctcagaagccccatgtggtgttactcaaagtgggatccttggatcatgcccagggctgcttgttaaaaggattcctgggctctaacccctctaatctaaagtgtgccgtggctcaccagtcagtttaacaagctctttcaggtggtcctcaagtcactcaggtttgactcccaacagtaatataacccggggaaccaaaaggacgctgttggggaagttaggcacagctgagctgaattagcgaagtggttctgaggtcaggatgaaggtgggggaggcgggcttgttaaatagttcaacccttagagctgccttgatgagtctacgtgctcccagcatgcctccaatgctctagggggctggctgagctacccagtttttaaacttgagaaggaagaaagctgagggctgcctacactagcccctttagaagccccaagcaggggtaatgacatggggcagcactcatttctgtagcatgcctaggctggcctctggtccccaggcaggttttataatccagccagagcaagggtctctctcaggcctggtcaccaggatgcattctcaaaagcctctgggaacatgaaactagagcattcctttcttcaaaactgtttctctagcctgaagaggaaacccaggtaggaaaaaagagtttgtcaatgtctacactgctagatagcgaatagagaatttccttcagtgtctagggtttactagggcagcggctaactcatacatccccaaagttcccttgggaagggaataaaaaatagtttctagttaacttcctcagggagaaaaccaatttggctaagccaggcttaactataggtaggactgggtgactgcaccaggcaggcctgtgcatgggttttggaggctctcctggcaaacccttatcaccctgctggtaagtgttgtccttgcttggtgtttcattggggtcggtgttgggaaggagcccagggagcttcagaatgactgccagagcgggtagggctaggggctctgagcccgcctgtctggactgccatgccagctacaacccttacctttggggtgacattgctctggcttcctgtgccattatgtgaggacaataatagcaccaagtgccattgtgaggcttaaaggagtgtgagaagcccatgaattgttcctggcatttaatactcaataaatactgtcaaatcttagatgtgtctgccatcagatgtcctgggtagtgcagccattttttagttttgttaaaatgtggaatgaagctgggcgcagaggctcacacctgtaatatcagcactttgggaagccaaggtgggcggatcacttgaggtcaggagtttgagaccagcctggtcaatgtggtgaaaccccgtctctactaaaaatacaaaaaaattagccgagcatagtgttgcatgcctgtggtcccagctactcgggagactgaggcaggagaatcgcttgaacccaggaggcagaggttgcagtgagccaagatcacgccactgcactccagcctgggtgacacagcaagactccttctcagaaaaaaaaaaatgtggagtgaataaactctccttttcgctgatgtaataagagtttagtatattaaaatccttgaaaggggaggtaaatgtatgttgaatgctaaaaggcagtaaaaatttgcatgttttctgaaagaacttgagcaagaccacaaatctgttaccttttggagaaaaaaaaggagttgaggaatgaaatatacccttgcaggctggctcagagccattaaccattaacatactggcgactttgccctgttcttcattccagtttcagtttgcatttctgcagtgccgggtggcaggcactgtgccaggtgcagatactgcaagtgcatctggtgtctgccccgtgtttcttgcccagggctggttatgacagtggtcagccatcgtttttcagccttccccttcagggaccccttgagcagaatctgcctggtgggtgaggtggagcagatgagcctcatgactgggccgaggggcccgcatgctctagctcactctggatcccatgtgcacgctcgcacacacaacacacccagcaggatgggcgtgtctagaagaatgccgagcaggtggccttggacaattcacaaccagccgagcaggtcccctcctgcgccctgtgctagatgccagctgccccagcaggcctgttgtgactgccaggccccatttaggattgttttcctttgctgtcctttgcagggtggggctcttgtatacccacagcctgctctgggcaaaattatgtagcacggtctctgctattaattttttccagtaaattaaaggctagagaagaagaagaagaaaaatcaaggatccaatattaagaaatctgagcccaaaccttctactccagtgctgaacatggtgaaggattaagcctcctatcaagaaaaacaagcctgacagcctgtagactgatagagggaggtgtgccttctctccagaaagcctacttctgcaggaacccaggagtatggaatgagccatgcaaagtctgattcaaaaaataacccaatgggcatgcacccccagtcactcatccggaatccggctggcagcctggcagcccggcagcccatggctcccatgcacagtgcttgagagcttcattgtttcctgtctgctggtgccatcaacagctctggggtggcaggggcagatcttgggctaaaggacagtggccaacagctttgggccaaaaggccacaacaagaccagccagctaagaggaggaatgtcatgtccacagcgaatacctactgcagcaaggctgtaggagactttggagaggaaggaccctgtttccaacaacttgaccatgtttcccatccagggacctctgtgcagagagtggtggtgagcaagtatttccaactgggagcccccacagagtcagtggctggtctgtgcacttgttactggactcctagcactgtgcttggcttgtggtgggtactctacaaatgctgcatgcatatgtgcgtgtgccagtggactccagccttgtgatgtaccttcatctctgtgcccttgatagggcggttccagggttgcctctgcgtgagttcaaccctcgggtatttgagcagcacgtagcctcagcccagcattgtgctggctactggggcaatctaggcagcttataaaggctgggccttgccttgaagaagcttagagatgaggttaggcatttagcacaaatgcacgtctgggctctgaatgccagaggagttcaggagatgggccctcagtgagagcggtttggcactatgggaggggcagggccaccaggtcatcgcttctcaagctcttgatgggctctccttctgtcctgcccacaagagcccagccttgggctccccatctagctgtccagacaggctgggggtggggggctgttggtgaagggagggtgggccagagccatctgctctgcacaggttgggtcacgattctattccaccactttcactggtcccttggtatccaggcacatggcagccactgctccagagagtgaggagaggggctggggggatggagcctcgcaaggagcatggacacctagcacttacgtcatcaccatcggcatctgccttacctggctacctctctgttcagcacacctgggagcagcacccttgcagcccttctcccttgacagagctgtgacattgaaccctgccctggtctggtagctgagggcccagcctccccttgcctcctttgtcccatcagcccaggccatcatgggtacagaaggtagcaatgaagtctcacactcggggtaaccaacatgcaatacttatggaaagactgtgtgatcaagggttgagagaatagtatactgaacccaaatgtacccattacatagtgtgaacaattatcaacatgcagtactcgttgaaagaaaagggatgataaaaatgcactattattgaaagtaagaaagtgtggggtctgttaaacagacaaaggagcccactgagaaagctcccaaaggccaaaactgcaacaatttgagcaacaaaataaataatgtagcattggaacataatatgaagtataaaataaacgagtccatagtgaaagaaatggttgaataaattgagaataaacatctcccatgtagaattccgggtagtttatgcaggtgctctgccttcaaacatatggagcataactccccacttctgtttgttgttttgagacagagtctcacgctgtcgcccaggttggagtgcagtggcacaatctcagctcactgcaacctctgcctcccaggttcaagcgattctcctgcctcagcttctcgagtagctgagattacaggtgtatgccaccacaccaggctaatttttgtgtttttagttgctatggggtttcatcatgttggccaggctggtctcgaactcctgacctcaagtgatccacctgcctcagcctgccaaagtgctgggattacaggcgtgagccacctccccacttcttaagcgtggactgcatatagtagctaccttctaaaggacacattcaagaaagggacaaaaagtaaccttatggaggaacctgacaaactacctcagccaggcgatgaagggtaacatcagcataaacatgatgaagcaggttgatagtatgtatccttgatgtgtgatgagaatggtactttacctctgtggccttcctccaaaaaactgttacgcatggtctgggcacggtggctcatgcctgtaatcatagcactttgggaggccaagggaggatgattgcttaagtctagcagttcaagaccagcctgggcaacatagcaagagcctgcctctaccaaaaaaaaaaaaaaaaaaatgtaattagctgcacatggtggtgtgtgcctgtggtcccacctactcaggaagctgaccaggaggattgcttgagcccaggaggttgaggctgcagtgagccatgatccactgtactctagcctgggcgacagagcaagacactgtctcttggaaaaaaaaaaaaaaacataaacccatctagtcataaggataacatcaaacaaatcccacctgagggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttctttagtaatgtatcaaaattggttcattcattatggcaaatgccacctattagtggaagatgttaatagggaaaactgactaatgggtctgtgggaactctgtgtactatctttgcaatttttctgtcaatctcaaactattccaaaatgtttattttttaaaatgctttttttttttttttaagacagggtcttgctgtgtcatccaggctggagtacagtggcataatcatggcttactgcagcctttacttctcaggctcaagtgaccccccatcttagcctcccaagtagctgtgagcacaggtgtgtgccaccgcatccgactaatttttttttttttttttaatttttgtagagacagagtgtggctatgtcgctcaggctggtctcaaactcctgagttcaagtgatcttccagccttggcctcccaaagtgttgggattacagtcatgagccatcacacccgaactaaaaaatacattgtttttttttttttttttgagatggaatttcactcttgttgccaaggctggagtgcaagggtgcaatctcagctcaccacaacctctgcctcctgggttcaagcgattctcctacctaagcctctaagcctcccgagtagctaggattacaggtatgcaccaccatgcgcggctaattttgtatttttagtagagacggggtttctccatgttggtcaggctggtcatgaactcccaaccttaggtgatctgcctgtcttggcctcccaaagtgttgggattacaggcgtgagccaccacacccggccatgcatttttcttattgttattttgtaagcgctgtatttcctcagggggagcagagggcaagggaaagtttccattaagctgggctaatgatgagcgccctgtccctgccctgcctggttttgttcttggatgtgccagagaagcgggagggaggaacgtgaggccacctggccccagttccccagctggtggaaaacagaggcaaggagggttactgcaggaaagtgtgaggatgtgcaggaacctgttagatgtgcctgggccaggttggagaaagctggctgctgtcaggtcagctcctgggaagacggactcatcacggcctcactgagccacacggcatcacactgcactggtgtggccacacacttggtggcaagtggagacctcattagaagggtgaggggcctgccctatttgctgtcaccatccctgacctagtgacagatggcagctggtattcagggcctcagccatccagcctagaggtaaaccaagcatgtttcaccagtgccccctattccccgagacctctcaccttccttcagaggcctgcggtggtggaagggcatgggctttggaggcagcagatacgggctcgggctcaggcaccaccacttgacagctgggaaaccttgggtgatttacgtaagctctccaacctgtttctccagttgtaaaaggcaggtaatacgcctgcttcacccaccttacaaggtgagtcaaggatcaaatgagaggcggtagaacaggagggactgtcttaggggttattgtttgggcagatgaggcaagagtggtcagcactttttaagcagcaggtaaagccttggtcttggggctaattggtggtagagttttgtatatagtcacgccacatcatgttttggttaacaacagaatgcatgtacgacagtggtcccgtgagatcataatactgtatttttactgtaccttttccatgtttagattcacaaatacttaccactgtgttccagttgcctacagtatccagtacggtgacaagctgcacaggtttgtagcctaggagcaacaggctaccccatctagcctaggtgtgcggtagggtaggccatctaggtctgtgtaagtgcactccatgatgttcacacaacgacgagatcacctgactgcttttctcagggtgtatcctcgtcattaagtgacatgactgtattaggttgctttcagttgcaggtaatagtaagtccaactcacattgtctcatataactgaaaatccagaggccacgtgggcctcgggagccatgtgatcagggccatgtttctcagtctcagagcatatgtgtgtgctggcttctcacgctggtttccttctaggtagaaaaatggttataggaggcccaggccacacattctaccatcccctaataggaaagagctgcttttccccgtcatacagtgtccacgacgtctctctctttagactattttaggtcacatgcttgtgctctgaattgatcactggggcaaggacaaatcatgctgactgacttaagcctgagttactcccaacctgaacaaattactggggcaaagagagataaatgaaaattattggcttagccagtcagggcctgggcctggaggtaggagggcatcaagccctggcaaaccttttggctgccacaggtggggaggagtggcatggatgccaacagtgtccctacaggcttctatcccagtaatcactgtttgagagcaatggccatttgcctctctagcatccatttacccctttggcaacaatcctaatttgcatttggagctttgttccttccccgttcccaaaaactacgtgcttctaatgaagcctcatttccctctcaagggagaggcatgtgaccaagactttggccaattggtgcactgtattctccaagccattggactgcttcttggaaaggcacttggtttgattaaagccagtgaaacacaatgatactcgctggaaggaaggctggggtggaaccaagtgtgcctgtctgctgaacctgaccccaacaggatgtagggtctggagctattggtgctgccattttacaaccccatggagagcctgagattgaggctaatgtagaaagatggagggagggtgaggaacctaataggaccagcctaattcctggactctgcagtttgagtcaacagattgcctcttttgcttcaaaagccagtttgggtcaagttttctaccagttgcaatggtgtcttaaatcatattatactttccttcctattcaaaggcagtaaatgccaccaagcagtgcatgtgggcaactagaatgcttggtccaatccttactatttgtcacttgacactaatattacatgaaaagcatcccagtcatgaaaggtatggaagaatgctcaataataccaagaagggagagcagtgtggaactattgtttactggtattattatctcaggggtgtttcccctgattatccatgaggttctctttatgctccgctccctgtagggtctggcaggcttcccaacttatctggtgttcaaggtgggcctaagggtgaaactggagcccacctggatacagagatctgtattagttttgtgtttattgatgggagaaagtatttggggtcatccaccttgaatgctacataaatgtcttctactcaaggagtcacataataaatctctccaaaggtgcggtggctcacacccgtaatctcagcactttgggaggctgaggcaggaagattgcttgagcccaggagctcgagaccagcttgggcaacgtggtgaaaccccatttctataaaaaatacaaaaattagctagctgtggtggtgtgcacctgtggtcctagctacttgggaggctaaggcaggaagatcttctgagcccaggaggtcgaggctgcagtgagccatgattgtgccactgcactccagcctgggtgcatttgagcaagatcctatctcaaatgagtgaatagacaaatctctaggactcaccttgagggctgtcaggaaaccctctggaaaaggatgtctcatggatatgccagtgtaaactctcctgaaataaccctttctcttctctacccagactaactttacctaccctttggggcccaactcagatccctccttcttggtaaaaagccagttcagactgaagcaatcccttctattaaccacattaattattactgcaattaatctcacaataccttgaggctccgagtgctgagaggattttgccttttgttatagtgatggaaaggatgcatttcaatatgttgccttgcagtgcaaacctttgttaacagggcaaaaatagcacagggggcaggaattacattcctggatgtgcatttggcttatttacatggatttgggtgccctctaaggacaccatcttctctcccctccaagagggtcaggccacaggacatccatgttcttggcctcccatgggagagggtctctcgccagaggaagggaaagccaagtggccacagagttccagcctgtccctgtgacagcccctgcctctggccagacatccacccacccttgctaagtcagcctgctctggggctactaggcccagtccttgctgtctgtcggagacagaccatgaagtgcagtgtgtggagggctgggacatagcataccgaattaccccagggagcttggaaaacatctcttcccactctctgttaggcccacggcttcctctactggaggagacggcatgtgaggatggaactcggtcattcctctgtcaccaccgatgtgaacagtctggaatcctgcacacaggagactgacgatccctgagcaacctttagtagctcctaccattgggcattttcttggtacagatcacaaataagagacatcatagaaaatgttattcttttattatttcaaggaggtaatacatagcccaatatggcaaagcaaaagggaattagaggcagcaaatggccaggtttttctaagcgcctcatgctgcatctctgagctcctgtctgcccgcagcccacagctgcttacatgaaggccaggtcagtagacagatggcccaacttgatactccactgactgagaaagggctcaatgtgcagcacagcagaggcactgccaggacccagcacgctgggcggcaccccacgctgccaccaccagctacagaggctagtgccttagtagcagccagtgtgtctagcacttgattttattcctgtgagcctagagtgggcaggacgtgaataaatcctgagtcataagttaaggtgaaagacttagtagtgttaatactcttggtgagaaaagacaacacagtcttggaggagagtgggcttggagtctggtggaagaaagatagaaacccccagaagggcctcggcctgcaggcactgccttgaggccatcagagggggttttcacggtacatgatagggaggagtgaggcaggtgggcactggagggctgtttcctctggcacagttgaactagagggtcactttccactcataattggtttcctaggtctaagtcaccacacctggggctgaagcaagtcttgcctgtgcaccaagcgtggccttggaccctggagagatgcaaggctcagttctccagtgttgaagtggaaggactcccaactgaaggagatctttctctccccacctccagctcttttcccttacaaatgaccagggtgcaagtcgagaggcagaggcacctcctggtgcaactccaccacagtcttacagagaactcatcttggtgggacccaaagcccagccttggcatgaagcagacttattccacccatcggagggcacccagtctggtgactgaatggtggcgtgcaagtgggagtcagcagtggctctggatgccgtaatactcagatgccattcatctctgtgtgatcgtcctggctggagagctggtgaggagggactgcttcctcctggcatgcactgttcaccaaccacaccacgtgggctgatagatttttggtttgacaggtgtggaaagaatttttaaaaccagccactgtgttctccaaacccagagccattggttttgtttgacaagaaagtaccaagagaaccacagctccactgaggctaaggcttgtgtagcacagaatgcagtatgtattgaaacgtataaaccttgtctgactggggagatgggtgagcaaagagctgccgggacccaggtcctctagtcggttgcaggctctgccgatgtctcatccttaagctcctcaaaacctgggactggcttctgtagaaagtatgtagtggcctggatcaccttgtctggtccaatgttgtacactgggtgagtgggctgctgcaaagagaagaaaaggtgccagttaatcaccccggtggtccttgaaaacataacacatcctttgctccatgaaaggcacttctaagaatttagtataaggaatcagagatacacacaaagcccaaaggttcaaaaatggtgtatttgctaaaactatctagtacatgggacacaggttaatatacagccattataaacacgcatttaaatatttaacgatacaggcaaatacttacaacatattatgtgagaaaacagtatgtacaatactatctcaaactgtttttttttttttttttttttttttgagagagtcttgctctgttgcccaggctggagtgcattgacacgatcttagctcactgcaacctctgcctcctgtgttcaagcaattctcctgcctcagcctcctgagtagctgggattacaggtgtgagccaccacgcctgggtaatttttgtattttttttttttttttttgagacggagtctctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattatttttgtatttttagtagagacagggtttcaccatgttggtccggctggtctcgaactcctgacctcaggtgatccacccgcctcggcctcccaaagtgctggggttacaggtgtgagccaccacacctggtctcaaactttttaaaaagtgtatttgtacctgtgatgtatataaatagcaaaaattgtacccataccaaaatattaatagtgatatgattgtttttcattttcttttttatattttatgtatcccaattattaaaacaataaacatgtatttacatttataatcaagaaaaagggggccggacgcggtggctcatgcctgtaatcccagcattttgggaggccgaggtggatggatcacccgaggtcaggagttcaagaccagcctggccaagatggtgaaaccccgtctctacaaaaatacaaaaattagccgagcatgatggtgagtgtctgtaatcccagctagttgggaggctgaagcaggagaattgcttgaacccgggaggcggaggttgcagtgagccaagattgtgccactgcactctaacctgggcaacagcgagactctgtctcaaaaaaaaaaaaaaaagaaaaaaggaccacaaccctaatatgtagtaaggctgtcagatcatatttaaatatataaacaaaatttaaatatgaaatttaaattaaatagatgttattctagtacatcacagaaacccaaaagaaactttagatttgacacggcataatcctaggccaatattcaggattctcccactgtgggataatgaagaaggggacacaactgcaggagagattttaaaaattttgagagaatactaggagcaacctcatgctgaaacatacaaaaattcagataaaacaataatttttaaaaaccaggaaaactgccaaaattgacttaaggaatttttaaaggcctacatgaagaaattagtaacaacaattgcttattctgccacccccacataccttaaaagatactagacctagatggtttctcaggcaagtagtatcaaacctacaaagaaacagataatctctgatctatacaaaccttttaaggactgaaaaaaaaaaaggggctagtgcgggggccaggtacaatggctcacacctataatcccagcactttgggtggctgaggtaggatagcttgaggccaagagttcaagaccagactaggcaacatagcaaaaccctgtctctacaaaaaatttaaaaattagcaggttctggtggtgtgcacctgtagtccctgctacttgggaggctaaggcaggaggatagcttgagcccaggagttccaggctgcagtgagctatgatcacagcactgtactccagcatgagtgacagagtgagatcatgtctctgaaaaagaaaagaaaaagaaaaaaggtaagaggtgcaggaagctacccatttaattttatgaggctatgatattatcctgaaacactggaaaaggacaatacaataaaattttagatcaatctttcttatgaatgtacatgcaaaaaaatcctaaataaaagtactaggcaaacatactggcaaactgaatccagcagtatactgaacaaaacacacagacacagacacactgcctctactatgaccaagaagggcttatcctgggaatataaggcttaacatcagaatattaatgaaacatatcatattaaagaagaaaaatcagatgcggagaaagcattcaataaaatttaacactaccttatgactgaaactaacaaaaacaacctagcaaatcaggaataaaagtgaatatcactaacttgatataatgtaactatcacaaccttacagtaaacatcatgcttaatgatcaggttataaaaagccttcccattataatcaggagcaagagacgaatgccctctactacctttagtcagcactatgtggggatcttacccaacaatacaaggcaagaaaaataaaatggaaactaacttagacaaacttaaaactattaaagagttcaacaaggtggctggacacaagatttataaatattattagcatttctatacactagtaacaaacagttacaaaactgaaaataagaaaagattccagtcacaagagacatgaaaactgtaaattagacataactctaaccgaaaaaaaaaaaatgctagtcctttatggaaaaaattataaaaaaaacactgaaagacattaaagaaaagaaaaattatgttcataaatggaagcctaaatattgaaaagaagtcagttctctttgtactcctgggaagacaggaagaaaaaaaaaaaagttggttctctcctattaatctaaaatgtagtgcaattccaataaaaatcccattagaacttgacaggctgatcctacaattcacaggaaaaagcaaaaggcaaagaatagccaaggcaattttgaagaaaaacaacaaggcagacaggacttgcctacctgttttcagacttgcttaaaagagtgcagataggcaaacagaccaaaggaacaaaataagagagtccagaaacagggccccttcatgtatggaaacttgagggtgtggtacacatgagatacacatcagcaggaaaggttgtagacttcagtaaatggtgctggtcaattggttatccatatggaaaaaagataacattatatccaagcctcaccatacacagaaaccaaatccaagagaattaaaaatctagattaaaaaagcaagctttagactatttagaagaagttacacttaatgacttgctgcattgccttgttcattcccttcatagcacgcatcacaatttgtgatgtatttgtttaatgtgtgcctccttttgtctgcttccctcaaaaaatggtagagattccttaagttaatcctcacctaccctcccccaaaaacaaacccctgaatgacagaaaagacaaatagatttgaccacttcaaaattaaaatattaaaatatttttgtggggaaggggtgctgggggcagggtctcactctatctcccagactggagcaaacagagctcactgcagccttgactacctgggctcaagcgattctcccacctcagcctcccaaagtgctaggtttacaggtgcgaaccaccatatctggcctaaaatcttctatttaacaaaaaaacaccaaaaacaaaatgctatggtttggatgtggtttatttgtccccacaaaaattaatgttgaaatctgatccccaagatggctatgttgagaggtggggtttgtggaatgtgtttgggtttgaggggtggatccctcaggagtgccttggtgctgttcttgcagtagtgcgtgagctctcactcttgctctggggagtctggattagtccttgagggaatggattagttcctgcaagggtaggctgttataaagccaggatgctctcaggctctcctctgtttgcatgggttggcttcccctttgatttccacatgttataatgcagcacaacccttgccagaagccagagccatgcccttgaatttctcagtctatagaaccatgagctaaataaacctcttgtctttatacattacctagtctcaggtattctcttatagcaatgcaaatcagagtcacaaaatgaaaagacaagtcacaagctggaagatattcactacacacatgtaactgatagaagattagtattaaaaatatacagagaactacaaatacttaagggaaaacaactgaagttacccatcagtaagaaaatgagcacagaatatgaactggcagacaattcgcagaagacaacacaaatggccaacaaacatttgaaaatattctcaacctcaccagtaatcaggaaaacacaaaatcaaacaaataccacttcacacccatcaaattggcaaaaaggaaaaggtctgactatggatcgattcatcttacacaaccacactggggagcagttacagaggtatctatcaaagatgacaatatgtgtccccttcaacccagcaggtcccctcctggagacattctaacatgtgaacccaatgagacagataccacaacgttcactgcaacactgtaatagcaaaaaattgataactagcaggagaacagagaaacacactggggtacatttatataagggagtatcatataatagttaaaatgaataaactggagcaacacatgtgaacacagataaacctcaaaaatacaatggcaagtggaaaaagcaatgcagaatgactggtacagtaggtaccattacaaaaagtttgaaaacatgcaagcaactgttatattgcttataaaaaactatatattgcttatagatacatatgtatgtagcaatagcacaaaaacatccacaggcatgatacatgtcaaatttgggacagggttacctctggagaaggagggaggaaaaaaaactggaagagggctacataagaggcaaatagggggaaataattagggcctggaaaagctgggtggtggtttttctgattaagaatgaggttgagcatcttttcaactatctattggccatttgtgtttcttccatttgaaatgtttcccaattaaaagaaacaaagatggggccaggcgtggtggctcacacatgtaatcctggcaccttgggaggctgaggcaggcatatcacttgaggccaggagtttgagaccagcctggccaacatggggaaaccctgtctctactaaaaatacaaaaattagctgggtgtggtggtgcatgcctgtaatcccagctactcaggaggctgaggcacgagaattgcttgaacctgggaggtggaggttgcagtgagccaatatcatgccactgtactccagcctgggtgacagagtgagactttgtctcacaaaaaaaaattaaaaattaaaaaaaaaatttttttaaacaaaaaaggaaggttacaatgacacagatgagaaaataaggcagtgacctagatggtagcagcaggccatgtttacactggtggaagtagggcttagtaagagtagggaactgcacacaaaaattcatgacagtctgcatgggccctgtgatttgatcactggggacagtctccattggattcatgtccaggctcacgtctaggctcagagcacctccaggttgtcctcagctggctgcagcagtgagcatcctgccctcatagggctattgttttttcaggaaagcagacaaacacacattaaacaacacaccaccaactgagtaaagtactacaaagaatatgaacaaggcactgaggcagagcattctggggatctcattctctgaagagatggcatctaagctgagcctctgggagagacgcggcaggctgtacagccagtgccgcatggctgcagtgctatcacgagcctgctgggactcacagcctcagagtgacacgtaactgtggcctcctctaggggaagctaataccagcagtgggctaggtcctcagccctgggataaaggcacaacagctctttgacagatcagaccgcccatctggaaccctgagcttgcccagaggtgcgtctcctctgtggtcacatcctcactaacggctgcacagctcgaagggcagagggaccacaagcttccgcctgtccacacaggaaatgcagagccagttctgcttacttggaaagccttctgtccgcgaggtccctgtggagaaggggtgtgaagccctgcacccgtcttaccagagcgttttcgggcacacccaggaccacatcatgcaacatggctccgctgccgaagtgctgggctatggacaggccgctcaggcagtagcaggtgtggtagaaatcacgcgacctgtaaggacaggcagctctgagcaggcgctcctctgctccgcacacatctacaaatgtagccacaccaattcagagaccactggtgcaatcacacgtccccccccatcctccatgtggctagaggaggcatggttttcccagcagtgttatttaaagccccactggctgagcacagtggctcacacccataatcccagcaagcaggaggctgaggcaagagaacggtttgaggccaggagttcaaaaccaacttgggcaacatgggagaccccgtctctacaaaaaattaaaaattagctaggtgtggtggccgatgcctgtaattccagttacttgggaggctgaagcaggaggatcactcgagcccaagaggtgaaggctgcagtgagtcatgattgtgacactgcactccagcctgggtgacagagtgagaccctgtctcaaaaaagtaaaatacaataaaataaaagccccatcctccagccctgcccagcagtgggaactgtattttttttcttttctttctttttttaccttaaactattaaaggaaactgtaattttaaagtcagtctctccagctgtcttctggaaagggctctccaggggcagtactaatgataaattgatacacttctctagaaaaatacctaaatatctagaaatgggccacatccttcctgatacattgtgggaccaggccttcccctggatgccaagagcagcaggacgtgtgctgggatgggggaagacagagggtgggtaacaaaggtgagaggacttattttatttccctttttctaacacataagccatctcagatttgagcttaatcatttaatccactctataatagttgtcatgattacagtctctgtttacaacactgaggggttttaaaatcctgtatcctattctatttagatcagtttttttttgttttttttaaaaaaaagaagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctagcaaaaactgggtattctggtaatactactaaggtactgacaagcaactggacttcttcactctgaagtccaatcactatggtcaaagaattctgtgggccacacagttatcaagtgggaaggagggacaaatcacggacaggtgtgcagaaacatctgcatagaaatcgattaaaaatatatatacatataggatgtacactaagtccttggtcaattttatattttgatacctgggctaaaagatgcctgacaataaatcatttttaaaaaaaagatgcccaacaattggtaaatggcacctgaaagctaattgttctttcttccagtctttttggttctatgcgtttttctacctagttattataactgtgtagcttatgtttttcacttataccactataggcataaattttctattctattacataatctgcatagccatcactgtgaatagccatatagtatttcattaagtggacatataaggtaactgtatcataaaaagaactgagctaaaaatcttatatatatgtcagtatataaattcctatggtgggccaggcacgatggcttatgcctgtaatcccagcactttgggaggctgaggggggttgatcacgaggtcaggagatcgagaccatcccggctaacacggtgaaaccctgtctctactaaaaatacaaaaaaattagccggacatggtggtgggcgcctgtagtcccagctactcaggaggctgaggcaggagaatggcgtgaacccaggaggcggagtttgcagtgagctgagatcacaccactgcactccagcctgggcgacacagcgagactccatctcaaaaaaaaaaaaaaattcctatggtgaaaattataaaagtttatggtatcaataacctttcccattttggagaaaatagcaaaaaagaaaaacgggggaaaagatttctaaaaataaaaatgaaaagtttatgatacagtctataaagagattgaagcaaaatattaaactgttgaatatttcctttttttttttcttttttgagacagagtctcactctgttgcccaggttggagggcaatggcacgatctcggctcactgcaacctccgcctcccgggttcaagcgattgtcctgcctcagcctcccgagtagctgggattacaggcatgcaccaccatgcctggctaattcttgtatttttagtagagacatggtttcactatgttggtcaggctgctctctaactcctgacctcaggtgacccaccctcttttggcctcccaaagtactgggattacaggcatgggccaccgcacccagcctaaattgttgaatatttcaaacagacaataagaatttattaaatttctttaaaaagagacacagaggaaaagggtttccaaggttgagcactaggtgagggacagtggccaggtgacatttagaggccagggacaaaagcttctcgtcttcaaccctgagtcgcactcagccctgaaacacccattaagagacacaggaaactaagtccgacctaaggagaagcatccaatctcccatctcaggctggctgcaggccacatgctttgatacacttgcactattttaattcccttcctttcttttcctcacctgtaagcacagtgaactttgttgtagaagatacatacatatatgatgggacttcactctatcttcttttacttatttccaaggttgtttccagttccttgccattatgaggaatgctggactaaatctttgtcaatattatgtatgcttaagattattttcttcaaatagactgaccacggtggaattattcggttaaagggaataaacattgttaaggcttttaatagatactgataaactgctttaagaatttatagactactctcagcacaatccctgtggagtagccctgctctgcaggagctgtcaaaaataaatatataaataaactaaaaataaaaacaaagactttatatagctaccagcaaaatttaaaattttgctataccacctccagcattagcacctttttgttgttgttgttgagatgctatcttgctctgtcgcccaggctggagtgcagtggtgtgatctcagctcactgcaacctctgcctcccaggttcaagtcattctcctgtctcagcctcctgagtaccttggattacaggtacaagcccccacgcctggctaatttttgcatttttagtagagacagggtttcactatgttgatcaagccagtctcgaactcctaaaatgatctgcccaactcggcttcccaaagtgctaggattacaggcgtgagccaccacgcccggccagctttagttactttttaaaagttatcagcaattaaaatggtaaaaagaaatagtacctgatagtttattttgatttgcatgcctctgattactaattagggtgaaatttttccataacttgtgtttaatatttgcatttccttatgatggtgtctgtttggcctaatcttctgagatccaatagccaattttattaatctagctttttcttatacttgccccttgtctacatcatatgctgcatctattttctcctttttgctcctctgttttggttatgtgagtttaaaactttttaaaatttttaaaatttaattaatgtaaaacatatatatgttttatacttaatattgtaatcatactattgatttttccttcacgatttcctttttaagaaaatatttaatgtgtatggggatttttggggggatgagtgatgaaaatgttctaaaattgtcatgatggttcgcaactgaataggtaagttgtgtggtatgggaattatatctcaacaaagctattatttaaaaaagcatatttattaaactttaggaaactgcattacacatctgtacaaaatgtacatatatttcatatcctataacaaataaaagactattattataaggtaaatgataacctgtggctaaaattagagtctgaaaagaaaacgctatgtttattatataaaaaactatagactgtttcagtgacttcctatattattaaagcatagaagctcaaagttcaaaagctctacaaggagcttccagatatcctgaatttggacaccagcacacataatcacaacaagatgaaagcagatacgattatagggtgataactgcacactggaatccaccttttaaatcctttctacctcttcctgaaattataggtcgccattctaatctcattttgcatttcaaaggttccttttatctaaaaaaatcaaaagtctttccacaccataactgataggtgcagccatctgtagctcaatttcacaggtaggcaagaaaattccagggtatgtccaaaagaacatataagaaaccagtaactaccaagccaagtggaaactcacaggcctgctgctttcttattgctccacaaaacaaaaaaacaaagtaactcactgatttagtcagcacttgagatttcttaagccttttttttttttttttagacggagtcctgccctgttacccaggctggagtgcaacggcgcgatctcagctcactgcaacctccgcctccggggttcaagggattctcctgcctcagcctcctgagtagctgggattacaggcaacgtggcaccatgcctggctaattttttgtatctttagtagagatggggtttcaccatgttggccaggctggtcttgaactcctgagctcatgatccacccacctcggcctcccaaaatgctgggattacaggcttttgtgtttttttgagacaaagtcttgctctgtcgctcaggctggagttgcagtggcactctctgcctgcaacctctgcctcccagactcaagtgatccttctacctcagcctcctgagtagctaggactacaggcatgtgccaccatgtctggttaactgtttttaattttttgtagagacaagctctcactatattgcccaggctggtcttgaactcctgagctcaagaggtcctcctgctttggcctcccaaagtgctgggattatggtcatgaaccaccatgtccagcattttaaggtactaatagtaattccttcttctactcaaatactgtcatttacacatagaaggtagtcaatggcatggagccactgatggtcacttgctgggtcagggcatggcctagacccacgtgctgcactatgtagagcattctttttgctttttagttagcaatatgatcaatgccttttaaaaaatgtatttgtacatttaccaaaataaaattagtaatgcacatggtttttttttttttaaaggcacagtataatacagaaggatagaaaatctaaaaagttggccaggtatggtggctcacgcctgtaatctcagcactttgtgtggccaaggaaggtggatcacttgaggccaggagtttgagaccagccaggccaacatagtcatatcctgtctctactaaaaatagaaaacattggctgggtgtggtggtacacgcctgtaatcccagctacacaggaggctgaggcaagaaaatcaattgaaccgaggaggctacagtgagccgagattgcaccactgcactccagcctcagcaacagagtgagactctgtctcaaaaaaaaaaaaaaaaaaaaaaaaaaatctaaaaagtctccctccttctgtcttctgtctgcttctcttctcccaaaggtacccattgttcaaggggttttgtgtagggttccaggaaaagctgtgtacatctcgggctgtgtgcccaggcactgctccaggccccgcccccttacacttcatgttgtatcttgcagagctttctatatcagcccatggtatgcagctactgtttggagagatttttattatttaacccttaaccttttgataggcacttaggctgctattgaaactccacttcaatatacatcctttgctaatatccctgcaggtaaattcctgacagtgcacttgctgtgttcaaagggtaagtgcccttataatttaaatggatgtctccaaactgccctccaaaaaatgacttaacctatttacatccccactatcaaattacctgttttctcacactctccccaacatagggtatcaagttttttaatctctgccaatccaataataaaaacaaatagtgccactcttttgattagcatttcttttactacaagtgagctaaacaatttttcgttggattaatggccacctactgtggttatgagcagggcagggttcagatgccagctagtctggattcacacaaccacatactaacccttgtgagtgccaatcaggtattataaagcaatcacttaacctcactgtagtttgtttcctcatctgtaaacaatggtacctatttcatagggttgttttgagaattaaatgagaaaacatatgtgaaatgctcagtacagcccctggcatacagtgagggcttgggaagactccgctaccagtagtagtggcagttgtagtagaaaaagtaagaaggacagttctttcactgggacctctttcttcagatcctttgcctgtttttcagttgggttgtccatccatttcttactggtttgtatgattttttttcaaattaaagaaattagccattcatcacttgttataaatatttttcgcacctttttgcttgttttgtttgtagaatttccctgtttctgtaaaataacttttgttgtctttttttatgcaagaaatacctattaactatagaaagattagaaaatacaaacagaagcaaacatcacctgtaacttcacatcctagatactttctatgaattttttgtagtcaactcttcactaaaaatgggattccacacatattgctttgatatgatcacaatatattgtgactatctttctacactgcatccccttttgactcccaaagtcagtattttgccctcctttcaacacacttcccttctttacagactcctgtctgttccaagttcaagagatgccctgtgtctgagaagacaacacaggccttctcccagccaatgaaaaaagctggaagcaccaagattcataggcacccttttccatagacaaagctttgaatgccactaagccccctagaacatgtgctacaagaaacaattaaccagcagcccccctggaagactttgacaggtggtgctcctgttatagctcattccacatttccctgggattgcagaattactgagtcttatccatgccagggacaggtttgtaaaagactgaccattttaccaggggcttgacctcaccagttccaaataaagagatcaccatgaccccaagtttttttctatcttagaaatgttgggccaggcacggtggctcacgcctgtaatcccagcactttgggaggccaaggcggacagatcacctgaggtcaggagttcgagaccagcctgaccaacatggagaaaccctgtctctactaaaaatacaaaattggctgggcgtggtggtgcatgcctataatcccagctatttaggaggctaaggcaggagaattacttgaacccagggggcagaggttgcagtgatccattgcactccggcctgggcaacaagagtgaaactccgtctcaaaaaaaaataatactaaaataaaaaatgtttgacttggggaattcctgacttccctactggtggtcaaggcagagactgtgcaggctccaaagtcagtgcacttgctgacagtgcacttgctgtgttccaagggtaagtgccttatatgccttaatactgacacctaaagcccagtgggcccaggccgggaaaatgggacagaggctctgcttactttaattcagtgtcagaaatggtcacaactcaacaactcaaaggaaattaagaaactaaataatgaggctcagggccgggtgcggtggctcacgcctataatcccagcactttgggaggccgaagtgggcggatcacctgaggtaaggagttcaagaacagcctgtccaacatggtgaaaccctgtctctactaaaaatacaaaaattagccaggtgtggtggcacgcgcctgtagtcccagctactcaggaggctgaggcaggagaattgcttgaacctgggaggtggaggctgcagtgagccaagatcgtgccactgcactccagcctgggagacagagcacgactccatctcgggggcggcggggaggggggaagacggggggtggggggctcagaaacaggaaaaaaaagtatggggaggggcagaaaagaatctcatcttttacatttgagcagttacattatccaactaagtccgaagaacagcttctctttggacccagggatctcattccaaaaacagatcagcaaccagcagggccccatgacttcctctctcccacaggtctactcagagacacctgctctcacatcaagtacaccagaaagatggtgcaggagttagcaggcagactgaggtttcaagagatagagagagaatgttcccagactttttgctcactaactacttcggttttgcgttcccatttgagaccccacagaaacgaacgtggatttctctactccaatggtgcaggtggaacaaactcccatttaggcttattcaatgaatgtaaaataaaacatttctaatagtgacaactctgcagccagtcagacacggcgagtctcttctccatggtgtaggggcaacccacccctacaacccacccctacacatgggttctggttctctacccctttacgcagttgcctttcctgttgctgttgcaacagtgactgttgcaacactgagggttttcagctctgccctgcacccagaggaggtggcaatcaccacagagcccaggacaggagtgggctgctccttccagataacgcagaagcagcgcccacttcctccccgctccccgtagcaatttcaaggaagctcattctgtcgcagccaatttgaagaagcaaagaatgacactaaaccaatgaaactaaatcttactctgcattcgcatgccccacggcatgaggttccacactgggcactcaaaatccaggatagacagagctcatttcaacccctctaaaaaagcacgctgggcttccagactttgtgagtagtggagggaaatcatccagccccaagtgaacagctccccaggctcaccttgggcgtgcagtgcgcggtggagcaggggcaggagccccgcctgccagaaggagtagcagccatccaccagcttgttgcagcggccctgaaatcctccttcaaatcgcatctgccggcttgtcacccattgctgaggagacacagatgggaaaggcagttgtaggctaaaagagacaaaatccagcccgacagaatctccaggagtcaatctgtgggatggagggtttcccatcttgtggcttcttggcactctagttttggtgctctggttttctttccttccctccccacactgccatagacacagagtgaagcatttaagccaacgctgtagaggcatccagcactgatctctgctcaatgcctggcagacaactaccttttcctgggttccaaagcagtgccagtgctgagaagataaagaggccaagctggtttgtaaggagaccttcaaagtctcttaataaacatggcttaagttggaaattgaaggcaagactaccagtagctcatttctcattacttccctgctccggggagtttattaaaagcagataaatggaatttggtactacatttcttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcccggcctggtactacatttcatcagatgatctcaaactgctcctgacttttacttggcacctggggaaatttacccaaggtctcttagcaagtcactagcaggcctgaaagcagaagccattcattctaattaccaaatgacaactctgcccagtctgtggctgatataagaaaatcttttactttgaagctgtaaaataggtcttggtcttgatgtcactcagcggtcacacacgataccaccattccttgcttatctacaagttttctaaacacactctactacaaagatcaagatagtcatgggtttggtccctcagaatgagcagaaccaactggctgagcagatatgacatttccatttccctccctagaccacctaggccgttccagccacggacttacagagctgcctcactcaactgaaagggtacaggggagggtacttcctgtttctagagtcttactaggtaaaggtcctgaaaggagccactgggacccttgatggaagtgggggccagccctcccctaaaagctgttgtttagattattccctcttcaaggcaacacctgcccatagagagtcacagtcacaaatgcttaaaagagacagaaaacactgtactgcaggttcaggtactaatatatcctcggttgatcttaaatgaaccagggcttccagcatgtaatggaagtgggctaagcattactcaggcagagagaaagcaggcgctgcagtgggagtcggttcctcatttctacttaccgcagggcttaagtgtttttaagcagactaatttactttttccagtgcctaagcccatggatttgttctgtttccttgggctataggaattcatacttcagatatgggtcctacttctcccaaagcaaatggaagggagtagtctggattagagcaggggtccctaacccccagaccatgccaggctgcacagcaggacatgagtggtgggtgagccagtgaagcttaatctgtatttacagctgctcctcactgctcccattactgcctgagctccacttcctgacagatcagcagcagcattagattctcataggagcgcaaaccctactgtgaaccgtgtatgccaggcttctaggttgcacgctctacatgagagtctaatgcctgatgatctgtcactgtctcccatcacccccaaatgggactgtctagttgaaagaaaacaagctcagggctctcactgattctacattatggtgagttgtataattatttcattatatattacagtgtaataatagaaataaagtacacaataaatgtaatgtacttgaatcatcctgaagccatcaccccccgtcccacccccaaccccaggtccacggaaaaattatctcccacaaaactggtcccttgtgccaaaaagattattactgtgggttagagggacactaacatttattaagtacctactatgtgccaggctgtttataaatgttctctcctttaaccttaaaaaaataaggattgttatccctaccttataaaagaaaaaaatatcaagctaaaagagattagacaatttgcccaaggactcatgtctcaaatgtagtagggacagggttcaaatctagaacactgtctttataactgaggcactccctaatcacattccttatctctgcctgggagatgggacttttttgtttcatgccttattggtgttcagattttaaaacatctgagaaactcttaagttcagcatacaaagttggctgtttcagcatgagccttcaagccttcatgaatctttaaaaagactacaccgggggaggctttctgaaggtggaggcaagacactgctggttacatgtctacagggtacaacagaaactctccaggaagctcacgatgggccgcataacgggaggctggcatctgaactcagggagaggaggtgcatgtcagttgcagctggtttgctttgacgtcatggtcagggggtacatgctccccaaatgacatgacggggaatgccttctccctggtggccgtggaggtgtgtgtgtttgtgcacccactgatcatttaactacaatctagtgactccctgaagctgactgctttctgagtttcttctgaatactggccaggagcgtggggtccagacataaatgttgggctgccttctcaatgcaattagccagctctgcctaaacaactcatttaaatgtaggtactaaatgtttacacagtgcagcaggtaataaaagtttggtttcgaaatgctgcaaagctcttcttgtaacttttcctcttaggaggttctttctataacacacgataacctctaattctacgaaactgaagtataaggaaggtactctgctcacaccagatgtctgcagcacacagtctatgtagtctacacactatgtaaaaagctctaagcaggaagacagaaaggcagaagggggagccaagacagagcagctgctcactccttcctctgtgttggaacagagctaactctcttagcccttcccatagccaaactctcctgaagcctgcatgtctgagtacaatcacatcaccatgacctggggcctgagagggggatggctcaaaagatacttactaataagctcttcaagttcaaggaacgttccctcttgaggattaccagcgcggccaggccacagaaggtatagccaccatgggcttccatccctggtaccccgccaatgccaccttcccagttctgacacctaagaagagattgagaaaagcagaatgagtggccagtgagtggacgtacacaagaccaggaccatcctaggtggcagagaaaaagttcactcagattaaggtgtgaaccatcacaactatgaatgaaaagatgccaactaattaacttttggaaatgtcttttcaaaaaaaaaaaaaaaaaaaagctgggcctggtggcacccatgtgtaatcccagctgctcaggagactaaggcaagaagatcacttgaggcgaggagttcgaggctgcagtgagctatgatcacaccattgtgctccagcccgggtgaaagagtgagactaggtctccaaaaaatgtaagtataataaaaactgtaaaatgttaaaaacccagacacttagaaacagcctacttgtgtaagaaacataataattcaaattattactctttgggaaaaagttataaaatcatacatatacatatatgtacatatatacacatatatatacatatatatatatacacacatatatatacatatatatacatatatatatagtgataaccatcaagttaaaataaaattaaagagtgattgttgattctagtgatcttttatttttgaaacagggtcttaactctgttacctaggttgactgcagatcatggctcactgcagcctcaacctcctggactcaggcaatcctcccacctcagcctcctgagtagctgggactatgggcgtgccccaccatacccggaccattttttgtattttttgtagagatggggcattgccatgttacccaggctggtcttaaatttctggcctcaaggaatcctcccaccccagcatcccaaagcgttgggatgacaggcatgggccaccgcacttggcctctggtgatctttgagtacaggtctactagtaatatttttcctttttgtttttctatttgttcaaaaagtttttataatgaacctgtatactattaaaaaataaacgttatttttaaaaattataattaggccaggtggtgatggcttcttaaacagcctgcagaaccatgagccaaataaacctcttttctttctaagttacccagcctcaggtattcctttatactgacacaaaatggactaacacaagaaggacaagaaataactgacttagtagaatagagaaacctttcctacccaaaggatagggatgggagaggggcaacaaaaagcaaggtgatctgctccaataaaaggctccaggattagagatacagggaacctccacaaagtggaatgcgtctgaaccaagtttgttggttgcaaacttatataagaatcagacctttaagtcccctactcaaatccagcagaagatgggaagtttcagaggtttaatcaaaaggatctgagttccagaatatccaacaagctaagaggaggagggagcactgtaccaaatgtgattacgtgagagtcagtaatctcaacacaatacccccagccccattcctctgtgtatttcacacaaggctgccagtttcataccccaagcaggaatttagaagattcctctctgagggaactgataagcccaagggaaaaaccctacagacactgctttgagaattccccaatgaatggcttgatcctgcccactctcgcagagctccccagcagcttttcagtgctggatccttaaatatgaacagacagctgtagagtaccagacatttgaccacagtctctactatgaaagaggagaccaaaacaaacaaaaataaattggaggaaataagacagggagcaaaagaaaactttttaaagttgtatctttagataaaatattatatgaagtaagactattgagaggacaaaatatccccagaaaagaacaagagagtagataaaaaagtagtcaggaagtaaaagtagtcagggaggaaaactaaaaataggattacaaaaataaaaacaagaggattagaagataaatactaagagaatctctcaaagtataagaagaaggattaagagatggaaacgaaccatgcaatgaaatatttttatttttatttatttatttttgagacagagtctcgctctgatgccgaggctggagtacagtggcacaatcttggctcactgcaacctccgcctcctgggttcaagtgattctcctgcctcagcctcctgagtacgtgggattacaggtgcatgccaccacgcccggctaatttttgtatttttagtaaagacagggtttcaccatgttggtcaggctggtttcgaactcctgacctcgtgatctgcctgccttggcctcccaaagtgctgggattacaggtatgagccactgcacccggcagtattatttttatttatttatttattttgagatggagtctcacactgtcacctgggctggagtgcaatggtgcgatctcggctcactgcaacctctgcctcctgggttcaagcaattctcctgcctcagcctcccgagtagctgggattacaggtacccaccaccacacccggctaatgttttgtatattttgtagaggctgggtttcactatgttggccaagctggtctcgaactcctgacctcgtgatccgcccgcctcagcctcccaaagtgttaggattacaggcgtgagccaccacgcccagcctcaaagtattcttaaaagtcagacaatcaaatgtactaatgggatgtcatatttttaaaaggctggccaggtgcgggggctcatgcctgtaatcccagcactttgggagaccaaggcaggaggatcatttgaggtcaggagtttgagactaacctgatcaacatggcgaaaccccgtaaaaattagctgggtgtcgtggcgcacgcctataatcccagctacttgggaggctgaggcaggagaatcgcttgaacctgggagaaagaggttgcagtgagctggtctgcaccaccgcactccagcctgggcaacagagcaaggcaccatctcaataaataaataaataaataaataaataaataaataaataaataaataaataaataataaataaataaataagaggctgggcatggtggctcacacctgtaatcccagcacttggggaagccgcagcaggaggattacgtcagcccaggagtttgagaccaacctgggcaatgtggtgaggctttgtctctacaaaaatttaaaaaattagcggatggtggatgcctgtagtcacagctactcaggaggctgaggatgatcacttgagcctggaaagtcgaggcaacagtgaaccatgatcgtgtcactgcactccaatctgggagacacataaaacaaaaagagacgtctcaaaaaaaaaaaaaaaaaaaaaaaaaaaaaaaaaaaaaaaaaaagggcccggcgtggtggctcacgcctataatctcagcactttgggaggccgaggcaggcgatcacttgaggtcaggagttcgagaccagcctggccaacatggtaaaaccccatctctactaaaaatacaaaaattagctgggcgtggtcgtgggcttctgtagtcccagctactcaggaggctgaggcaggagaattgctggaacctgagaggcagaggttgcagtgagccgagatcacgccattgcactccagcccgggtaacaacagcaagactccgtctcaaaggaaaaaaaaaaaagagcaaacacagaaaacacaagagaagaaattatcaaagaaatactgtaataaagaatcttggtactaaagtatatgcacttccaaatcgagtgcccagcaaaatgaataaaaataatccacatcaagattcatcatcaagtttccaaacaagaataaacattccaggccaggcgaggtggctcatgtctgtaatcccagtactttgggaggctcaggagggcagatcacttgaggtcaggagtttgagaccagcctggccagtatgacgagaccctgtctctactaaaaatacaaaaattagtcaggcatggtggcaggcacctgaggttgcagtgagctgagattacgccactgcactccaacctgggtgacagagcaagactccatcacacacaaaaagaataaagattccaagccgctaaagaaggacaggatggggatagaaaaagagagacagaagaaaaaaacatacagagaattaagaatcacaatggcactgccaggtagtacagcacagtggaatccatttgatttctctgtatttctgcttaatataaaatttaaaggctgggtgtggtggctcacgcctataatcccagcactttgggaggctgaggcaggcggattgcttaagctcaggggtttaagaccagcctgggcaacatgggaaaaccccgtctctactaaaaacacaaaaattagccaggtgtggtggcatacacctgcagtcctggctacttggaaagctgaagcaggaggatcacttgaacccaggaggtcaaggctgcagtgagccaagatcacgccactgcactccagcctgggtgacgaagtgagaccctctttcaaaaaataaataaattaaattaaattaattaaattcagtatcccaccacttgacatataaggaaactatgacacagagcagtggaataacttgtccaagcacaaagctaattagaaatggcaggctggccatcgtggctcacacctgtaattccaacactttgtggggctgaggcaggaagattgcttgaaaccaggagttcaagaccagcctgggcaacacagtgagactctgtctttacaagacattttaaaaattagctaggtgttgtggtgcacacctgtggtctctgctactcaggaggctgaggtgggaagactgcttgagcccaggaggtcaaggctgcagtgagccgtgatcatatcactgcaatccagccagggcaacaagcaagaccgtgtcttcaaagaaaaaaaaaaaaagctgggcgcagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgactgaaaaagggcaggcagattttggtggagtttgaaacttggaacagagaacagcatgcagttagtccctcccttcccccacaactttttctctctggtttgccctcaggatggcagccatagcccagggcggcagcagcaggccaggggtcaggggtcagggcgggcagccaacactctaatgggaagccaaccatccttctggcaggaagatgcaggctgccagaaactgaggacgaatccagaaacaggaaagtcaaagaagaaaaatcccaaattctgcatttaaactcagttcaagtttccacatacgtgctggggaaacaaagcaacttctaagcaagaactgagctctgagctgctgcatgagtgacagtttgtagcttgagtctgaccaagttgactgcctgctaaactgaaaacatcaaccccttttggggcaaaccaacagaatccataccgttctgttgtatgacacctccaccatcatatcacaatgtctaggacacaacacaacatcactcagcacaggaagactcatggagctgacatgccaactccaggacacacagatgtggaaattcccagacaagcaatttaaagcagacattataattccatacttaccacagcaaaatgaagaaaaatgcactcataaagaataaaaagatggaaaatctcagctgagaaacacaaaatataaaagagaaccaaacacaggcagtgcctactctccagctctcaactatagctgccttaccattgagcatgacagtcctcaatgaactctggttactattatcagccttattaacaatgacattggaagccagaagataatgaagcaatgcttacaaaattcagaaagactacagtttataccattgccaagttagaaatctctaaccaaataattaagtgtgagattagaacacagatacatgcaagatattaaaaatgtatctcccaggtacccttttttgggatctgttggagtacaatacttcatgaaaataagaaaaccaagaaaaaggaggacagggacttcaacgaaggagagaaatgaagtgaatttcatgctgaaaggaagcttcgggatgcctgctgtgtagcaagctgagagcaatctgtccagactgaagcaggagggcagagggctccagaaggggcaactcaaaacgcacgtgtgcacagagacaggttacctgaagggtttgactatgtttagagtaattttttatagctctgacagacaatttgggaaggaattcataagtacattcatgatatatccattaactccaggaaaatgaaactcatacaaaaaagtaaacatgatctcagcatatcatctggtatcactgtaaattatatttatatggtaatacatactactttgataaaaataaaatttttttaactaaaacagtatctcagcttggctatcattccatcatagtatatatgtgtctactataccttttgcttctttttttgagatggagtctcgccctgtcgcccaggctggagtgcagtggcgtgatctcggctcactgcaagctccgcctcctgggttcactccattctcctgcctcagcttcccgagtagctgggactacaggcgcccgccaccatgcccagctaattttttgtatttttagtagagacggggtgtcaccatgttagccaggatggtctcgatttcctgacctcatgatccgcttgccctggcctcccaaagtgctggaattacaggcgtgagccaccgcacctggcctgctttttttaaactatgaaatatttggagcatccaggaaagtacagcaaacaaaatatagaacatacacgtatctaagacctagcttagaattagccatatacacttcaggtctttgttgttgttaactattacagctgaagtctcctatgcagacttatctcatttcctttgctctcccctcagcgggaatcactatgctaaatttggtgtttatctttcgtatacatgtttttatattattaccacatgattcttctcagaaacaatacagaattctcttgcatgtttcaaattttaagtaaatgtgctaatctgtatggtttttttgtatttttttcttttcattctttcaactcaacatagagatttttccatattgatacatgtaactctagttcattcattttcactgctacattatattccgatgcaactataccacacttacccatctcgtgcttatgagcactgaatctgctttcagcttttggctcttataaacaagtcctgtgctcctctctcccattcgtgtgtgcaagggtttctgtgggagtggaattactgggtcctacgcaagggcacctttgacatactgtcaaattgctctaaaaactggttaaatcaattcaggctctcactaatattgtttaccaaagttttttatctttgccaatctaaaatataatataacattaaagaaagtttggaaaaaagaagacattttaagtatttaaaaaaatcattagataaccctaatggatctcctgtgatttttgtatttccttccaagtccctctgcattttctttatttttctgaagtagtgtcgtgaccgcctgctctccaagaggccaggagaaaccctggcttctctcaccttgctatccattcagcagtgccctcaaagaggtctggagtgatgatgttggtcagcgaggctacggaggcagcacagtatgcgcttctggaaagacagaaacgggaaacacattaagctctacggaagagctaatgaggctcagtgaactccgcgggcggactgctcgccttgcctagtaagctgtaatcacctcctgtcctcactcttggcacacggtcagtcctcctgggtctccaactgagaggtgtgacattctatttggatagagttgctcacggcatggcttcagtgaaagaacatgacattctattctccctacctccacatggtccaatctacatcagaggaaataacagccatatcaattcatgtcaaaagtggattcagctcttctttcaaagacctataatggttgccataaatctatggtatcattcaggtacttctgatatgctcattcatttggatgttagtactgtttcagagccaggatttctgtttacagccttgacacattaaagattaactatactttttctgcaacagataaactgcaaaacaggccaccaaattgtaatagatcaaacaaggataggaacaggtgagtccactccaatacagtccttaaacctctagagggagaaaagagccttgatttcaaacctctcaccagtacacacacacacacacacacacacacacacacacacacacgttaaatgaaaaaggcgcacgtctatattttttgttttgcttttgttttggtttttattgagacagggtctcactctgtcgcccaggctagagtgcagtggtatgatctcagctcactgcaacctccgcctcctgggttcaagcaattctcctgtatcagcctcccaagtagctgggattacaggcgcatgccaccatgcctggcttatttttctatttttagtggagatggggtttcgccatgttggctaggctggtttcaaactcctgacctcaagcaatccacctgccttggcctcccaaagtgctgggattacaggcataagccaccgcgcccgggctattttttaaaaaagcattattaggctgggcacagttgctcatgcctgtaatcccagcactttgggaggctgaggcaggtggatcacgaggccaggagttcaagaccaacctgaccaatattgcgaaaccccgtctccactaaaaacacaaaaattagctgggcatggtggcgtgtgcccgtagtcccaactacttgggaggctgaggcaggagaaccacttgaacccgggaggcgggggttgcagtgagccaagatcatgccactgcattccagcttgggcaacagagtgagactctgtctcaaaaaaaaaaacaaacacaaaaaattattatacttgatttaggatcattcttgctgttccatcctcccagccctaattcttctcggggcacattttatttcagcttctccctctgtcatggtatacacacacagactgcctttccttcccctctatggttttttcaaatacccggcacagggaagacaaaaatcattggtttgaattctgctcaaaaatccttctcctggccaggcatggtagctcatgcctgtaatcccagcactttgggaggctaaggcaggtggattatttgaggtcaggagttcgagactagcctggccaacatggtgagacctcgtctctactaaaaatacaaaaattagctgggcatggtggcacacgcctgtaatcccagctacttgggagaccgaggcaggagaatcgtttgaaccccagagacagaggttgcagtgagccaagatcccaccactgcgctcctgcctgggcaacagaaagaaactccatctcaaaacaaaacaaacaaaaagtatattcctaagggctcctaagaaacataaaagaagggcctagtttccatcttcttttttttttttaagataggatctcactttgttgcccaggctgcagtgcagtggcgctatcatggctcactgcaacctcaaactcctgggctcaaactgatcttgcctcagcctcctaagcagctgaggctacagatgcatgccaccacacctggctaattttttaaaaattttttgtagagacagggtcttgctgtgttacccaggttggtcttgaactcctggcctcaagtgattctctcatctcagtctctcaaagtgttgagattacagacatgagccactgccgctcggccctggtttccatcttactcagtatagatataacatgaagtcagacttactgaggtattccaaagaagtctctgcagaagctgcatgcattatgatcctaccagcatttttagcagccaaaggcacagtggaagtttagttccaccagcaggcattgggagcacacaagagtcacaagtgccaatgccaaatgtgatcatctaccagcagctaattttgaagatctgtctaatttccttgcaattgtaggcctcttaaagaggctcagatgcatttgctcttgaatcctattgtgacttgtgaggtaggaggcgacctataatacagtttgcctctcacaagtgtgaggactaagaagtgatgacagaagacaggagtcccaggtctcacgctgagatggggaggaaacgtaatacaaccttttcatgtatttctccccctttccctccacccagtcatcgcagctctcaaatttgaatttgtccactaactttccatccttgctgccatcacccaaatccaagccttcttcaacctggatcagtcttcctgctctctctccctccagccctgaaaccagagggcttttattggaacactacagtccatcactgcaattgggaaacttctaagaaaatacaaatcagatcacatcactaaactccagactccataggagatttcagggcctctgtagcctgttcccagcctgtccctccagctccactgctcccctgcccaccaggccatctacacttcaacactgaacttgtcctttcttgagcaacacatgctttctcaccaaacttctgcaaatgctagatccctgcctccaccttatcctcacagaatgatctagattatataacctagaaaggaggtctcctttcttaagaactgagaaaaaatagtgcttgctatgagttcactgtgatttgattttttacaatacactggaactacagacccttgagtaggctcatctctgaaactatcagcagtgtaacagagcagaaagatcatccagagactgctgtctatcccagaagggcagcgagctagtctccagatgtcaaactctcccatcactgctgcttttctccaagtcaaatccacccaaacaagcactcctgaggactggctgatgcttccaggcaaaggacaatgaaagaaatgccaagtgaaaaatgatggaatcggggtactagaaaccaggcaaagcaaggaaaatggatgcaatctgctagcttttctctatcattcatatctttaatcctttatgtaaatagaaagcacgggcacgaatggcagagcatcacccaaagagcaaaggtcagggaagaatatggctacagtgcttggcaggggaaccaagctgccttactggagaagtttcctagcatttatctagaacatataaataaagagcatagggaaaaaaaaagtgctggaatgaataagatagcaaataatcacagctgcaaaaggtatatgataaaataccaaaaggatcttgctatgatttgtttgcttttgcctaataatcttagtaggtttttaaaagctgcgtttcaagactgtgcatattttgggggaatagcaacagaacaggaacgaaaatgtagtgaacacgagggaaaaaaactcttttaacattttccttaagaagaatcaacacatactgatttacctcagtcgttctactggtttcactggtatacacagatcctaatctaatttttttggttggattagacaagttagagatagaagaacatcttgaactaaaggcctttgcagcctgattacctattatctgtaatgtattttatgctccacaatgttcgtggttttttcctcccctatactttcaaaccaatggttaaaccagatgcttaagccagactattaatcaacttgtgtagaagcaaacccatttacacataggcagtaagacagctttgctatagaaacctcacaaaatgtatttctcaactaaataataagaaaatggcataaaatctcaataagccactgtcttagagaaatggcttattcaatgaattccctgtatgcctcataagtaatctgccaggtgaggaagcaacttgcttggtacatcagacacttatggaagaaaataataatttcgagctaactggcaccaatcagttaatgcgattttattgcactgcactctcccggcccacaaggctctctgcacctcccagaaaaactctcatgtgcctcaggaggacctcagggattagacattctcatgatttcatcaaattcactcagaaggtatttactgaggccctgctggactttcccctcccttcctatctcagagaggtgaaggaatacattacaccatacagttatttatattgtggtatatcattttgtaccaaacaaatgtatttttaatttctaaaacaaaagcatttgtttcttatattttcacatttacataaaataagtcaagtgatcatgacacctgaggacatctgcatcacatctgaatgattctgacgtgtcactgacatgtcatcccatgtgtcattctgggacaaagcagcagcttccccatgatgttccttaggcttggcatctctaatggcagatgagctctagagtcaactgatgtggcagcctgtgcaaaaccccactcacctcacatccacctcacctccgacatgcatgagaaaggagccgtcaggttgcttcagggagtacaaatactgaagaagcttctctctgagaaacagggaaagaggtaggagaggcaacagtcagtgcgtgtcagcaggcggggaactcctctaggtttctgtcactgctggctttcactgtacctgttaatgatgtcataggcctcctcggtgccaatgatgcacaatgcattgactgctgcatatgtgggtgcaaggtgtggatactgaccgggtcctcctccaaagccaccttctgggctctgacacagctccaggaactgacacacactaggtacacagccaaagggcaaaaacaaagtcagagagcattcatgtcaaaacaccaaattcccactagattccaggcctttccaatgatcccccactccctcaaaagttgaggggaacctctcctcccacttgttgaatataacctctccccaaagggcttaattctctctccagctatcatcatttctgtctgccctcctctgagtttcgtacttaagcgcttgttggtcatgaagcagggaacacaaggctgggaagaaaccgactttcgtagctatggggtaagagtctcccgtgcttcccacacaaacctttcccagactttccactcaacttgctgccctggacctgtggtaccagcctcctcctccttgcctttgggaacctcccagcctttgaattttgccaaaacatggtgctcaactgcttctttccacactaaccatcctagtcaggatccatcacctaggcctatcatgaacatgtaaatagaggtcttctcactcccattgccacctaagcctctgtgggccactgatttctactccaccagtaagaagcaagttttgtttttttgtttttttttttgaggcggggttgccctcggtcgcccaggctgcagtgcagtggtgtgatctcagctcattgcagcatccgtctcccaggttcaagagattcttttgcctcacccttccaagtagctgggattacaggcgtgcaccatcacgcccagccaattttttgtattttcagtacagacaaggtttcaccatgctggccaggctggtcttgaactacctgacctcaagtgatccacccgccgcagcctctgcaagtgctgggattacaggtgtgagccactgcatccggctgaaaaacacatttttaatggagcctgcttccatggctgggagaacagaagagaggcaggctgctctcatgctcaccttaattgcggtaaacataagaggagctgcactgactcgccgtgagaatgcctcccagtctgcgggttcttggagaattctccacgttaattcaaacaggctcccattccctcactgaggggagctgttttctgagggtttgcctccaagcctggcatcaggctgcccagaggttacagtcttgctttaggtgaaatcaagagagccctatcatcagtccggggtcttccgaagtgcaccagaaagggtgccccaggaaagccctggttatcaagctgtttctccacagctcagcagggtcacagccttcccgccaggagaaacctccatttacaacaagcaaactgtctttgcagtgttcatggggccttctttcctgggcgctttcacctcattatttccttgctactgctgccagaaagactacatagcctactctccaagaagacacaagtttataactgtttgccaacatcacatttaattgctttcgatttcagagttcccattatccgggcagagaaagcaaaagcaaacgctgctgccttgctctgtgagttctgaaacgtcacaggttaaaacaacacatacttctttttgcacctacaattttactgtagaaaacacaaggattgaaactgaagttgaaaacaattatgtggcactatggtttttgtttttgattttgagagagggtcttactctgtcggccaggctgcaggacagcggcataatcacggctcactgcagcctcaacctccccagactcaagctatcctcccacctcagcctcccaagtagctagaattacaggcatgagccaccacgcctggctagtttttgtattttttataaagatggggtttcgccatgttgcccaggctagtcttgaactcctgggctcaagcaatcctcccacctcggactcccaaagtgctgaggtcacaggtgtgagccatcatgcccagcatgtgacacatttttaacagcaattaatttctgtagagaacttgaatttgttccttctttccaaatcgtcatcaattcttatgacatttcccagaaacaaatagttaataagctcatgccctaacaaaggctggctgcactagcataccaaaaggtttctgtaccacaaaaagttttagctgatacaaaacttaacagcacattttttaaaagaaagaaaaagagtcacctggttatccactccctttcccagctcctaagatagaatcgtgccgaacgcaacactactgaccctaaagcctcgaattagttaggatctgaatgtaccagacacaccttgataccatccctccatgccaacctccctcagctgacatgctgcatctgactgtctggggctgtgctagagaactggaggttgggcttctcttgatctcagacacttccgtattacagaacattctgatcccaaggctttccaacttgcaccttaaggaattggcaagttgactatgaactaccagctgtcattcacagacttcttagcaattctgaagaccaaaatgttaatgatacttctacatatttaaaaaaaacaaacaaacaaaaaaaaggagccaggcatagtggcttgtgcctgtaattccagtactttgggaggccaaggcaggaggattgcttgaagccagtagttcaagaccagcctgggcaacacagtgagaccccagctctacaaaaaaatatttttttttcccacaaatgtagggggagaaaaacttatcatagagacaagaagttcaccaataaataaaaaattacaagcaaaaaacattgtacaaacaccaagtggcacattttgtgaaaaacaagtattcacaaaatcattcctttagaatatgactgaaagctgcaatacatcaattttctttaacgtcagcaaggcatttcattctagcttacgtgccaattaccagcaaagtgggaaactatcttctatatcatggatcttcaaacccaaaatgtgtgcatcagaatctgtagaaagctaataaaagaatacagagacccagtcctgctgaggtggaaaagatcctgggcctttgtatttttaccaaattctcaggtgattcagatacatgcaaagcttgagccatcactagtccttgctgcacaactaaaattacttggggggtgttttaaaaaaatcccaacacccaagccacacctaattccaattaaaccggaatcactatgggtgggacccaggtggcagtattttttttaaactccccacgtgattccaatgttcagccaggtatcagtgcttctcaaacttgagttgcatagaaattacctgtggatcttgctaaactgcagctctaattcagtagaactagatgggtctgagagtcctctttttttttttttttaggagatggagtgtccctctgtcgcccaggctggagtgcagttgagcgatctcagctcactgcaagctctgcctcctgggttcaagtgattctcctccctcagcctcccgagtagctgggactacaggtgcatgccgccacgcccagctaatttttgtattttttagtagagtcagggtttcactgtgttgcccaggctggtctcgaactcccgagctcagacaatccgcccgccttggcctcccaaagtgctaggattacaggcgtgagccaccatgcccggctgagagtcctcatttctaataagttcccaggtgatagcaatgctcctggtctggggaccacattttgagtagcaatgagatacatctgtgctgtccaataggcagccactagccacatgaggcaatttaaattctcaattaattaaaatagaaaattcagctcttcagtcacacaagacacatttcaagtactccacaactaactgtggctagtggccaatatagaacacgtatagatgtttatagacacctatagacatttacagaatatagaacattttcattatcacagaaagttctgctggacaccaccacttttatcattccatcattaaagagtatgtaaatcttgtaagagggtcaagttcaaagcagggatatcagcgattgcctctcagccttataaggagtttacttgggactcttaggtgatggctgaggactgatctaaagtgattgattctggccaggcgtggtggctcatgcctgtaatcccagcactttggctgaggtgagggggatcacttgagctcaggagttcaaggccagcctgggcaacatggcaaaaccccatctctacaagaattataaaaattaaccaggcacgttggcacccacctctagccccagctactcaggaggctgaggtgggaggatcacttgagcttggggaagtccaggttgcagtgagctgtgattgtgccactgcattccagcccagacaatagagtgagaccctgtctcaatcaattaatcaatgttgattctaaacaccgtcatcagtttggatgaaggattcaaaggcatgtacagtaaataagcatataatacaaaatgagcagcaaaacaaatcagaaaccaataagaataaaacaaatgcaacaggtacaaatagcaagaattacgcttagagatggcaggggtgggggatgggtaaggcacatgaatatgggaaatgactaggaacatagcaggaaaagaccagtaataagggtccacgagttgtgaagaacaacaataaaaatgcttgttaaaagcatcataaatgcagtattagtcagaactgtatctggctctagcctccattttccacctcaaagggaattcacatgagagttgtaaaaatgactactttttttttttttaagtatttggctgggtgtggtggctcgtgcctgtaatccctagactttgggaggccaaggcaggaggatcacttaaggccaagagtttgagaccagcttaggcaatacagcgagaccttatctctatttttaaaataatataaaaagcttaatattacagacaatcacagtgagaaagctacccagcaaaatacctcaaatatacaaaggataattacataaacattctagtaggtaaaaactgagactaatttgtagcaagaagtatttaggttacataaaaaacttcagcactagactaggctatcatagacagacttaaggcctaggataagttataaaaattatagctatgttctgcacaattgggcaggtttaaaaaaaaaaaaacagaaaaaaagattacagctttggaaataggaacagtcatccatgggcagaacggcttaggaggggatgtaaatgcaagatgcatgagctggcatcacatcaagcttgttctcgtactaactaaaacagcttcagcttgatatagtgaagaggaaatctccttccctaggtagaatatgacaatggacaggtgaagacgggcagcatctcttgttgattccgggtggcctctgctgctcacagagtcagacgtgttatttgactcttcatcaagcaccggcaagtctctggatggctgctgttctggaagaatggtcaggtcgaaagttggctactataggccgggcgcagtggctcacgcctataatcctagcactttgggaggccgacgtgggcggatcacttaaggccaggagtttgagaccagcctggccaacatggtgaaaccccatctctactaaaaatacaaaaattagccaggcatagtggcatgcgcccgtagtcccagctgcttgggaggctgaagcacgagaatcgcttgaacccggaaggtggaagttgcagtgagctgagattgcaccagtgccctccagcctgggggacacagcaagactgcctcaaaggaaaaaaaagttggctactttagagcagagtttctcaactgttgacactggggctcagtaattctttggtgcagggaccgtcctgtagaggatatttagcagcacctctgacctgcacccaccaggtgccaacagcacctggccaggaaaaatgcccaggagacaaaggcctagatatggtgtcctcactgaaaggtaaggaaacatacaaactagacttaaaaattaaaaggaaaaatatttaaggggctattccggggataagctactaacaaccttttgaaagggaaaggataaaacactgaaatagcaaaatttgaatttatctttggaaaaatcttacaagctgaaatgtcctaaaatggtttttaagttaaaggcaatttttaaatcttacagaagctaaaaacataactttaacagtgcgatggtctccctgtgaattttattttgctctgtttcactgaagctgctttcagtaacaaagaatgggattctcattagaggatgcttccttcagtgccaaaaccattaagcaaagcaaatgtacttagtctagttccaaaatattaattcattttagataaacacatataaatgtgtgcatataacctcttaaaagagggaagctaggccgggtgcggtggctcacatctgtaatcccaacactttgggaagccaagacaggtgtatcacctgaggtcaggagttcaagaccagcctggccaacatgttgaaagcctgtctttacaaaatacaaaaattagctgggcgtggtggcacacccctgtaatcctagctacttgggaagctgaggcaggagaatcacttgaacccgggaggtggaggttgcagtgagctgagatcatgccactgcactacagcctggcaacaagagcaaaactccgtctcaaaaaaaaaaaaaaaaggccgggcgcggtggctcatgcctgtaatcccagcactttgggaggctgaggcaggtggatcacctgaggtcaggagttcgagaccaacttggccaacatggtaaaacccaatctctactaaaaatacaaaaattagccgggtgtggtggctcccgcctgtatgcctgtagtcccagctactcgggaggccgaggcaggagaattgcttgaacccaggaggtggaggttgcagtgagccaagatcgtgccactgcactccagtctgggcaacagagcgagactctcaaaaaaaaaagaggcaagctgaagtcctacctatggactgggcatggtggctcacgcctataatcccagtgttttgggaggctaaggcaggaggatcaattgagcccaggagattgagaccagcccaggcaacacagcaaggcactgtctctaccaaaaataaagaaaacattccaggctatgaatacattattcttgaaacctctgataccagcagtaacaacctcgccttgctggctttggtcagcggtcatagcagctgacaaaagtattttgtccactagagggaacccagcttatcatattgttccctaaacaaatagaagcacagcagtgaacaaaataggaaagagaaacctttgtgtaagtgtagggggcgtgtgtgttacatgcaggggaaaagaaggcaggaaaataataaaactgcagagctagactttttgactctaggtcaccttaatatatttgtatgaagaaagaaaactgaacgcatttcaaagcatttcatttccctgtgcaagataaataaaaaggcaatattctatttcagctagtctaaaaaaaatcttctatttatatagaagtccttaagatttatctgtatcttactaaaaataatctatttccttatgggtcagagccagtaggctttgttcataacaagtgttttctgcacctagaagtaaccacctcctaggcacaaagcaaaatacattattgggaagtctaagaaatgtttaaaagttcactaaatcaatgcgtagaagaaccacaggtaaagcttttaaggcatctgtgaagcagaaactctcattaactgtcaagtggtttttgaaataaggacaaatcagcttatttttaaaccattccttttttaattacaaaataataaaagatcattgtagaaacttcagaaaatgcaagtaagcttaaaaaaaatgttttgtttgtttgttttttgagacaacagtctccttctgttacccaggctggagtgcagtggtgtgatctcggctcactgcaacctctgcctcccggattcaagcaattctcctgcttcagtctcccgagtagctgggattacaggtgccagccaccacatctggctattttttgtatttttagtagagacagggtttcaccatgttggccagactggtctcgaactcctgacctcaagtaatccgcctgtctcagcctctcaaagtcctgggattacagccatgagccactacatccagccagaaagttcttctttttctttttctttttttgagatggagtttcactcttgttgcccaggctggagtgcagtggtgcaatcttggctcaccgcaacctccgcctcccgggttcaagcgagtctcctgcctcagcctcctgagtaggagccgggagtgcagtaacagaaggagactcttgtctcaaaaaacaaacaaacagcctcctgagtaggattacaggcatgcgccaccacgcttggctaattttgtatttttagtagagacggggtttctccatgttggccaggctggtctcaaactcccgacctcaggtgatccacccacttcgttctcccaaagtgctgggattacaggtgtgagccaccgcgcctggcctttttttttttttttttttaagacagagtctcactctgtcctccaggctggagtagagtggcatgatcttggctcgtcgcaacgtccacctcccagattcaagcaattctcctgccttagtctcccgagtagctgggattacaggcatacaccaccaagccaggctaatttttatatttttagtagagacaagatttccccatgttggccaggctggtctcgaactcttgatctcaggtgatctgccgaccttggcctccccaagccctgggattacaggtgtgagacaccgtgcccagcccagaaagtttataaaatcacttttaaccccatcgtccagaaataactactacatgtatctttctggttctatctatgcatatcatcatctatatttttaatgtatgtaaattaaatcttttaaactattttcatttcacatctctctatataaatacatatattttaacatacaaatatacacattcatatatttattgagacagggtcttgctctgttgcccaggctggaatgcagtggtgccatcatggctcactgcagcctcaaacccctgaactcctgtctcggcctcctgagcagctagaactagaagtgtgcaccaccacgcccagctatttttatttttatttttgaaatggagtctcactatgtcgcccagactggtcttgaattcctgggccccagtggtcctctgaccgtggcctcccaaagtgctggggttacaggtgtgatcatgcgtggccacatttatacattttttaatggttatatagtatttcacagaatgtactgcaccataaatgacttatgttttattttttaaatttatgtattttatttatttatttttttgagatggagtgtcactctgttgcccggactggagtgcaaaggcgcaatctcgactcactgcaacctccgcctcctaggttcaagcgattctcctgcctcagcctcccgagtagctgggatgacaggcatgcaccaccatgcccagctaatttttgtattttagtagagatggggtttcaccatgttggccaggctggtctcaaactcctgacctcaagtgatccacccacctcaacctcccaaagtgcttgggattacaggcgtgagccaccacacccagctttacatttaaaaaaaattttttttaaacattctctactgttgatatttaatttagattgcttccaatgaaaggccctttaaaggctcctctcttcctatgtgacattgccccagaagcggcgctgacacttcctcagaaaagccttcactataaaacaccaagtacacagcctagaaaaaaactcagtcgattttggctcgagttcttccacctcaggcaccccctgtgattctctcttccagtttttcatgggtctgcggcctcctccatccagcgttcagatccaggctcacagaaatccccattttttctttcttctctcacacccaactttcccattgtgcaagagtgaagggaaaactttccaaatatcctgattgtgtaggagtgaagggaaaacttcccaaacaatccccaggcccccgagctggtatttcaaaaacacacgaggctggatgtggtggctcacacctgttatcccagcactttgggaggccgaggcaggtagatcagctgaggtcaggagttcaagaccagcctggtcaatatggtgaaagcctacctctactaaaaatacaaaaattagccaggcacggtggtgggtgcctgtaatcccagctactcaggaggctgaggcaggagaatcgcttgaacccgggaagcagaggcagcagtgagctgagactgtgccactgcaccccagcctgggtgacagagtgaaactctgtctcaaaaaaaaaaaaaaaaaaaaccacgtgggcctttctttgacaattaaattcctgttactgcagaaactgtgtccaactctccttccagtgctggaagcagccaggcttgcagtggcatcccgatgatcaaaacaatgcacttgcctctccctcagaaagcatcctacgtaccacaagggttaatggcctaattctttattatcttccccatccacattcatcacaagacaccctgcccaggaaggcaagaatgagaggttattgttaagacagaatgaatgagacaatgtgcagttctgttcctctgacctgacaatgtgactgaggcaggggctctgtgaccagagaggggccccggctaggcctctgtgtgtcccagcacagctgcctccttgtgctgtggagaaacaaacctggctcagaagtctctcatcccagatgcttcgacctcaagagcaccagaggaagctgagaaattcgagatgctgcctagagcccatgctgcctctcagtggatctcttggatccaattcctggctgccctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagttttctaaagtggaggagtttcaggaagttgccggaggtcatgagaagagcaaagatttctttgtggcactgtttttttccattccaaacaaacaaaacagaaacaaaacaaaatcccaaactcaaaatacaatttcagagaacaccccagatttcccaaagacagactcactctgtagccactatctgggggatgggttcatctagcagttccaagctgtgcaggatccaatagcagagccatgggcggctggcatccagacactgggagagagacaggagagaaaacatcccttattcacaatcactccaagacactgctgccaaggctgtatctgtctcactcccagcagcctggcaagggggaggagggcacccttgctcaaacaacaatcagtgaataaaggacactttgctttgtggccttagccaggagctgaaatgaccatctgttaaaaaaaaaaaaaaaaaaaaaaaagataacaaggctgggcgcggtggttcatgcctgtaatcccagcactttgggaggccaaggtgggtggatcatttaaggtcaggagttcaagaccagcctggccaacatggcgaaaccctgtctctattaaaattacaaaaattagctgggcatagtgatgtgcgcctgtaatcccagcgacttgggaggccgaagcaggagaatcacttgaacccgggaggcagaggttgcagtgagccgagatggcaccactgcactccagcctaggcgacagagcaagactccgtctcaaaaaaaaaaaagaaagaaaagaaaaaaaagacaacaggattaaaaaaaagatgaccctgaacccagtggatccctccctggcaggcatctaaggaaggctgagcagaggacttcctacaggccaggaggttaggggctgctattttctcggtatagaaccaaggagatatacattctctgaagagatttcctagcttaactcaatcactgattcaacaaatatttgatagtatctacttgtgccaagcactgtattagacactggggggatgataataaaatttggtttctaccgtttatttttttgagacagggtctcgctctgtcacccaggctagagtgcagtggtatgatctcagctcactgcagcctcaacctcccgggctcaagcaatcctcccacctcagcctcctaagtagctgggactacgggcacacaccactatgcctggctaattttttaagtttttatagagacagcatcccactatgttgcccaggctggtcttgaactcctgggctgaagcaattcacctgcctgagcctcccaaagtgctgagattacaggcattagccaccatgcctgaactggtttctgttcttgagatgcttgggatatagaatgtgtgtggttacctgtaggggaagagagcactggacagacatataagttacctcatgtctttctggaaccaacacgtgtacatatacctggagaaatgctgtaatggacgaaaacagagttttgagggagcacgtggaagagactgactaattctgcctggggagctaggaaaggcttccaaaggcaaaatgcagacggctcttgatcctaattaaaccataaatgattattgagcattcaaggctaggcagggtaggtaggagtactgccccagttttataaattaaaatatataaatgaggtccaaagattaacctttttcagattataaaaatagcaaatgtcagaggtgagacaagaacctaggtttttagagtcaatccagtgttctttccgttggcccaagctgctctcttcaaaactatgctgatatcccaagctgtggctaacccaccacctggaaggtaggctggtgagctactgaagacactgccagggatgcagcttaagtttgaatcccagctcctcatcttactcgctatgtgcctttgagcaaatgacttaattttactatgcccatttcattatctgcaaaaaacaagagattgatctacctcatgtagttacaagatttaaataagagaatgcaactgggcgcagtagctcacgcctgtaaccccagagcctcaggaggctgaggcaggtggatcacttgaggtcaggagctcgagaccagcctggccaatatggtgaaaccctgtctctactaaaaatacaaaaattagccaggcgtgatggtgcacacctgtaatcctggccactcagaaggctgaggcaagagaatcgcttgaacctgaggcggaggttgcagtgactcacgatcatgccactgcactccagcctgggaaatacagcgagactccatctcataaattatgagagaatgcatggtaagctttcagcacactgttcaataaattgttagctgatatggtaccaactgtaacataactattgaggacttgagtcaaggattgaaaattcatagcccacaggccaaatctagcccatggatgtgtattgtttaactggtagtagctgcaacatttgtcaggagagtcacatgaaaacgtgatttccggcttcatttggaggaagaaaaaaaaaaaaggaaacaaagatgatttggcaaccctgggtctgcattcccagatggcagtaatgggcaggaaagaagttaagggcacagggtctccagttagcctcagtctccatgcagcccacttcactgatttatgctgcctgcctgggccctacaggcatttgagttggcaaatcattgccacaaataatcaaatgtggaacccaaataaaaagcagattaaaaatagagatgctgctctgtgttaagcagggcagaaagactggagacttcctgttcacattcaccctttgcctgccgctcagtcccatccaacatctgtcccctccaccgtcacccagtcctgacgttgctctgggaaatattaaagatctactcttaaacagtaatgttaaattgcaaggaccactctctatactggtcctctagtcagtatagaaattagatcttattacaagaaagggttttttgtctctttaatgaagatatgaaaagtaatgtacttactagaaggagtggtgaagttggaaaatttgtaaccatcacgatacagacttaacaggtttggacaatagtcctcaataaatgagcgagaaattagatcagcttatagggcaaagggttaagggtgaacaggtaactggcatttagccagctgtcaaggaggtctagataaagcacgtgaaccccttagtcatcatctagtaacagaagaaagccccatcctatctagggtgctccactcactctggaagagactaggttctgccctttcagggctgagtcccagctctgtgacagcaccctacctcctgccagagccacagagaacaaagagtgactctgcaacaggtcagccccaacagtcttttacgtttaaatagaaaaaggaggaggatttggtggataatttgacagcaagagttcctgggtaatgtgtttacctcataggcatctgtcagttgtcgaaggcctcttttcagataatggaagtgcttctccctctgcaaaacaagcctggaaagacaaacagtttataagcccattctaatagcttatgcttccaccatacacacgtatgtgcacgtacacacacacgggtaaacactcagcttcaggacgtccccctgcaatcactgactggataaccagcaacttctctggttccaaagagcaactaaaccagagaaaagaagctcttgtctgaatgtctctaaagcatctgaaaaccatgccagctgacatttagagtgcgattgtctcctaaaggcagtgactttgggctaacggaaaagccgcaatgagcacacgcagccaggcaatgacagtccacccagaaacttcctccagcatctaagaacagatatctttgtgcctccccatcctataagcaatttaaatctgagcctcgccacttccctgcctcagccgctgtcatttcagtcaccccgtctgggatgacttctccaaggcccataatttactccctgcctgcctctcggttatccaactattattctctccctgaaattccacctcccacgtgtgacccacagccctggccagaggaccgtgttctgcagccagtcgctgtccttggctttcaagtcagcaatactggctttaagatggaatgtgccgcccatggccacctgcacaggccgggcaaagcacagaggctgcacttctttcttggtctggcagaagagcctgtgtgactagggaaggaaacaaaaagcacagattgtcaagatgttccccgtgcttgcagattacagaaacaaaggaaagagaaccattccctttgctaggtagtcaattccacaattgtttatcaaattcccactgtacttggctcagagtaagagccttcatgcagtctttttttttttttttttttttcctgagacggagtctcgctctgtcacccaggctggagtgcagtggtgtgatttcagcttactgcaacctccacctcttgggttcaagctattctcctgcctcagccacctgagtagctgggattacaggcacgtgccaccacacccagctaatttttgtatttttagtggagacgggggtttcaccatgttgcccaggctggtcttgaactcctgacctcaggtaatcccctgccttggcctcccaaaatgctgggattacaggcgtgagccaccgcacccagcccttcatgtagtctttacctcaaaaactcttccaattcagaaatgaggtaagtatatcaatggctacaaggaaagaatgggtaggttttgcaagggaaaaacatactactgaggctcaaaagggaggggatatctcatgaagaaaggaatgatcaggaaagtttgtgtgaaaaaggaggaatgtgcgatgagtggccctggcagaaggagaaaattttaattcaattttaattcaagtttaaatagctgcaggtggctaatggctactctactatgctgcacaggtatcaagtgtacaagaggagtgacaggtgggagaatctgacctcaatacagggatgaaagaggaatgggaggaaagcaggagtactgccccagtttaaaaacaaacaaacaaacaaaaaaacaaggatctgggatgctgactaaggcatttctactcaatttactaggcaaagggaagtcctgaaggtttttgagatgaggaaagaaatgatcagaactgtgctttggagaaacagtaggtagtcagtatgtgtttacaaactgaagtatctgaaaatatcgcagtgggcagacagatggggtggggagacagggttagaagctctgaggagctgacccagttggggctacttagggcccgaactagtgtgtgacccgtgatcagctgacttttggatgtgtgggtcttaggatgctgggactgcattcaggtgatgatgtcaatcaggctgctggacacacacgtgaggctcaggagagggattcaggttacacacacagactacgaagcatttgtctgcacacaagtgacaggtgaagccacagaaggtgagagggcagagagagaagtttggaaacaaaactgtgggaagacccatctctaagggtttggaggagccagtgaaggagagaaacaggagagtttacatatgctagggaagagcaaaggaagtgtcatgtcacaggccatcagggaggagagaatttcaggaaggtgtttaacagtggcagatgctgcagcaagactgaggggaaaagacaacaaaccacagaagggctagagacctccaagagcattcagagcagaggtgaaggcaaattgtaaacaagagaaggccagactcagtttctctttcaggaaagtccactcaggacgcagggagcacccatctgtgtgggcagagtgttgtccagcactggggtagaggctgctctgtaccctagagcgacagtccagaggtggacacacatgtgaaaatgacaagcagagccctgtccaataaacgctgtgatcagccacgggaagagatggagggtcagaaaactcttcccaaagggaagagcattgagtttaaggctggaaagacatgagttaagcaggcaaaatgaagaaaacaccatgacacatttgagttagtttagttcagctggatcaaaagtacaaggcagtaagcagagaaattccacattagaaatgcaaaagctcagaggaaatccatagggaaggtctgtaaagaggatggaggagggctgggatgagggtatagtaggagaggtgagcctggaataaggaaggatgctgcattctttgagcgagaaatgatgggtacgaagctagcgaaatataggtctctgatgtgggaagaaggaaacaggaaagtcaggtgggtcagcctcgattttctcaggaactaggagtcaagatggtgggagagctgtggagtggccacggtggtgggtgtgttagggaatctacatgagacgaataaaaggattataaggcagttagtgaagcgccagtgaaattaagaaatataacatgttggtgaagccagtcagcagcctcaggagaaaccaagcctgctgacaccttggtcttagacttctggcctccagaaatgtgaaaaaataaatctctgtggtttaatgcaccccatctgtgataccgtcttatggcagcccaagctgactaataccctcaccggtccttcattctcaactcacctctatccaaaaatcttttctgtgtaggaagttaagaaagaaaaggtagagctcttcctatttttacctgaacaattcagccccaaaaccattcaattacatggagcagaataagacaggtttcgtgcaggacttgagggggtgcagggtgggatgcaggctgtcagctcaagtggatgaggagggcccccgtctcactgtgcagagggtgacaggagagcaagtgggtaaatctattaaggctatgggaagtcaggtttccactgtctgagaaggaacttacacatctatgtgtactgggtaatgatttaaatagaatttcttatgaggggtgagcccactgggcttccagactcttcacaatgtgcctccacccacactactctccaacctcatctccgcccctgagctctggtcatgctgccttctttgagctccgctcctttcagtctcctggctttagcacatgctgttccctctgcctggaacactctccccatcctttaagttagccacccctattccacctacagattcagcttaaatgtcactttctgtaagaagccttccctaacttcccaatccaaattagattctcccagtgattctctctctcaaattatcccatcggtaactgtatatttgtgttcatttgtttaatgtccacctcccccactagaccaagagcccagcaggggcaggcccagggctagccttgctcactctggcttccctgagcccagcagagtgtcctgtcctttggagactctctagatactgctgctgaaagagaggatcacacaaaggcagcagaatggaatgagagcaaagccacttcctccccccaaacctgggccatcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgcccaggagaaaacaaatttaaaaactacatgtgagcgaggtatctgtgtagtttatgcatttcaggtttcttattaaagccaaggtgataaatgcaaaagggtacattcaaaagggtgtgaaaccgtgacaatacccacagggaagaaaaaatgaattttcatgggaaagcagacatgaataaacaaaaccatgaaaagcatggtcaaaaagctccttgggactgactacctcactccaggtagacagtcccaaccttagagaagaaaatcatttctgggaaggggattaagtatagaatgtactgacattcagctccaggcttgactttcagcccagtctgctattcagctttggccctggaacactgaataggcaaatgcctacttcagcatcatcacaggcatccctggacctgtgcgtggtctgtggtcctgggcatgtgtgtgagtctgtcccatttgatcagcatcatgacctcagacacacaaacaagccctgccatctagatttactgctaacagctaaccatgcacttcagctaacagtgaaggttacttcctgtattaaagtgtcagacttttaaattttgactattaatatgttaaatattgagactgtgataatgatttaaaattctgataaattttctaatttattcttatatcctcgcttattctatgatggtgatgtttgccttcagccttatattgatatgttgaattatatactcagccattcagccaaaatgtatagtatctccaatattaattagcatcctttaaaacactcaatttcataggcaacaatgataaaaacgggtaattgtgaaattcctgaaactaacccagagccctgatatattctatttccacaaggatccgagcccaggaggaacactttttttttcccacccatacttgacctaccagctatgaatcaggggatttcactcctttaatatcatctaccaccactctcaaaaaacaactgcttcctcccagactataacctcccattttccctcatatctcagtgtgaataaaagtctttcttcagctcatgagctaaggaaaaacaaattttaaaaaaggaatgaaagagaccaagggctctatcctgatggtaagtgaaaagggaatgtcaaataatcaaaggttcatgtgagaaacagaggctgtgtgtccccagagcccaggcagtggacagtgactcagcccgatcgggtgagtcatcgggggtacaaccacaacaacaaagcccctccaaaagcaatcacccacaccctcaccattatgaagtcttgtcccctctggggaggctaagcttgaaccagcttgtgcctaggggcagcgaactgccaaggataccattacatttaagagagctcgttctcccaagctatttaaataaatggcgtcatttgctaatctctagctgtatctcatgacaagaggaataattcattttattgaggtcagagcattgggttaatgcagagatttggtttagcagttaagggaaagactatactagtaagctgatatttttcctcctttccttccccagggaacaaagatgaagttaaccctcccacctgtctttccttatgaacacttgccttttccaactgttttctgccatggctaatcagaaaaagtttcttaaggaaatggtggc

SEQ ID NO: 37440 - DNA, 398085 bp, Homo sapiens; identical to SEQ ID NO: 36796

SEQ ID NO: 37441 - DNA, 384797 bp, Homo sapiens; identical to SEQ ID NO: 36500

SEQ ID NO: 37442 - DNA, 138741 bp, Homo sapiens
cgcgagccgggaccacgccgacccagcgtgcccaggccgaggaaagcgcggcggcggcagtccgaagacccaccgggactgaaagagaaggacgaggtcatcttcggacgggaggggcaagccagccatcctgggaccccaggcgtgcaggttctctttgagggtaagtcacggacacccagccagaatcccacaggtcactactggggtcttcgggaaagagggcgtttgtggtccccaaggggtgtgcttagtggggatgctgagctaagggtgggaggggaggggcgctgtctctaaccttagtccctttcagggtgggtcttcagactgtgaccagtttagggccagccaccaccaaggccatggcgaagaaaccctaatcgctgtggctagatctagcctcagaagcaacgtggattcttgggccacgcagcaggcccaggatccttgcagtggctcttagggaggaacgtgcacgtggagtgcactctagtagcactccacgtgcacgttcttgagtgttgctcaagaaccatcttcacaggcgaagaactaacgtctcgccttccattttgtacccttgtcatacatatccgccggttcacaacttgtatccccttccacacagcacagatttgctgtcgcaattggtctttgcaaattgaaggctttttcactgtaacagcactttctagatgggggagcggagagaactaggaatcctctccaagaccactccccagtttggatcagcaggccttgaaggaagccgaataagatgctatctgtgaagtactggtgaaactagcaacattaggaaacacagacctgaaagcgagaagaaaagaactttactacaccaaagggactgctctggaatctaaccaatcataactgccttagagagtgaactgtgtttccctccctaagctctcgcttcaacctcatgaccggactgcatttctcaaagagctaattccacatttttccaggcagatgagaaaccttactgtgtggtaaatcccacaaacaggcccatttttcaccaattaatctctgcccacagtcatgacctaaaacagaccattttcgtatatggtcatagttcacatgcatagcaaaaggcactaagaaattagcacaagaatttaaccaaaatgaaaaagttccagaattccctttcctttgcttttccttttctaatgtattacccaaatgcttgtcctaaaagataaaaattcaaaaggtcattttatccccatgacaagaaaaaaaatgctcatttcagcaaaactcagcaaatgtattttttatatgatgtgcatagaactcattaccaccagttgaagattaaagtaaaaaatggatacattttgagtttgtacagaagggcgtgacaaaactagcaccagcattattgaaattcccgttataaattccataggaaataataaattgatttgaaaattagaacaaattcagattaacaggtgtgtgtgtgtgcatgtgcgtgtatgtgtgtgggcatttaatctgaagttatcatctaaagtaggattggcacgtgatcatggaaacggtagggagtagaaatccagttttgtgagtttttgtctgggcctagccattcatactctgccattaagcaatcctataacttttactggccttgttcttctcaaatgtgaaatgaagcaattaatttagataacctttgaaatcctttctagtcttaaaaagctctgatttctgtatgccaaaaatacataggcatccttaagactcacctttcaggttgccaataatataataagagcaagagccaagagcaaccttttatattatttatactaccaaactaaaccaaagtctcagtgttgacaagtaaaaataaagggattgtgtcaaatgactgttttctgaaaaataaaatccaaagccctcttcacaaaatcgtcttcaagattctctagccgccttttagctgtcattcaggtttttataaggctacaagcccaactctttcaataacccatagtcggagtgcatccctctgaaggccaacctagcacctgagagaattctaaaataaagtgtaaggacgtgaccaaagaccatcagaagtttacttaactaaaaatatgcacaaaaagaatgagctagctatgtttatagtaactcccttctctgtttacagtctttgtcaaagattattactaggccacatttcttagaggtcagattatttaattattcccttgccaaacttaaacaaccaataaaattacttagttctttaggttcaagaatttatgaccattatctgtcatgaaaaaaactgaagtcacagtatacctttgacttttcccagcactttaccccatccttattttacctgactttgccttccctcacgtcttttttttttttaattattattatactttaagttctgggatacatgtgcagaacgtacaggtttgttacataggtatacacgtgccgtggtggtttgctgcacccatcaaggcgtcatctacattaggtgccttccctcacgttttgacccatcatctctccactccttagtggatctctccactctcctggtttaccatgacatgggatcctggctgttaccaccctgctcccaagtcattttaggacaatgcaagcccctgggtatttctttttttctaatttctcaggataaagtggtctgacacattttaaatatcaaagaaactcagaaataggcagtaaattaaccagtatcattgagattccaaatttataaaactagagtcatccctgaagatacatgcaaaaccttataaggtttttcaaagaattaaataattaacatttacgaccttatatttaaaaacaaaaatggacaagcttttctctagcatagaaaggatcattgttttctgtgtgcagtagcgactctgttgcccaagtatgttaacaatacctatgttccttccagctaatactcatctcagaatctgagcctcattttgactcattcttttagttcttttcaacaagtagctatttagtgcccactatatgccgagatttgtactaaatgctatttagaacattttttaaaactataacaggtccttcagagttttctcagagctgcagctttatctgggagatagaatgtctgcacatagactattaaatagcacaaaagaataaatatgtgattaagaactgttgagaacaatgtgttaggactattaaaacagaagaaaatcattttcttctagggtgcccccactgtgtaattgtttcagcttgttctcagtttctcattcttctagttccatttctctctcttacagtcttccttctttctctccccagcatctgtccagatggctgtcttctgatctctctcctctttcccccgacctctctctttcaactctgtattatattccctaacttcttttacttctcctacgtaccatcccccctctaccagcatttaatctatctccattaatgaatgcattcattcattcagtatttattatgtgcccggtgtgctggacactgtgctagatgacaaagatataatggtgaagatgtggttccttagtctaatgaaagcaagacagtaagaagactattacagcccgttgtaacaggagctgtgatacagaggtaataatcctcagtgtactctgggatctcaggagcccagactacagtaggagtagcaggtaaggagtaatgctctggaggactcagagaaagtgatttctaggcttgatattaaaaggtgaatataagttacctaagtaaagtaagtagaaaagataatctgggcaaaggaagcaagcagtgcaaaaatctggaggaattcagctatagtgcatttggataactcaagtatcctatggcttaagtgtaaggtatgatgggactacagagatggtgtggccctactaatggaactggagtttgttattatttgttacataaaggtttatgttctgttatcatatttgcttatttacatggctagctctgcaatatattcttcaaacaagaattctctcttattcaatcttagctcaatcttcatgcctatagcaagtacttagcctacagcaagtcctcagaatttttcaagtgtgttgatatttctcaaaactattttaataaatcagactttaactgtatttcctttgatttttggctttattagtcaatgaattttaatagaaaactcttaaaatagaatataatagaaaaaacttttcatattgtgattttaaaatatttttcttaacattcatttgcaccaaatcactaaaagaaccctttttcctagatttacaaaaacaaaattacacatatgtttatgtcgtatttcactttcaacataaaataaatgtttcagagatgtgtgggtcattttttattttaactcaagtgacagtacctgaattctttggctgtgaaagcatatattctagtacttttaagaattttcctctttccgtttcaagttttcagagcaacaattgtatctctgacacaaatttactattatacttttaaaatataacaattggtaaaagtattaaatctataacgcttacccagaaatttcctggattttttattataaatctaaaaactgaaacttgaacaataaacagcaatgcagactctttccaagttttcttgttccctccctagacaagcaggagtttcttcagctctggctatcccagcagatctgaaggatcacagccacgacggtggcagcctaccgttgacactgaacttgtggttaattgtggagttctgccacaaaaccacctcactaccacaaactggatacttgcccaggaaagtgacaaactgccaggccaagcaatctacaggaggcagcaaaagcaaactgccttttcccccagaaagcagtcatttctggattccaaatggagccaacaagcagagcgcaccaaaaaaaaaaaaaaaaaaaaaaaaaaaaaaatatatatatatatatatatatatatatatatatatatatagagagagagagagagagagagagagagagagagagagaggtgtgtttctccactaagccaacttaaaatgtattcatgcagttttgcaagaggagctcaaaaggattcatctagttcattagcatcatcaaaaagtgtaagactattcttttcttaaaaaatttttattaagcatggaattagaaataaattgcagttatattactattaactgctaagtgaaacacctacatattatcattgcaaataggagtaaataatgtgacttcgtgtgtgttactaagctgcgcacagcagcacagcagctctgggaacttcatttgaaaggccaggtagcacgatgtgaaggaaggaaactttagcgtcattctgatctagttaccatttgtagctacatgaccttggaggttacttaaagtctcatgttacctacctcatctgtgaaatggggataacaatgtctacctcttaaagagttgctgtggattaaattaaattacacgtgtaaggtaactaacaatgagtagatgcttagtaaatgtaaattagtttatttttcttacatctatccttttccttatcctcccacatcccttcaggacttcacaggactctgttaattctgagtttttccaaggagacctccagattatattgtctgttcaactctttttaagccttactttcaatattattttattcaactaagtctgcctttttactatacaatcaagtaaatagctctctttcttcaaaaagcaaatgctacagggatgttaatgcctctgttctaattactataaatgcagaaatgttttatatattaaattttaaggaatgcatacataatattatcttaatttcatggccctacatatcttagatctcattctgcagaaaagatgttgatttagggcctatatgttgtaacatggagaaacagaaaaaaaaaattaagccgtaaccaatttcattcatattagcattaaacatagggaagacaaaaaaagatttatgtttgcaaatgtattcatttattcagcatgtacttgatgctactcagatactaaaggtacaaatatgaataagacacggtccctgtcctcagtttggtaaaggagaaaataagtaaacaaatgcagtacagtgcaaaatgctctaacagagttcttaccaggtacagtgataggacatggagtagttcacagatgaagagatactaacctaggtattgaagaataggagcttcccaggtggacaaggaggagggagagtattccatacaaagaacagtattgcaaagccatggaggcatgagacatcatgggcatttctggaactttaaacagattggtatgatttgtgggggagggaagatgggaatgggaaaatgagactggatagataggtggaagccaaatcatgggaatccctataggccattctgagaaacctggactttattctgtaggtggtaaggaactgttaagttttaaaggagggagaagccatgatcaatttttattgtatttaattgtttttcaaaacccaatgctggtattgaatgaaggttagtttgaaagaatgtaagaccaaagctaggaaaatcgtttaagaaaccattataattggccaaatgaaagataaagttctgtaaggcaatggcagtagtaccatttggaaaggaagaattaattgaattaataacagctataaaactttctgatcagttccatagaattggaatgtgcagaaaaggagactgtgaagagggttccccaggtctagcctaggtgactagaatatcttgaaaccattgaacaggataagaagtactagaggaataattgagagtaaagattatggatttccttttgaacagattgaatccaagtgggaatgtttcttggccattggatgtatgagtctgaagctcaagaaaacaatctgggctagaggtatagattggaagcctgtagtacatatggagaagtggaaccctgggagaaaaagagatatcccctatgagagtatatagtgtgagaagagaagaggatttgtttttgaactcaggaatacaaacatgtaagggacaaggaactaaagaattgctcaaaagaatgactgaaaaggaagtagcaaagctagaaagagaatcagacaggagtggtgtcacaaaccaaaatgaggaagtttccagaagggggacaaaaaagcataaaataccacattctaaaaagatgaggacaggaaagtaaccacgggtgtcaatgaaacctgacaatgacaagtttcattgtcaaccttatgtggaacagttgccacagttggggcagaaaccagattgcagtggattgaggaatgaattaacacttattttgacattaagaaaagagagtttcattctagaaagtttagccaggaaaaagctttacctttagtttcatcatttctttgttagttttagtgtaaaaagaaaatttgagtagtttattgatacaatataaagtacacatataccaacttttctcctgtgtaaaaaaaataagtttaaaataatggattccccttaatggtatactacctacagtcttccctacatttctagaaatagatatgataaaccaacacttattttgtattcatagtgctatcctacaaataagagagtaaaaaatatgacagtgaggctacagattctatataatacagaaacaaatataaatgtctagcatagctcttagaggttaaaataactaaacagttattatctggcttcaatgagtcatacaaccttattctgctttttttctcctacccctttgaagtcagtgagaaatctcccttttgaaaagattccgatggtaagatcattgaaatgatcttgttcaacattctttgtttaaaatcactatatttttaccagctccagaaataataaacaaacaactagatctactaatgaaaagcaaaataaagacttgtacatttacagaattttattaatgtctagtcagataattcaggcaaaagcaagagtattttatgtcattttcctgctaaataaccaggattaactgcagcgctccagttcttaacctaacatcaatcttcactagaattatgcttggactgttcccagtgacaactctctagcatggtctggtgctttggtaactatattaaatgtaagtgcaaactgtgaaaaataacaagaaaccttatataaattcaagattttaatgctgtattttgggatgtgtaatcatgtttgaaaggatcactaacatccactctaacatgaacaacactttaaacaaatcaaaactatggctctttaaccagtaaacttcatggctatggctgattttattccttagagaccctcctttttacaggtgaaacggtttacatcagatttcctctcattatagcttctcaaatgttgtccagaccagcaagccactctctttaaacaaataccagccaaccaggaaaccatgaggttttattgtgctataaaatagaccagacatttctaaaccttcataggaatgaacctgactaaatctttactaaaaatggtttcaaaataaactgtgggctccaagtttctctaacaatcaaaatttcttcatccttcatcaatctcactctcaagctctttactcttccagaggtacacagtgcagtaagtttctctggccacatgttcataataataactaaaggctccagttctgtttacttattgggatataagaatgaagggatatattagcttcattccctgcatacattcacatttgtcaaaattctgtttcaaattttcttgtatactaccagcccctaaaacatgagctactacttcttgtatcatgggcatagaaagcctgaattttggctatgcacggtggctcatgcctgtaatcccacacttcagaaggctgagttaggagaataacttgaggccaggagttcaagactagcctgggcaacatagtgaaaccctgtctctacaaaaatcacttaaaaaaaaaaaaagcctaaattttacgaagaattaagtggaatcttcgccttcaaaaaaacatatcccctttcattccattcagcaaatatttattaatttaagccctgtcctaggtaccctcgaaaagtgtgtgttgcatgcatttgtgtgttgcgtgtatgtgtacaagtgttgggatagaatcagttgtaaatggtcagtggggaacaagacatacacaaataactgtaatacaaaatggaatatccagaaacagcagtcccaacctttttggcaccaacgactggttttgtggaagacaattttccacagaccgggggggatgattttgggatgaaactattccatcagaggagccaagatggccgaataggaacagctccgggtctacagctctcagtgtgagcgacgcagaagacgggtgatttctgcatttccatctgaggtaccaggttcatctcactagggagtgccagacagtgggcgcaggtcagtgggtgtgcacaccgtgcacgagccgaagcagggcgaggcattgcctcacttgggaagcgcaaggggtcagggagttccctttctgagtcaaagaaaggggtgacagacggcacctggaaaatcgggtcactcccaccctaatactgcgcttttccgacggacttaaaaaacggcgcatcacgagattatatcccgcacctggctcggagggtcctatgcccacagagtctcactgattgctagcacagcagtctgagatcaaactgcaaggcggcagttaggctgggggaggggtgcccgccattgcccaggcttgattaggtaaacaaagcagccaggaagctcgaactgggtggagcccaccacagctcaaggaggcctgcctgcctttgtaggctccacttctgggggcagggcacagacaaacaaaaagacagcaggaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtactccaacagacctgcagctgagggtcctgtctgttagaaggaaagctaacaaacagaaaggacatccacaccaaaaacccatctgtacatcaccatcatcaaagaccaaaagtagataaaaaccacaaagatggggaaaaaacagaacagaaaaactggaaactctaaaaagcagagcgcctctcctcctccaaaggaacgcagttcctcaccagcaatggaacaaagctggatggagaatgactttgacgagctgagagaagaaggcttcagatgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagtgagaagggaagtctagagaaaaaagaattaaaagaaatatgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagctgaaatgaaggaaaaaatgttaagggcagccaaagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaaccggtaccagccactgcaaaatcatgccaaaatgtaaagaccatcgagactaggaagaaactgcatcaactaacgagcaaattaaccagctaacataataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagattttaacaccccaatgtcaacattagacacatcaatgagacagaaagtcaacaaggatacccaggaattgaactcatctctgcaccaagcggacctaatagacatctacagaagtctccaccccaaatcaacagaatatacatttttttcagcaccacaccacacctattccaaacttgaccacatactgggaagtaaagctctcctcagcaaatgtaaaagaacagaaattatagcaaactatctctcagaccacagtgcaatcaaactagaactcaggattaagaatctcactcaaaaccgctcaactacatggaaactgaacaacctgctcctgaatgactactgggtatataacaaaatgaaggcagaaataaagatgttctttgaaaccaacgagaacaaagacacaacataccagaatctctgggacacattcaaagcagtgtgtagagggaaatttattgcactaaatgcccacaagagaaagcaggaaatatcgaaaattgacacactaacatcacaattaaaagaactagaaaagcaagagcaaactcattcaaaagctagcagaaggcaagaaataactaaaatcagagcagaactgaaggaaatagagacacaaaaaacccttcaaaaaattaatgaatccaggagctggttttttgaaaggatcaacaaaattcatagaccgctagcaagactaataaagaaaaaaagagagaagaatcaaatagacgcaataaaaaatgataaaggggatatcaccaccaatcctacagaaatacaaactaccttcagggaatactacaaacacctctacgcaaataaactagaaaatctagaagaaatggataaattcctggacacatacactctcccaagactaaaccaggaagaagttgaatctctgaacagaccaataacaggagctgaaattgtggcaataatcaatagcttaccaaccaaaaagagtccaggaccagatggattcacagccgaattataccagaggtacaaggaggaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaaaccgaatccagcagcacatcaaaaagcttatccaccatgaccaagtgggcttcatccctgggatgcaaggctggttcaatatacgcaaatcaataaatgtaatccagcatataaacagagccaaagacaaaaaccagatgattatctcaatagatgcagaaaagtcctttgacaaaattcaacaacccttcatgctaaaaactctcaataaattaggtattgatgggacgtatctcaaaataataagagctatctatgagaaacccacagccaatatcatactgaatgggcaaaaactggaagcattccctttgaaaactggcataagacagggatgccctctctcaccactcctattcaacatagtgttggaagttctggccagggcaattaggcaggagaaggaaataaagggtattcaattaggaaaagaggaagtcaaattgtccctttttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacggagagccaaatcatgagtgaactcccattcacagttgcttcaaagagaataaaatacctagcaatccaacttacaagggatgtgaaggacctcttcaagaagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcccagaattggaaaaaactactttaaagttcatacggaaccaaaaaagagcccgcatcaccaagtcaatcctaagccaaaagaacaaagctggaggcatcacactacctgacttcaaactatactacaaggctacactaaccaaaacagcatggtactggtaccaaaacagagatatagatcaatggaacagaacagagccctcagaaataacaccgcatatctacaactatctgatctttgacaaacctgagaaaaacaagcaatggggaaaggattccctatttaataaatggtgctggaaaaactggctagccatatgtagaaagctgaaactggatcccttccttacaccttatataaaaatcaattcaagatggattaaagacttaaacgttagacctaaaaccataaaaaccctagaagaaaacctaggcaataccattcaggacataggcatgggcaaggacttcatgtctaaaacaccaaaagcaatggcaacagaagccaaaattgacaaatgggatctaattaaactcaagagcttctgcacagcaaaagaaactaccatcagagtgaacagacaacctacaaaatgggagaaaattttcgcaacctactcatctgacaaagggctaatatccagaatctacaatgaactcaaacaaatttacaagaaaaaaacaaacaaccccatcaacaagtgggcgaaggacatgaacagacacttctcaaaagaagacatttatgcagccaaaaaacacatgaaaaaatgctcatcatcactggccatccgagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcgcaatagcaaagacttggaaccaacccaaatgtccaacaatgatagactggatgaagaaaatgtggcacatatacaccatggaatactatgcagccataaaaaaggatgagttcatgtcctttgtagggacatggatgaaattggaaatcatcatcctcagtaaactatcgcaagaacaaaaaaccaaacaccgcatattctcactcataggtgggaattgaacaatgagatcacatggacacaggaaggggaatatcacactctggggactgttgtggggtggggggaggggggagcgactagttgggagatatacctaatgctagatgacaagttagtgggtgcagcgcaccagcatggcacatgtatacatatgtaactaacctgcacaatgtgcacgtgtaccctaaaacttaaagtataataaaaaaaaaagaaaaactattccatctcagatcatcaggcattagatggagcatgcaacctagatcccttgcatgcgcagttcacaaaaggattcatgttcctatgagaatctaatgcctctgctgatctgacaggaggtggagctcaagcggtaaggctcactcatctgccactcacctcctgttgtgcagcctggttcctaacaggccatggaccagtaccagtgtgggggttgaggatccctgtcctaaaagatagccaaattgcaatgaggatcaggatgggtgacataaagtagatgagatttaaaatctgtcttaaaggatgggtaggatttagatataagagaggatggcattgcaaggaagaaaaaaggcataaaaatgaaagtgttcatgaaatcattgttttatcagaatataaagtatgagaatgataacaataaaaatattatgaagcaactacagcatgtgaggtcctctaagcctcttattctcatcctcacaacaatctgccagtagaaataataatcctcatttttacaacacatgggacaattgagattaagtaatttgtagggcagaaagattaagtaatttgtcaaagattacacatctagtagttggtggagccaggatttgaacccaggccatggaactccaaagctctatgtgctttccgttataacagtaattgttaaactttggtacacaagaaccatccagataacttttacccagatgataaaaatgcagttgctgaatgctaaccccagagattctgattcattaaacccgagatgggactgaggaatctgcatttctaccaagcacctcaagtaaccctgaggcaggaggtctaggaaccacattatcctgaggtagaccagcatagtttcgaatagaccctggaatggatttgaacatacttaatgatgagtgttatggatgaaactgtgttcattcaaaatttgaattttgaaaccctaaccccagtgtgtctgtattaggaaatggagcctttaaagaggtaattaaggttaaatgaagtcctaatggtggggcactaatccaatatgacttatgtccttataagaagaggaagagacaccagggatggagaaaaaaaacttatgaagacacagcaagaagggggctatctgaaagctaaggagagaagcctcagaagaaaccaaccgtgccagcaccttgatcttgaacttctagactttctagcctccagaactgtgatcaaataaagttctgttgtttaagctacccaatctatggtgttttgttatggaagccctagtagagtaatacagtgagttaaattaacttcctgcttatcctaagctatttacatctgtcatatatcaggagctgtcctaaaaaagatccctaattatcatcgctatcataaaaattcacatttatatggcattttataatttacaaagccttttcacgtgctctgttacacttgaactttgcaacagcctacagggtaaccaaaactcaataaggcaataggacttgcccaggtttcttacaagttgtagagctgagttcaggtctctttactccaaatcttatgctgattttttctacatcagacatcacacacttcatgatgtgcatgcacacacatcatgaagtatgattaatatataagagacccatctaaggatatgtctttctttagctctagagagtaaatacctttacttgattttctagttacataagatacggtttcaagaatttaagagatgtgccaaaacggtaatagcatagataagataagaataggtacaagattcctaatgttcagttctcttttcaaacaattgactaggcagtaacaaaatggtctcatttatatgaattaagattatgcttttgctccttcagggcacacttgagtgattttctagtagtgttttgctcaaatgccaagtgttataaatttgtagactgccagactgtacaaaagattatcacttaagtaataataaaaactgtaaatagggaaaaaaaaaaagtgaaagaacagttagagatagaggaagtgattcctttactttcattttattttccagcacttcctctttaagttagcaaaaataacgttttttgaattggcatttgcagaaaacagttcatagaacacagtcaacattgtatactacatttctgtagatccagtacaggaggtagattctaagtctgtcttcttcataccctaccattttatcgttagctaaggtcttattccctggtggcactgtgttagtttgtatcctctgagaaacaaatgccaaaacagaattagacgtgcaagtgacttattgtggaaagtgcctatgaaagataaatggaagatagccagaggaagtggagagagccttcagactgtgatgcaagtctcacaatagggaaagtggggaaaggaaggaggattaggtagaaagagccttatactacagcatcattctaagaaagtgtcaaccaggccaatgtgaggtcctcaagccaaagtctcctattaaaaggagtccctcatctcacaggaatgggcctacattatacccttgctgttactgactaggagaagcccaaaagaagtattgcctcagtactgaaacaggggtggatccagaagagtaatggtccagtagtcaattatgttccctatagcagaagatttgagtgacaaattttcttttttgagatggagtttcactctttttgcccaggctggagtgcagtggcacaatctcagctcactgcaaactttgcctcccgggttcaagtgattctcctacctcagcctcccaagtagctaggattacaagcacacaccaccaaacccagctaattttgtatttttggtagagatagggtttcaccatgttggccagactggtctcaaactcctgacttcaggtgatctgcctgccttggccttccaaaatgctgggattacaggcatgagttaccacacccaggctgaatgacaaattttcttgattgccacagtccacctctttctctggacagatctgcttctctatgcaaatttagggaacacatcctccatgtttcctatgggcttttcttcctgagggaaaacttagaaggaagttagtgagatgaactggagccccattgctgcagttgggcttgagactgcaacaaggtacttaacttctcccacctctattatccattccaagtcctctcaaccctcagctatcaccttggcaagtaatggtagcttaccttgtggtgtgacccaaaccttcattcctgatgggtctgagctcttggcagtcatacccttttcaagtcagggtcgttgtacatgtcctttcacagctacagtgggccaaaggagtaccagcaggcttccaagtagatgacataggagttgcatacatattcctatccttattgtctataagcagcactaccttctcccaatgatcagggttgattacccctgccaagatgtgaccctattcttgcctgcaggtctctggacatgaggtgtccaaactgccctggcagtatctataacatatagttcaatgagacactcactgtcccctggcaagagtgcactccctctcgggacctccagccctgcagagcccagagttgcacatatggggagcccaaaatcccccattgagagttattgggagtgatggtagatagggctagtcctgattacacccatcgatggccattgtgttcctcctgctgatgacatggtaccatatagaggtctctgagttagctcagatccccatgtcatctaccacagttgcaacagcatccctttcccagttggtacctttggctaaaatggggctagaggaaagggttcccatacgaccagctaaaggaagaagaataatcctgagcttctctctgcaaaggatggcactgcctcctttgagagtgttgcttctgagctgacgtttcagctgtgcctttagatagctgttccagtgttctgtgaagttggctacttctaaatgattttgttgtagaagatatagctagagctcccatggtcatgagttcaatcctgcatctcctttactgtgaaatgggtcacctgttcaaatgttttttgtgtggtattctatacccatagatcagacattctttaagcccctggattatggtgctggctaaggtactacaatcaggaaagacaagcctgtacccagaataggtgaaaacaaccctctagcccttgtagttgacttaccaccaagtggccagttggtctcattaataaatagtgatataacagcattgatctctgttgctgacaggttggacattcagaagcagcagaagctaggtcagctttggtgatgggaggtccatgctcctgggcccatgcatagcctgtctctggcagcatggccacttttttcttatgccaaaatgtcagtttcagggtagccaacaacaaagactggcttatataaactggtctggttattatatctgcttcactgttcacaatctcttccatggtagatgctttctattgggccataatatgtcacactaaactcttcatgtttacctgcatacctctaccccagaactccttctctaaaatctttcaattattttctttccaggccccgaccagacagccaggacattggctatttcccaagtctatatatactgggccacttctcattccacaagaagtcaatgactaggtgcactttttacagatccacgcactgggaagattttccctctccactgtctttcaaggctatccttgaatgtggttgtaatgcagccatggtccattttgagcttgtactcacatacagaacagacccacccaaaaatcaagcttaagctttccttctacttcagttggtcttacggggcccccatatggccataggaacaagctagggaagggtgttatttcagctgttgtgaatgacatgctggtctgagctacctgcgcatgcaatttgccatgtcctttgtccttctcaggctcaatccttgatgtaattttccatattaaagtagactactgctggacctatacagccttgtgatttaacatatccagcagaaccaaacttgtaatgtgcagttctagacccatggtcactttgtgccccatggtgaagcactctgcctctaccagtcccagtaattcaccaagagctttttctcaaaagacatataattctatgctacaaatggcatagccttgccccagaattccagggccctatgttgttattctcccaatgatacttgccgtaagacactgcatgttttcccaccactgtcacctacaccatgagatgtgctggattgtatgccccaagtggcagctctgtttgcagtgcagcctggacctcttcactcaaagctggcaactttctatgtcactcaatctagcagtattcataggtttggaatacgccgcctccagaacccaaagaggcctaccagccacttcatttccttctttgtggtggcacacgcaagatgcagcaattttcttttactttgaaggggatatcttgtcatgtttatgaccattgcattcctaaaacacttcattgaagtttcaaatccctgaatcttcataggatttatttccaaccctctggaacactgtgtcttaccaaggcctttagcatactagtgccttcttgctcattctaaacaatcagcataatgtcatcaatgtaatgtatcagacgaatgttcaggcagtccagatttcttcagagtatattatgacagaaggcaggaacattaacatagctctaagtcaaaagtgtaattgaaaattattatctaacccacaggaatgtgaactgtttctgatcctctcttctaattggaatagaaaagaatgtatttatcatatcagttgccacataccatgtgcctgagacctcattaatctgttctattaatcacacagtgtccggcaaagcaactgcaattggggctactaattgcttgactccgaactcctgaaagtctgcataggtacccagtcttacatacttttctgtctagagcatctaggacctagcaggtattctatatgtattttatgaatggattaataaattcagtatgacattcaagaagatgcctactaacaggttgatttagctgatgaccctagctcatagggttatgaggattaaatgagttactaaatggaaagtgtttacaatagtgtctggcacataaaaagcattcagtaaatcttatcaattgtatttttccaggccgcagagaaccatcagatatgatagagagattgacattaagctaactccttgaccataagtttaaatgaaacatgagagacatgtgttggcctttaaagtgaaagagtctgcaatatttttctgagaatgtgaggtttccaaggaaaactcaaaagaaaactgattgtaaagctggaaagaaagaattacttatagaaacagacactttcatagctagtggagagaaaaaggtggttactatgtgccaattcattactagcattgctatatttaggataattttgagggccaaatgtggtggctcatgcctgtaatcccagctctttaggaggccaaggtgggaggacagcttaagcccagcagtttgagaccagcctgggcaacataatgggaccccatctctacaaaaaaaacaaaacaaaacattgaaaattagctgggggtggtggcgcatgcctgtagtcccagctactctggaggctgagcccaagaggttgaggctgcagtgagctatgatggtgctactgcactccagctgggtgacggaggggtctcaaattaaaaaaaaaaagaaaagaaaagaaagataatttcagaaaaatctcaaagttaaaatttttgacaaatgctttttactaataaagcaaaacatgatcttgaaataaaatgaatgagtgcaattatgcccactagccatttcacaaaaatggtgttttccattacctaaatgactatttccatataaaaattaattaaaagtacactcacagttttcatctctgacataggtcaatgtaacagctaatacaggaaaatgaaaaggtataataacaggacatacacacccctactcttcattagaagaaaaaagaatattttttcttgtataatactgtgatttgagaggccttaaagctgctattctctgacattagctttgtggtcaaatttaaaatgatcttgataactctcaggaaaccccaagtctcataaaactttcccaacaattttcacaatgagagctgtgaaataatttcagggtctctaggaaagaatccacacttgctacttttaagaaagctaggaagtgggttgttggacaagatctaaacatgaattctttcatctacaaaaaaagttgagccactatgaagaatttccagtggccactctgttatcaatatctcacaactaggtctagacgacctcaaaacttgggaaattgctttgctgctttattgccagtatctctgtctttacagagccttccagaatagaatcactagattgaatttattcctccagtaagtcagttgcttattagcacttttaacatccagatggtttgagacaaaggctaaaccagggataattcccaagtataaacagtggaaactctcttttgctgagggactctagtctactgggctatgggccagggcatgggtttcttttgcaacatcccaacactgctgtggccttttctataacccttgcaagtgaagtcacctgaaaagccaagagttaaactggctgtacagtctgaactgtgaagtttggaaataaattcaaatggaccaatagcctggatctgtttcatgaataaacagaggagttcaggcttaggaccctataaagttaagtcaatattagttatagaggaaatcctgtttgttcttcttctgttgtaattgtctttttaaaaagaactcaggtagagctttggggtatgttataatgctcaaaacatcctttaaacatacacatacacatacacacacacacacacgcacacacacacgagtgtttataaccaagaagaaagcaaatcactgttgtccttactgttaggtacacgagaattaaaagtgtttgctcaatatccttaaaaaatacaacttaaaatgccctaacttatgaaatgggaaatacttatctaggttctgatgccatatagtcaccttatcatgattattacaataaagataagtaagtgattgctattaaagccctttagttatgctgatttggcacaaatttttcccagtactcatcacctagaaattacacataacaaggtctgagtaatccagtgtttaaactttgagggtactaagagagtgatttctaacctctttgaaattatgacaccctattttgcccgttagacatcacaactcttgctcctgttatactgtctccacacactcaaggaaagcaatctattatatgatataaaaaacacttaaatgaatttaaattaatcttaatttcttcaggcttttacttgtttttctttataattacctcttctttgaagctgagtcaccctaggtttaagccagaattaacctctcctcttcgtgtattcttttagctctttatgtggtataaatctatattacagattttttttttgagacaggatctctctctgtcacccaggttggagttcagtggcactatctcaactcactgaagtgtcgatctcctggctcccctacttcagtttaccaagtagctgggaccacaggtgtgcaccaccacactcagctaattttttttatttttgtagaggcaagttttcgccatgttgcccgggctggtcttgaactcctgagctcaagcaatctgcttgcctccgcctcccaaagtgctgggatcacaggcgtgagctgccatgcccagcctatattacagtatttttaaatcatatttttgttgattaattttaagtctttccccctggcttaaatgtaagggccatgtttattcatcttttttccagaatttctagcacagtgcttaatacaaagggagattcaatacatgctagatgaaggaataatgaatgaatgcacaatggctgtggaggcagaaatataccagcatgtcaaaaatatcaacccaagaattattattctagtagcttaaagatatgcctgtataagatcatctgttacagaacttaaatccagtgagaaaatggatgcaaaaatactttataaactgtaaaatcatacacaaatgtgagcaaatgtcactgttacttactgtttagtatccttcagggaatagtttctgaatttgtgaatcaaactttgaaaaacagtatgaacttaactcattggaatagtaggaccatgaaaggaataataaatggaagccagttaacaacaagttgtcatttgtctataatgtaatgcagtaggagttcagttttggaaaaccaggccttggtgacatctttaaaatactaatttttgtgtcctggtttataaatgacaattcctttagatgcttaggatttggataattccatatagtattcccagaaatatgtgttaccaggtacaaaacatacaggcttgattgttcaaggaaacatgtattacatttggataactctactgagaggctaaaataactgattcatttttgaagtgaccattgatagtaaacttcagcagttctagaagaggcaataaacatatcagggcaatttgacaggctactgtggttcaaacagatgttagtggtagccaaagttcacaaattatgtcaatgaagctggattccattaagtcaatcagtaactaaggaaatagttaattgagatacaatcacaagctagaaaagcaggataaattaaagaagtaagaggaataatcacatttctcgataattacatgctatcagacagcagaatctgatgtctggaagataaagcaggcatatttcaaaaatggaaaaggaggccataggctagagcatgagtaattccataaaagcggtcaaatgggaatctttctgaaaagcaaatgatgtcctcacagaaggaaattgcctaaaaactactagaacatagtttctatgctacaaacataatctggccaaagtcatcagctagtaagttgcaaaatagattttcaaaaccaggttgacaccaaagcccatgtcctccacactgtacttctctctcctaggcaaggaataatcaaggtatgtgccaagctcccaggctgtgttgttccttacacctctcctgattccagtttcagtaaagccatgagtcacagcagcggtaacagtaagaagctttcagcttgtccagctcacttgttaaccccatatacacacacacacacacacacacacatatatatatatacgtatatatatgtatatatatatttcaaaaaaaaaggacaataaagaggctgaagatgaactcaaaccaagtagctgattttctgaagcagctaacctatttctgagctaacagtcttagtgtgtattaaattcttacttctgtattctctcagaattagagagaaatgtctattcactctttcatttaacaagcaattattgagtgcttaccctgtgccagtcactggagaaacagagattaatagaaaaagatttctgctgttaagaatcacatggttgaggaaggaagggggaagtagaaacagacaagcaaatgattatagtacaatgtagcattgatattgagaactaaaaaaagaaattaacagtaataaatatagggatgctacattgggggaaatatcccttcccaatttttggtgtttccttccagatggagaagattccactagtgtggtattccctaaactttgtccacccctcaactctttccttcccagagaaggagaaattacttaatctgattgattagtatgaaaaaagaaagtgggcatgcaacacaagccccttattttctccctccacacccactctcagcaggcagcctgaaaagaagataacttctgttcttccatgccctgtgtttttcacagactggcttcatgtaaggaagcctagagaagtccagcactgtctgtgactaggggttcactattaggaatcccttttgttcatagatacaaacgacattctccaccatcagtttaatctgtactaaatgtgttatttctcaagaggcaatataatgtagtggttaggtgcatagactctggagccaaactggttcataccctgggtttgctacttaataatagccatgagactttgggtcagttgcttaacctccctggggcttcaatttctccacctacaaaatagggctaatagtatctactcacaggatgatgtgaggattaagtgatttaacatatctaaagcacatagaacagtgcctgttacaaaataacttctccagaagtttgagctatcattactattattattattttaacctttatctattgtaatcttatttctcaatttgttgaaaactcaagcaggaaaaagtgttattaatatttattgggatctgatcgggcacagtggttcacacctgtagtcttagcactttggaaggccgaggcaggcagatcatttgggtcaggagttcgagaccagcctagccaacatggtgagacctccatccctactaaaagtataaaaattagccgggcatggtagtgcttgcctgtaatcacagctactcagaggctgaggcacaagaatagtttgagcctggtaggtgaaggttgcagtgagccaagatggcaccatgcactccagcctgggtgacagagcaagactctgtctcaaaaaaaaaaaaaaaaaaaactgttgggatcctccaactctcacctccaatagttagggaagtttaagaaatcttacacagttcttacagtcgttgcccttttgtttatagttcttggctctttactggatgaaatttggaagattgtatcagtaggtgccagatgccaggccaagcatctcagacttcagcccaaattggtttgaggttgatgcctctgatttccatgggtaaggcaggcaggcagctctttacttgattctcaaagattaatcccatgtccctcaggttatctgcacattctagagatcccctcttgctctggcctctgcgtgtcctactgcggtctttgcaaaaccctcctaggaagagaaggctctttcccacctagtcacaatgattctttccctggattcagatctgcctttcaggagttcaatgagggaaacaaacaggtaggctaaaacaattggaatacaaagtattaagtacagttaaaaagagatctaaatggtaccacagaagtggaccagtcaggacaggaaacagatggcatactgaaaaggagtgattaaagagagtttaataaggaatttatttacaaaggtataggcagttaaggacagtgaagcatcaacagtgaaaattgctcctacacctaggcctgaagaaacaaagggaaagagctattaccaaacttcagaaagcaagctataggagagagctacctcacaggaactctgtttcaggtaatgcagcccctgccaatccaaggcctggaagagagggatgtaggaaaatattacaattgtactcttctgtcctctgagtttctttcagcgtgtcccactgttcaaatctaccagaaagtcagaggacaaggaaacctgttactgtcatccaaagaggtcaacctctgaggacgcagggcaagtagagaatgctggagaggggatctcaagtggccagcaaagaacaacccagcacagaagcgaagggactaacactttcttaagatttcataaaagaccttttaaaggaggttatatttgagataggcactgaaggataagtaggggtttaccaaatagagaagtgaataagacattttaggcaaaaggatagcattgtcaatatctcatagatatacaaaagaacttgcatgggctatatattcagacaagcaatcccatttggcagaagcacatgatgcttttggagagatgggtctgaaaagaaaagttaggatcagattataaaggctcttaagtgccatgctaaaatgactggactcgatcctgtagttaatgaggatccgctcagaaactttcagagaaagagagtgacatgagcatagtttaagttagaaaaagatccctccaatggcagtgtaaaggatggactagagtactgaaagactaaaggcaggaagatcattttggggatctttgccatagtccaggcaagataaaggtgaatggaactaaagcagtggcagtgataaggaagcaaagattctaggcattttctgaagatttaatgaacagaactggatgacctagtaactatgaggaatgcagaaaaaggcaggctctagatgagaatcaaatttctagcttgagaaactagatcgatggtggtactattaattaggagagaaaattcaagcagagtagctttgtgtgagactgcatggatttcatctttctgcgtactgagtttattatgcctatggatcactaacagaaatatctagttggcaatgaacagtagaaggccaggctctgaagagagatctaggagccagatatacagtctgaagaagaacaattcattatttggggttttttttttcagcttatatgaaacatattcaccaaatttttctcaacctctgtaacaaaggaaaaaatgttactcatcatataatgaaataaaccacagagttagaaataaatccactgatgacacttcttaccaggggagagtttttcatctgtttgttaataatagaaactcctaactcagaattgcatggtagtttaggagtattttttaaaaaaacaaacaaccctcagtttttaaaactgagtactgtttgcttgttatatttaacacttggttattttgtaaataatatccaaattttccatgaaagcttcattttattatttaaacccatatcccagtgacatgcaattgttcttcaactgagacatttgataatactgtgacaagcagagttcttttctcatagtaagttcaatataaatatttactggatgaatggataggtagaaggataaatgaaagcagcagagtgtgataaagtaattttgattttgttataaatgtgatattcatatataaatgtatgaaaaactgtaatcaagagaattacaaatggtctacttttgtttcatttgtggaagatgccagaattatttagacaactgcctgtttctcctttgtgtccagaggcctcaaccaccttacttaaaaagaactgaaatactgttcttccagttctttgctgtataaaatgagcacaggtatagggtttcactactttacttcttttgtgtaatttcctacataattattttgaaatctcagaaatatagttctgattatctgaaaccaatggaagtctgtccttaataccacataatgaggcacagtagaaccagttgatttttggctgggcacagtgctcacgcctataatcccagcactttgggaggccgaggtgggcagatcacctgaggtcagaagtttgagatcagactggccaacatggtgaaaccccgtctctactaaaaatacaaaaaatttagctgggcatgttggtgcacacctgtaatcccagctacttgggaatctgagacatgagaatcacttgaacctgggaggcagaggttgcagtgagccgagatggtgccactgcagtccagcctgggcaccatctcggctcactgcaacctctgcctccctggagcaagactccatctcaatttttaaaaaaaaattgatttttaactcctaactttatacatgaccaatatgtgacttaataaacctatttaaaattattgactttattactgtattttacattattaactttattacagactttatttgttaaaatcctctattcaaaataactttagaaaaaatgttctgctttggtggttgtccatccagtgaaatttggaatgagtcattaatacactgcataaccatgttccttccctatctccatcttaatgtagttccttgtcttcaatgggcaccattgacactgcatcttttatcactcatctgcccagcccgcccggcccacaaaataaatggaaagatttcttcctaactcctgccctttctaaggaaggaagtataggcacatggtctaaagaggactggacctcaagttaaattatgaccaggcccagtcacccacagatcatatgatctctgggtaaacatagcctactctaaatgactaagttaaaggtagcaggaagatacagaggatactaaaaatgcttgacaaattttaaatttctgttgaatatttaaaaaatattttatttatatctctttcctagagggtacagtctatgtcctagtcatctatgtatttttcttttcacctagcacaatatcagttgctagtagaatgaattaagaaactgctccatacattttttttctaattttctgctttatctaatgtttctttaatgcagataaactgcttatatgataattaaatgtctctttcctgttttaaatgtatatattttatatagatatattgtacacgataatacatatatgatcatactttcaattgaaggaaagtaaggaaatagtttaaaactgacttatgaatcaatacatactacaatttcaacatcttatgagaattgtgtgttacactacataatatttaaatacaaattatatttttctgctattctaaacaccatggttagcaaaaactgaaatgaatgttttgttttcctatgacacaactgggtgaaaagcagaactacacataagtttcataataaaacttcacaccacatcatacttgtctgttgtcaggttttgttacattcctcctagctcaaccaagactccctggggctggcaaacagggcagagtttgagtcaaaaccatgcacttcctttcagctttagagatgcacttacaattttgggggaaaccaaaaaacagctgttttttcctccagatgtggcaagtctgtcactttcagtgtttattccaactccaaactcagcacaaataaagacaattgcctgggaaaggaaggggatagaggctggagaatccaaaagttctattccactcaaaataaggtatcaatgttacaagactcccttgaaaagagacaaagttgggaagatggcagagcagaaagggagagaaggagagaagagagagagagcatggaagggagggtgggaaggaggaaaggaaggaacaatctagtgaggagtatgtgtcattaccaaagattaggattaacccaattctgtggtcctgggatccaacaaaaaaatgcacacctgacctaattgtattcatttgtcaagaggccggttccatatcggagacaggctgtattcatagatgattttaaggacagtttaaggcatagagttttactctaaaaactgagaaacaaaaaatccttcattgtagaatttgttttgttgccctagctctactatttatacttttccactttagctatgcacagaacatagctaattttcatctcaatttttcaattcttttgctatataattgttaacatttattgaccactaacctcattttaaggactgtgctaagtattttatatactttcctggggaggcacttattcctcacttttgatatttccctccacgtggggaacatccattagagtaactctcctggcctgtatctacttacccccaggagaggagaagagagtttggtgagtttgagatgaggaacaggatgtctgatgaagatctaatataactcatgttccttttaccttctccattgtctttcaggtattccaccctgcaaaaagcatgtattcatggtcagctctcagcaaggccagtagcagagtggtaaaggccttggccctccaaggctgggaaaagacaatgacaagtcaaatccagacctatgttgtatgttggtctactaggtgactgtctcctggaaatgttatgcagctcagcaaggtgaaggtgagaatatctttgctttttgataaaacacagaatgcatagatttcacatctcactatgtgagcccccacaaaacaaaacctagaggagcatgtgagaaaaacgcatctctaggctagaaaacaaaaagagaaaaaaagaaaaatgtctgtgtaagaaagcaaaggaaagaagatgctcaaatccagcaaatcataccagccttgtcataggcacaaaaagaaagggattaacctaagttacaaggtgaattatcataaaatcagatgaacctttctgaaaaatagtcatgggacaaaggagggatatataacactagaggcttaaccctttcctgcagagaaaaaaaatgtaactgaaagaaatgccactcaaggcttgtgacattcaaagtgaagacaagataaggtcttatgtagtacatgacataggtgtagacactcactagactgaaaggagtacatgtttccaaagcagctttaattcacgtctctgctgagggtgattacaatagtaggaagcaggaggcaggtcttaggctatagcaagaggtacaggcaatagcctctgtggcacaggattgagatacctgttcataagacatcttcggaggctgtgtcactagacacagccccactcttatcagcatggggtgccagaaacatgagactcaatgggaaaataaaattaagaggatttgaatatgttataaaggaaaggcactttgagtaaaacattaattggggctgccatcatgtgaagatttttaaacttttgtagaacccagaggtgttgcaaatgccgctctctgagaaagcagatagtatgcagaagtggctcttcctctgatattggaagtaaaagattaacttcttgatggctgacttctcccaactgagtttaagctcacaatttcctgactcctgaaaattggctgtgactgccaccaaactgtatccagaaacccaaccatttgtcacctcccctgctatcacattggtccaagccacaatcatgtcttctttagattattgcaacagtttcctaaatggtcttcctgctgctgcacttaccctttagagtctcttctcagcaaagcatccaggtgatcgtgttaattcaagtcagtaccttgttctgtaccctgcactggcttcctatctcatcagaatgaacactacatggtctgccctctgtatccccctgatctcatctcatcactcttcaccttgctcactgcactccagccacataggattccttgctgttttgtaaacactccaggaatactcctgcctcctgtttttgcatttgctatttcctccaccctaaaatgatcattcactacataggcacatggcttgctctttaacatcctctaggtttttattcaaaatagtctccctggctctcctagctaaaattctaatcccctctcaacatctcataactccattcttttatttttttctccttatcatgtcactaatatgttaaatatttaattatcttatttaaaaaaggtcttccccaaaagaatgcaattttgctccatgaaggcaagaatctttgtctgttttattagctgctagaatatctcctgatacatagtaggtattcagtaattatttgcagtatgaatgaatgaatgaatcctgatgagacaagcctggattatctccatccacctatcgttatgcagataactttgatatggtctttggactcaccaagtgatgtgatctggaaccataattttcctatagtatcaacattacaatctagggattagcttgctttccaaattgcatagtgactgagctagaactcttataattcagtatgttctaggaattctttggactttattttattaagtggggatcatgaaaacaaattctgagttcttgaaggaactgcatccattctaggaactgcgctactgagggaaacgaacaccacatctgccttctcttgaccaggactgagtagagtaagaaatgaggaaagacaagttttgtactttaatttttttaaactttaactcataaagtcaaaagaatttgatttagggctttaatctctttgggttttaacttatttagacttaacttgcaagggaatctaatattttttactgtaatttctccctggaatttgataatgggaagaagtctatattcagatgtgaagcatcttattattttatatattttatacataatatgtatacttttatattatatataattatatattttaacatatataatcatatatgttttatatgtataaaatacagacaggatcttgctttatattcatataattatatatttttaacatatataatcatattttatatatataaaatttttttttgccttttttaaattttattattattatactttaagttttagggtacatgtgcacaacgttcaggtttgttatatatgtatacatgtgccatgttggtgtgcttcacccattaactcgtcatttagcattaggtatatctcctaatgctaaccctccccgctccccctaccccacaacagtccctggtgtgtgatgttccccttcctgtgtccattttatatatatatatataatagagacagggtctcgctgtatgacccaggcttaagtgcacccaggctcatagctcactgcagcctccaacacctgagctgaagagatcctcctgcctcagtctcccaggcagctggaactacaggcacatgccagcaagcttggccaatttttaaattttttgtagagatgaagtctcaccatgttgcccaagttggtctcaaactcctggcctcagtgatccttccacctcagcctcccaaagtactaggattacaggcatgagccactgtgcctgccttgttatatacactattattggggtatttttatgctgtcattcagtgccattgtagaacttctgatgggctatatacatgttacatccatgaaaatccactgctcacacttcctgctgtgaggatcataatggactgatggcctctggacccatcatcatgttcacactgaggccacacttcctgctagctgcttctaccaatgactgaagatgactagggtactaaaacatgcccattccagtgaaatagaactcttccaacaaggaactttggctgaaggattttccatcagccaggtttaacctttctaagaactgctgcattgcagtctaagattcttcctacccagttgtccttccttccctctcttcttgcacagatgtcagacctacaccatgctttggaggcattccctgccttcacctgctccccctgccaataaatctcttccatttctcatcctttcttggcgtctgcttctcagtggacccaaagttacatactatataataggacaacttggctagacatcatctggggtgggaaattgattttcagccaggggtacaatgttgcctacaagttaatttatctaatgtattactctggcctatttcagagcattctggggtcagaagcaaccctggacagtaccaggaggacccacagagcatcacaattagtgttaggagaacagccttgtgaaagtaagaatagaattatcttgatagtctgctgatctcttctccacaagaggatagctacagcttgatggaatataggctaaatggtcaagcccaatgtattaaaagaattagagtctgggaaatgttcagagctaaaacttttcctctactccagtgtttctttccttgtggaaagagcttcactggcacaatactcctgtcggctctctgccaacctctctcactcctccccagggaaacactggtgactttccttattgataagtttggaagaagaattttacaatgctcatctcagctccttcctccttcattttaacataatatccacagagagtatgcactctattctgttcctctatatcatatattttacaggggcaggctcctgcacagggagaccagcaggtccagctggtctgtatgcctggggctatgtgtcagtaagcctattattcccacacatctaagccacatcctcaattctggcctttagcagcttatcaggtgatattgtgactgctatttattttttcctttttgccttataattgatacagaattccagtggagagaagatactatattccctttttacctagcagaaaacaggtgtatcaacttctacaagattatacagctaataaatgtcagaattaaaaatcaagaaaaagtccttagcctctctgctttttaatgttgccatttctttttatagctctgtttcatgataaaggcttttgatgcacatgaattagaaacatccaattactgaatacatcagtagttttgataaggtttggtcctgtaggcctgcatttatttatcctggatttttaaggtttttaaactattaaattgttacatttgaaatctctccctgagggtcttgacaaatatttcaaaacagattctttttttttttttctttttttctttttcattcagacagggtctcactctgtagcttagactggagtgcagcagtgtgaacacagctcactgcagccttgacctccctgggcccaggtgatcatcctgaaaagaggtgatttcatttcccaacttcagactatactataaagctacagtaaccaaaacagcatggtactggtacagaaacacatagaccaatggaacagaagagagaatccagaaataaagctgcacgcttatagccatctaatcttcaacaaagttgacaaaaataagcaatgaggaaaggactctctattcaataaattgtgctgagatagctggctagccatatgcagggcaatgaaactgagcccctacattttaccatatacagaaattaactcaagatggattaaaaatttaaatgtaagaccagaaactagaagaattctagaagaaaatcaaggaaatgccattctagacattggccttgggaaagaatttatgacgttctaaaaagcaattacagcaaaagcaaacattgacaagtgacacctaattaaactaaagagattctgcatagcaaaagaaactatcaacagagtaaacatacaacctacacgttgggagaaaacgtgaatattttcatatttgcaaagtatgcatccaatagaagtctgatatccagaatctatgtggaacttaaacaattgaacaagcaaaaaacaaataaccctaattaaaaataggcaaaagaagccaggcacagtagctcatgcctataatcccagcactttgggaggctgaggcaggagaattgcttgattccaggagtttgagaccagcctgggcaacatagtgagaccccgtctctataaaaaataaacaaagttagcgccaggcatggtgttgcatgcctgtagtcctagctacttgggaggctgagatgggaggatcacttgagcctgggcgattgaggctgcagtgagccaagatcacgccgttgtattccaacctgggtgacagagtgagactctgtctcaaaaaaataaaaaaattaatggacaaaaaagacatgaacagaccacttcccaaaagaggacacagaagtggctgggaaacatgaaaagatgctccacatcgctatcctcagagaaatgcaaatcaaaactgcagtgatataccatctcacaccagtcataatggctattattaaaagtcaaaaaacaacagctgttggcaaggcttcagagaaaagggagcacttatacactgttgatgggaatgcgaattagttcagccactgtggaaagcagttggagatttttcaaagaacttaaaacaactattactcaacctagcaatcccattactaggtatatatccaaaagaaaataaattcttctaccaaaaatgcatatgtattctcatgttcatcacagcactattcacaatagcaaagacatggaatcaacctagatgctcatcagtggtggattggataaagaaaatgtggtacatataataacccatggaatactacacagccataaaaggatgaactcatgttctttgcagcaattagaggtcattatcctaagcaaattaacacaagaagagaaaaccaattaccacatgttctcacttataagtaggagctaaacattgggtacttatggacataaagacggcagcagtagactctgggaattaccagaggaaggagggagggaagggggcaagggttgaaaaactattaggtactatactccttacctggatgatgggattattcataccccaaacctcagcatcacataatatattcaggtacaaacctgtacatgtacctctaactcaaaaaagttgaaaataattaatttttaaaaagaggtgatttcaagaaaaatctaacttctaactacctttttttctcatgtgacctctagcatattacaaggaatggactaaaattgcatgtgccccaaatatttttatctttgcattggggccctagaaaggcctgaatatagagatgtcacatatattctacagaatataacagtcaagaaagtagaattaggctgggcacagtggctcacatctgtaatcccaacactttgggaggccgaggtgggtggatcatttgaggtcagtggttcaagaccagcctgggcaacatagtgaaaccctgtctctactaaaaatacaaaaaaattagccgggcgtggtggcatatgcctgtaatcccagctactcaggaggctgaggcaggataatcacttgaacccaggaggtggaggctgcagtgagctaagaatgaatatgaatatttacttcaaactctacctctctcagcttactggaaaggacatttagtagttagaagaaatgtattttaatggtgggaagagtttgctaagaatgattttcagagtattttgtagggatccaacagaagactatatgctaactttctcaaaagagagttaagcatcagtcttttttctcttgtaaaggaatcaagccacaagctgtatccctgtcaccagatctatggaattaaaacttctctttgtatttgaattcctggaatatttcttgatactgatttccaattcataattttatagatctgttttccctgtcactacatttctgcattttgtataaatacttaatttgtttcttgaatttgtaattaaacagtcaaccagcttaagtccaataagaatctactgaagctaaatatttgctgcttttagtaagcctaataatttccatctttgtcttacttgaataattagctaggaatatttgatgtttagtctgtgcatggaatattttgtaaggtattagaacccttgcaaataacaggaaaattcagcacaaaacactgtgacacacacctaagcactttgagtcagtggactcatcgggtgcaataaaaaacaacttttccatctctcctcattgcccattttgaggaggaagtggtcctttgcttgaaagaaatctagagcagatcactcctagataataaagtcatctgattacatctcgtcatatggatagtcctcttttgttaattaaaagttcagtaatttaagtgtgagagtcaaagttccaaatttcatttaaaatttctccccttaacaaagtgcttacagtggaagaggggtgcttagctggcttcatctctctttacctacctggtgaattacttctccttccttactcaccatcaggctgcctctggatcctccagggttaaaacagtgagaggaataagagggagcaggaaatgtcttacctgactggcaccaatgtaattttgcgttggttacctctagctgtggcaaatatttaaagccagctctttctggctgatgttccaagctgatgattcttctcacagttgctttcatgggtacattggaagcccccacatcaaacccccacatctatagtgtgggtgaaacattgaccttcaactggttacttatgtctccccgcacagccatggaaatcaggtgaacccatcctgtattggggtcacttgatctttctgagcggaactcacgtgaaatctgaaatggctccaggtctgctgagcccacacctaatccatgagaaacactcaccatctttgttcctgctttcagtgtaaattcagttagtactcaatgcaggctgggttctgcctttctctatatatttacctgcactttagaccagtatctgcagcctcttgtcttgcacatccaagtttatttatttaaactttatcaccgccaacagccatttttagtaccttccaaaaggctactccaagattatgagcatgactttctactcctcccatcaaaaaaaggtcaaatttcatacactttgtagactgtaaaattacaagaaaaataatatatatacatatacatatatagaaatcagtttctattactatgatttttttttcatacctctggaagtctaaaaggagctggaaagcctggcccagagctctccacccaatgaatgtaccaggtcaaggaagataatataaaacaaagtccactcttttctcccaaacaaatgtcccaaagaggtggtgataaatgagacagttttccttgctactcccaaaaagcttggtgatagctcagccttttcatggccaagacagttttgcccaggtgtctagttctgggaaacggtctctatcacataactgaaattccctctccaattgtaatttagtgttcatgagtttctccatcctgctggatcctcttgctctaatgggagggatctaaaaaatagatgtgccattatagatggttctactgagccggagctaggacccacttatgcatgtgtgctatgctgggtgtgaagtatgaagccatgaatctatagtgaggaaccaatgagggctctatgtaaagaatgagaggattgactaaatttagggtagacgttaaaggtggagaatggtgaagggtgcgggtaaacattgatatccttacctttttctgacagtaagcccttcacaagattttctcatgcatgaggttatttggcatggaccttgacagaattctcatttagcaaaattgttatgtacataggtattgagagttagacaacttggattttaatctcattctttcacttactagatatatggcctcggacaagttacctgagcaagttcatggagttgggagtaagggtgttcacttttgcttcttaaggcatctataaatcttttaaactctgattctgaagcccatgacatcctgattttccccaaagtgagcatgtagacaggattatgtgatcacgaagaaccccttgttctatttacattaagcctccattcacccagagttaccagctcaagagactgagtcggagagagtttacatcttctccaggccatatctagaggctttcaggcaataatgcaggtagctagatttgtgttttgaggtggaagaacggcagcctttggtgggtttcaagtgcaaatttcatcccagacccagggatagttatgtagctgggcatccaggaggctagaacttagtttaggaacaggaaagaatccctaaaatccttgtctgtagtagtttggggatttttactccagtattacaccattgatctgtcagctactcctctcatgtttgtttccaacacaagtcccactccccccagtttaggcagcacccttgagttagcactgacccatttgtgttgcaagaccccgtgcatgttgcttgtgtaaatgatgtttggctccttactcctgaaatagccaactggcagtcacctgaaatagggagtcaaagctgaatttctaaaatggaataatgcatgacataatgctatttactgggaatgagtgatttgtttccctgtctaaactttaatttctttaacagtgcttccaagatatttggttttaaaaaaaacacataagaatactaaacaaaaaattggaactacacaaaagtgggaaagaatgccaatgtgaaagccagaaataaagaaatgttggagcattccaagatggccaaataggaacagctcctgtctgcagctcccagcaggatcgacgcagaagatgggtgatttctgcatttccaactgaggtacctggtgcatctcactgggactggttgaacagtgggtgcagcccacagagggcgagcagaaacagggtggggcataacctcacctgggaagcacaaggggtcaggggatttccctttcctagccaagggaagccatgacagactacctgggaaaatgggacactcccgctcaaatacagtgctgttcccaaggtcttagcaaccagcagacaaggtgattctcttccgtgcctggctcggcggctcccacacccacagagccttgctcactgctagctcagcagtctgagattgatctgcgagacagcagcctggctcggggaggggcatccaccattgctgaggcttgagtaggtaaaaaagcggtgggaaactcgaactgagcggagcccacaacagcttaacaaggcctactgcctctagacttcacctctgtgggcagggcatagctgaacataaggcaacggacaacttctgcagacttaaacgtccctgtctcatagctctgaagagagcagtggttctcccagcatagcgtttgagctctgagaacggacagactgcctcctcaagtggatccctaacctccgtgtaacctaactgggagacacctcccagtagtggccaacagacacctcatataggtggctgcctctctgggacgaagcttccagaggaaggaccagacagcaatgtatgctgttctgcagcctctgctggtgacacccaggcaaatagggtctggagtggaactccagcaaactccaacagacctgcagctgagggacttgactgttaggaggaaaactaacaaacagaaaggaatagtatcaacatcaacaaaaaggtcatctacaccaaaaccccatctgtaggtcaccaacatcaaagaccaaaggtagataaaaccacaaagatggggagaaaccagagcagaaaagctgaaaattctaaaactcacagtgccttttctcctccaaaggaacacagctcctagccagcaacggaacaaagctgggcagagaatgactttgatgagtggacagaagtaggcttcagaaggtcggtaataacagacttctccgaggtaaaggaggatgttcaaacccatctcgaggaagctaaaaaccttgaaaaaagattagacaaatggctaactagaataaacagcagagagaagaccttaaatgacctgatggagctgaaaaccatggtacgagaacttcgtgatgcatgcacaagcttcaatagccaatgtgatcaagtggaagaaagggtatcagttactgaagatcaaattaatgaaataaagtgagaaaacaagattagagaaaaaagagtaaaaagaaatgaacaaagcctccaagaaatatgggactatgtgaaaagaccacatctatgtctgattggtgtacttgaaagtgacggggagaatggagccaagttggaaaacactcttcaggatattatccaggagaacttccccaacctagcaaggcaggccaacattcaaattcaggaaatacagaaaccactataaagatactcctcaagaagagcaactccaaggcacataattgtcagattcaccaaagttgaaatgaaggaaaaaatgttaagtgcagccagagagaaaggttgggttacccacaaagggaagcccatcagactaacagcggatctctcagcagaaactctaaaagccagaagagaatgggggccaatattcaacattcttaaagaaaagaattttcaacccagaatttcatatccagccaaactaagcttcataagtgaaggagaaataagatcctttacagaaaaatgctgagagattttgtcaccactgagcctgccttacaagagctcctgaaggaagcactaaacatggaaaggaacaaccggtaccagccactgcaaaaacatgccaaattgtgaagatcatcaatgctaggaataaactgcatcaaataatgagcaaaataaccagctaacatcataatgacaggatgaaattcacacataacatattaaccttaaatgtaaatgggctaaatgctccaattaaaagacacatactggcaaactagataaagagtcaagacccatcagtgtgctgtattcaggagacccatcttatgtgcagagacatacgtaggctcaaaataagggaaggaggaagatctaccaagcaaatggaaaaaaaaaagcaggggttgcaatcctagtctctgataaaacagactttaaaccatcaaagatcaaaagagacaaagaaggccattaaataatggtaaagggattaattcaacaagaagagctaactgtcctaaatatatatgcaaccaatacaggagcacccaaattcataaagcaagtccttagagacctacaaagagacttagactcccacacaataataatgggagacaaacaccccactgtcaacattagacagatcaacaaaacagaaagttaacaagcatatccagaaattgaactcagctctgcaccaagcggaccttatagtcatctaccgaactctccaccccaaatcaacagaatatacattcttctcagcatcaatcacacttattccaaaattgaccacatatttggaagtaaagcactcctcagcaaatgtaaaagaacagaaattataacaaactgtctctcagaccacagtgcaatcaaattagaactcaggactaagaaaatgactaaaaaccacacaactacatggaaactgaacaacttgctcctgagtgactactgggtaaataacgaaatgaaggcaaaaataaagatgttttttgaaaccagtgagaacaaagacacaacataccagaatctctgggacacactcaaagcagtgtgtagagggaaatatatagcactaaatgcccacaagagacagcaggagatatctaaaaacaacaccctaacatcacaattaaaagaactagagaagcaagagcaaacacattcaaaagctagcagaaggcaagaaataactaagatcagagcagaactgaaagagatagagacacaaaaaaaccttcaaaaagtcaatgaatctaggggctggttttttgaaaaagatcaacaaaatagataggatagaccgctagcaagactaataaagaagaaaagagaagaatcaaatagatgcaataaaaaatgataaaggggatatcaccaccaatcccacagaaatacaaactaccatcagagaatgctataaacacctctacgcaaataaactagaaaatctagaagaattggataaattcctggacacatacaccctcccaagactaaaccaggaagaagttgaatctctgaatagaccaataacaggctctgaaattgaggcaataattaatagcctaccaaccaaaaaaagtccaggaccagatggattcacaaccgaattctaccagaggtacaaggaagagctggtaccattccttttgaaactattccaatcaatagaaaaagagggaatcctccctaattcattttatgaggccaacatcatcttgataccaaagcgtggcacagacacaacaaaaaaagtaattttagaccaatatccctgatgaacatcaatgcaaaaatcttcaataaaatactggcaaaccgaatccagcagcacatcaaaaggcttatccaccatgatcaagttggcttcatccctgggatgcaaggctggttcaatatacgcaaatcaataaacgtactccatcacataaacagaaccaaggagaaaaaccacgtgattatctcaatagatgcagaaaaggccttcgacaaaattcaacagcccttcatgctaaaaactttcaataaactaggtattgatggaacgtatttcaaaataataagagctatttatgacaaacccataaccaatatcatactgaatgggcaaaaactggaagcattccctttgaaaactggcacaagacagggatgccctctctcaccactcctattcaacatagcgttggaagttctggccagggcaatcagtcaagggaaagaaataaagggtattcaattaggaaatgaggaagtcaaattgtacctgtttgcagatgacatgattgtatatttagaaaaccccatcgtctcagcccaaaatctccttaagctgataagcaacttcagcaaagtctcaggatacaaaatcaatgtgcaaacatcacaagcattcctatacaccattaaaagacaaacagagagccaaatcatgagtgaactcccattcacaattgctacaaagagaataaaatacctagcaatccaacttacaagggacgtgaaggacctcttcaaggagaactacaaaccactgctcaaggaaataaaagaggacacaagcaaatggaagaatattccatgttcatggataggaagactcaatatcatgaaaatggccataatgcccaaagtaatttatagattcaatgccatctccatcaagctaccaatgacgttcttcacagaattggaaaaaattactttaaagttcatatggaaccaaaaaagagctcttattgccaagacaatcctaagccaaaagaacaaagctggaggcatcacactacctgacttcaaactatactacaagccaacagtaaccaaaacagcatggtactggtaccaaaacagagacatagaccaatggaacagaacagaggcttcagaaataataccacacatctacaaccatctgatctttgacaaacctgacaaaaacaagcaatagggaaaggatttctctatttcataaatggtgctgggaaaactggctagccatatatagaaagctgaaactggatccctcccttacaccttatacaaaaattaattcaagatggattaaagacttaactgttagacctaaaaccataaaaaccctagaagaaaacctaggcaataccattcaggacataggcatgggcaaggacttcatgactaaaacaccaaaagcaatggcagcaaaagccaaaattgacaaatgagatctaattaaactcaagagcttctgcacagcaaaagaaactaccatcagagtaacagtcaacctacagaatgggagaaaatttttacaatctacctatctgacaaagggctaatatccagaatctacaaagaactcaaacaaatttacaagaaaaaaacatcaaaaagtgggtaaaggatatgaacagacacttctgcaaagaagacatctatgcagccaacagacacatgaaaaaatgctcatcatcactggtcatcagagaaatgcaaatcaaaaccacaatgagataccatctcatgctagttagtatggcagtcattaaaaagtcaggaaacagcagatgctggagaggatgtggagaaataatgcttttacaccgttggtgggagtgtaaattagttcaaccattgtagaagacagtgtggtgattcctcaaggatctagaactagaattaccatttgacccagcaatcccattactgggtatatacctcaaggattgtaaataatgctactgtaaagacacatgcacacgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttgcagggacgtgaatgaagctggaaaccattctcagcaaactgtcataaggatagaaaatcaaacagtgcgtgttctcacccataggtgggaattgaacaatgagatcacttggacacagggtggggaacatcacacattggggcctgttgggggttgggggctgggggagggatagcattaggagaattacctaatgtaaatgatgagttgatgagtgcagcaaaccaacatggcacatgtatacctatgtatcaaacctgcacgttgtgaacatgtaccctagaaattaaagtataataaaaaaaagaaacgttatgcattttttcaacccataagtagacccatataagttacctttaactgtaatatgaatgataactagaagctaacattgtgctatggaaaaataattccaagtaagttaaaatgttgtattatggtcaatatatgtggtaaatctcttatttaaaacacaaggaaagacatctacaattttgattaacagaaaatcagatattctcatccccattaaatcaatattgaacacttatttactgaatattgggttaaaggagtacgaaatgtttttttgcatgggaacctacatgtcttggtctagacatgatggaaatgtaaagctgaaccccccccttccctgtgccaacaatttatcaagcttattagtatcttttactgcagagatgtagatctctctatttggacttcccactgttgtagtgctccttccaaatgctcacactctgacctgtgtgaacatatggaggggatatgaggggttctatttcctaactatatcagttgagatgctttggtcaccagtaacagaaaaacttaagaaaattgctttaataataagaaacatttattacttcacataagaagaagtccagatgagaatgtaggttggccaaggaatgtcatcatgaatcaggttctttccattcttcagctctgccattctcattattaacattagctttgtccaacatctcttcctatgtgcctcttttccatgaagaggtaaacctttcctagaagtccccaggcagacttgcctttatgtctcactgaccacaactgcgtaaggcaacctattcattcctacagcatttactggtgaggggagcaattggcttagggaagcacaggctaagggcctgagggtgaattacaaggcaagatacagtgttctgttagaaaagaggaagaaagagaatgaattttgagtaaacaacaccaatgtctactcacccactggagatttacatgccaaaattaactttctgctgccttacccaggaccacatactgaatagtcacagattttgctgaaagaaagccgatctttgtgcctttctcttattaggaccacacattagggctggcgctctctctctctctctctctctctctctctctctctctctctctctctcatttttcctcctctattactttctttgacagtaaccccggaatgtctttgcttttccattcagcagacctctcttccttcttcccaccatggctcttaggcatgttaggtgacatgccttgaattacaatgaagttatgttagacctgtaaagaaagctctaacaacttccaagtcaaaagggctagaaccttatggaagcattttcaaaagtatatccataaaattctaggaacttcccacaaagaagaagcttctgtggtcaggtaaatttgggcagcgttgtagatgctttccttctcttgcagattgtagatatacaaggctctcagaagtcttcagttacgtaaactaactcagaatgagtcctggaatcaaaatgcctgtgttcaaatctgggctctgccactttctagctatgtaagctctttaaagctctgttttctcatttgagataagggaattctatggtactatttaattggggttgctatgagaagtgggtgagataattcatctgaggctttcaacacagtgttttgtacattcactcatttaacaattattgtgtcaagggcccaggtctcaaggagcctacattctaatggaggagggaggaggaagacaataagcaagtaaataaatagaataatttcagataatgacaagtaatatgagaaaagtaaaacataatgatattataaagcacaactaggatgagaagggctgttttagataggaggattaggaaaggcatttctgaggaaggcattttatctgagacctgagatatgaggagactggaattatttatccatttattcagtcattcattcaaaaaatgtttattgagtacttactgtataccacaaattgttttaggcaccagggataaagcaagaaacaaaattctacaagaatatctgccctggccgggcacagtgactcatgcctgtaatcccagcactttgggaggcccaggcgggcggatcacaaggtcaggaggttgagaccatcctggctaacacggtgaaaccccgtctctactaaaaatacaaaaaattagcagggtgtggtggcgggcgcctgtagtcccagctacttgggacgctgaggcaggagaatggcgtgaaaccaggaggtggagcttgcagtgagcagagattgcaccactgcactccagcctggggagcaaagcgagactccatctaaaaaaaaaatatatatatatatatatagagagagagagagagagagagactgtgtcagagttgagacggggtcgatgaggctgaccccagcgggtagaagggacgaggaggagcgagcagcggaaggtcctggtgtgtccggaattggtgggttcttggtctcactgacttcaagaatgaagccgcggaccctcgcggtgagtgttacagctgttaaggtggcgcgtctggagtttgttccttctgatgttcagatgatgtgttcagagtttcttccttgtggcgggttcgtggtctcactggctcaggagtgaagctgcagaccttcgcagtgagtgttacagctcttaaggcagcatgtctggagttgttccttcctcccggtgggctcatggtctcgctgggctcaggagtgaagctgcagatcttcgcagtgagtgttacagctcataaaagcagcgtggacctaaagagtgagcagtagcaagatttattgcaaagaccaaaagaacaaaccttccacagtgtggaaggggacccgagcgggttgccactgctggctggggcagcctgcttttattctcttatctggccccacccacatcctgctgattggtagagccaagtggcctgttttaacagggcgctgattggtgcctttacaatccctgagctagatacaaaggttctccacctccccatcagattagttagatacagagtatggacacacaggttctccgaggccccagagcagctagatacagagtgtcgattggtgcactcacaaaccctgagctagacacagggtgctgattggtatgtttacaatccctgagctagatataaagactctccaaggccccgccagactcaggaacccagctggcttcacccagtgaatcccacactggggctgcaggtggaactgcctgccagtcccagtgccgtgcgcccacactcctcagcccttgggtggtcaatgggactgggcgccctggagcagggggcggcactcatcggggaggctccagctgcccaggaacccacagagtgggtgggaggctcaggcatggcgggctgcaggtcctgagccctgcccctcgggaagccagctaaggttgggtgagaaattgagcgtagcgccggtgggctggcactgctgggggacccagagtacaccctctgcagccactggcctgggtgccaagtccctcactgcccagggccggcagggccggccggctgctccgagtgcaggcccaccaagcccatgcccacctggaactccagctggcccgcaagcgctgcacgcagccccggttcccgctcgcgcctctccctccactgcaagctgagggagccggctctggccttgcccagcccagaaaggggctcccacagtgcagtggtgggctgaagggctcctcaagtgccgctaaagtgggagcccaggcagaggaggcgcctagagcgagcgagaactgtgaggactgccagcacactgtcacctctcactggggtgtccgccatataaagtcgtttgaggtaaccattgcctaattgtgagtctgtgagagaagatgtgaagtatggcctcgtcccggtcatctgggcgtgcgggtctcgggttttgatcttgcgtttgtgtagttttaacttctagccatggcaaacgatcccaggggagcacagactggaccccgctacgatctctcttggagtggatcagactgatgatcaccaacaaccaactcattcccagataaggaagaagagagtgttacccatttcaatgtggtttcaaccccacttctacatcttaaagacattgtattttttcagcagtgatgcccctgttcattagtcccactgatgttttcattcctcatctcatctttttcttagcagcattcaatgaatccttcattctagaaacactctgtttttttggttttcatgagaccattctcaccttgttttgtcctgtgactcttttgaaaactaacaaacaaacaaaaaaaaccctgtttttctttttaagttctggtaaaaaacacaaaatgaaaatttgctatcttaaccgtgttgaatgtgcagttagtaaagtacattcacattgtggtgcaagccatcaccaccatccatcactagaactcttttcatcttgcagatctgaaactctacccattaaataacttcccatcttcccatccccacaactcctagcaaccaacattctactttctctatcagtttgactactctaggtacctcatatgagtagaatcatacagcatgtatccttctctgcctggcttatttcatttgtatgatgtcctcaaggttcatccatgttgtagcatgcatcagaacttcctccccttttaaagctggataatatttcatagtatgtttagaccacattctgtttatccattcatccatcagtgaacacttgtgctccttccaactttgggctgttgggtgtcctgctactgttgctcccagtgctcaatcttgtttactccctcctaatcgagtgtacagcgttggacactgtgcaggatgatgccacttcatcttggatgctaatctgccatgttgacttctgattaaccccaggcccaggaatgcctcaagatttctactttatgtactgttgcttgtgtaagccaagacaaccttgatgttatcataaacatgtacttacctaagtgctgtcctttggcaaattatgggctatgagacacagcattcttacctttccctgaggggtcaatttcagtgatcctacacattccttctgaagcacgtatgctctttctatacggtgtgtaagctctgggtctggggagtaacagtacagagatctacctgtcttgttgccacatgtttctaaattttccagtaagtcaccttctactgacaaagaaaaaaatatatatatatataatacacacacacatatatatacacacatatatatacacatatatatatacacacacatatatatacacacacacacacacacatatatatatatatacacacacacatatatatatatatcttccctaatgcacctcaaattctaccatggaaaaacaaaaaggaaaaggaaaatacatagtatcccaagtggttaagtgctatggggaaaaagaaagtagaaaaggagaaagaatatttaacttcacatttttaaatagggatgcagggattcctcacagaaaagttgacacataagcaaagaaagacctgaaggaggtgaggaaataagccatgcagaaatctaggagaagagaattctaggcagaaacagcaagtgcaatggccctggggcaagagcatgcttgatttattcaagaaagagtaagaagggtgaatgcctaaaggagggtaagtaaaaggaagggtagtaagaagtgaagtgccagaagatgtaaggataagcaaaggtctggaataaaattcctccaggcagatagaacagcagctgcaaaggccttgagtcagaaccagggcgtggttggcctattcaagcaacagaaaaatggcttatagagctggagtagactgagcaaggggaagcatacagatgaagtctgagaactttctgggtcagatcacataaagccttattataggccagtataaagaatgtatattttttctaaatacattaaaaaataattggctataattgcgattattgtgattcatgagacactcgtatgctaaacagatggagaaatgctgtttcaaagccaattttaatgaacactcttgtccatccttcctatcaatctatccccatgtgttgtggattatgtcacagtaggactatagtaagaacttgataatgggtctccaaactctgttttttctttcttaagttacagttggatttctgaggtcactcagaaatcactccccttctcaaaaatttgcattgtttttttacttgtaggatcaagtccatacccagcagctatcaaggatttcaaggtctctccctacatctccctccacctactcctgttagaggtgttgaaattgtgctgtaaatgtacgtgcatggttatagctccaccatttagttcatgccattccctcagcccaaattcttctttccctcattctttgcctgttgaaagttttcttttcattcaaaaccagcagagcgcctattcctttctgaagtttttcctgatattcccaggcagagtcactcactcattccttcaaccatgtacctgttggtgtcacttgtacctcagtttggtgtgtttgtcagattgcatttctgcagacttagttgttgtcacatctcttactttcattagattgtaagcacattaaaggcaagggctgtattttcatcatatcttctagaagtactacctaacacaattgccagtacagagtagatgctcaataagttgctgattaaattaaatttcagaggaagtaatgtgataaacacctttaggtaaagcactgagacacaaaaagaagaaaatggctatgctgtcagggagtatataaatcaataatggtagcttccatttattgagtcctaactatggtattggcactgttcatatagtatgccatttaacactcatagcaacccagtgaagtaggtgttataacccctagtttaagaatgaaattaagtaacttaaacaagttcatagaataaataataggattcaaacttaggtccctccagtttccaagcctgtgctctttcactatacatgatgtcagctgggatctagccaggaaaaaaaaagacaaaaaaaaaaaacaggtctttcagaggaagggaaattgtttcaacagaggattcattatgcagatgaatggagcagtgaagaagtcgaaaagggaatggtgaagtaattcacagattagcaaaattgggaagttattctccttgttgcaagggtgacactgggaggagcagttgtcaccagagcccagaagccttggctgtcagacagaaggagcaaaaaccaccaggagaactgcctgagtagatctgggagaaagaagggagaggctgtccagagggacaccgccagattccaaaggacacagggaacagagtgagaaatggcctggcttctctcttcccgtttccagtcctcctgtggtgcctctcattgctttaacctatcaagaatgaaagaacaagacagcctgtgagaggcagcaacagagaagagcagggaaagggtgggaatggatctgagactagtgtcagcaagctacctttctacctgaaatgaaaagaatataaattaaatagcatttaatttggggctatgatgaatggcaaagatattaagtaaattcaaaagaaagagattgagaggccgaggcaggcggatcacgaggtcaggagatcgagaccatcctggccaacatagtggaaccctgtctctactaaaaatacaaaaaatttgctcagaatggtggcatgcacctgtaatcccagctactaaggaggctgaggcaggagaatggcttgaatctggaaagcagaggtttcagtgagccgagatcgtgccactgcactccagcctggtgacagagcaagactccatctaaaaaaaaaagaaagaaagaaagaaagagagattgatgatggctgcagtagcaagggagagattcttcggtgggggaaagttataccaattcctaaaaaaaggtagactttctatgggtgaaaagaagagggtaggtaggtattccacacagaaaaaactacctaagtattttcccttgggcaaagaatactattcattctttttaaatgtctttttatttggggataaaatagaatacctatcatatatgtgtacagtataaagaataatgaaaaacaaacacccacatgcatactaccctggctcagggagtaacacatcatttatctgcatttcctttttttttttgagacagagtctcacttggtcgcccaggctggagtacaatggcacgatctcggctcactgcagcctctgcctcccgggttcaagtgattctcctgccttagcctcccaagtagctgggattacagacatgcgccaccatgcccagctaatttttgtatttttagtagagatggtgtttcaccatgttggccaggctgctctcgaattcctggcctcaagtagtcctccagcctcggcctcccaaagtgccaggattaccggtgtgagccaccacacctggtccaatttacttttaaatgtatcaaaaaataagtggattagtagacagagggatgttaacagatggatagatatgtggtaataaaatgttactaaatggataggcatgaataataaaatgctaatggtagaatccaggtggcaagattgtaaattttttcaactgtcttgtctgtttgaaaattttctcaataaaatactgagaagagaaatcccatgcctgaaagattctaatttaattggttgtatttgggtctggacaccagattttttttttctgaccactgcaatgaagtcttgcagtggagggaagagattgggctcagcaccccaaaactgttcaagagctctctggatagattccaatgtgcagccaggtttcagggctactgcactgcaatatgccatgggatcacagagctagcatgagcagaacagagaatgggataagtaggaggggcgaataaaagaggggcaaatttctgtctgcctatcagagatgaggcctccaggctagacttttatgtgctttctgtgtcggaatgggtggatcaactgcatgtgaaagaggcaagagaggtttagcaattcagcaggggttactgagaacataggcttagctagggttctctgaagttcttaaaaggggactcaaaagtttatatttaatgtaaacttttaatttggcaatgactcatccttcacaatgtttcctatagctttaaataaggtcatctattcattcagaataatacttttagcatgttatctcccttgagaagtataacatccactttcaacatatatatagagagagatgcatttctatgttttatttttttaattcatttttatggagatgaagaaagagacctgttcagaaagaagggaagcagaaagaaaatgttatacctttggcagccttggactcctgggtcagcagaaaaggaacaagagaaagctaggcctggatagtataggaacaagcaatcgagcctagtgtcaggcttggaaatttgacaattccaaagaagcatgtataacccaattaatcagtaaagagagtaattgatgcttcccagaaaatggatttctatactgcctaatctgcagtaacatgaatatcttctataacccttcccctatctccagttattttaaaatcttactctgagggttactgtagtgtataaggttgtttgtctctacagtaaatgattccagtccctttaaccatgtgaaaggagacaggaacactagcatctgatcctcgtcatgggaccccagcctgtcttactacaattgccagctggagacagaacagggcctaagggcaaaggcagaatggcatatgaggaagagaaccaaaggtcagtcacagaacagctgtgtcacaggtgagatctaaaggaaaactgcgggactaaaagcaggaagcaaacagaagttcaggagccagaggaatgcaagaacatatcaggaagggggatatgagacaggaatagaatcagggctttggccatgaatgaggccagggtacctcaagctcattcttgttgagagcttgccctgtggtgcttgggtaagcaggaaagagttaggcagtgcaggttgggacagtctttaaaaaaaaaaaaaaaaaaaacaaaaaacaaaaaaaacactccaaaccatattatcacatagcctattaactgacacttattttgatgcctctgagccatccggaagaggctaaatgtggtatcttccacttaaaaagtaagggaaatatgtgaaatattttagaaaagcctgcgaatagcgtggtttaaaaacaaaaagagaggtccttttacctctgaagggataacttttagctgccaggaaaattcacatatgtataatcccacattgcctccataaatctaggtagctatggcagtgattcagaaaagtgaaggcatcgctttttgactttgaatgtctccatttctcccagctggtatgacagtgattttcctttctcccttattttggagttgtaaggtatattaacattcttacatagctttgatccaatatagaatttttttaaaaaactttcaaagaaggactttatggactggcattagccacgtgcttatttgctgtgtccagggggctgtgacactgtaattggctctgctggggataatcactccctaggagacagatgaggttagggtaggagggtatgagccctgaagccatgtggagtagtaaaggagtcccccaagtgaaaagaggctgccgttttcagaagcaggggtgtgggaaaaatactgagcagatatctaccacaacctaacaggtgcacacaagtaatgagtgaaatagcagggactttaacttatgtttgcctatttttaaacgtctacttttctcctaatgttgtgtctcctttgctggggaaaacttttataattgctgcctaactcctgttgtttcactctgtctgccctctctcctaccctgcttttacccccagcctggagtccacttgggtggaaatgcagcatataatgagcccaaagttaatcatctgcaggtttgccctgataagtcacagtatgtttgctgcactccttccaagagtcaacagcagctttggggatgtgctgagagtggcttatggcattctgagcgctggcccagatgggaggcagtgtgttggggagtctatctgaacgccaccatctggaatgcctctgttgccctgaaggcactcgtctgcatctccagtgtacacggcttagagatgccaaaaattgagccaagttcactggatgtacaaacggcctgacgtcaatggaatttattcataatttaggcctcatgtgtgatgtactgtctgaactcaatgatctgtcaaaacaatcagggaagaagaggagaaggaagaagaaaaggtggaggaaaacaaagaggaagaagagaagtgaaaggtagaagaaacagcagagaagaagaagaggaaattaggacagggccaggagctgtagcagcacaggttcagcttttggctcctggggccaatggtccctgtaagtttgttgaaagcatcagtgccaaataaaacatggccttttaaagcaccgaattacgtgagcgcagagctgttaaaatcagtgtagcaaaaatccagctgggtttggccgtcgccacaaagtacaaaatgatgatcatttgtactgccaagacccagggttctccagatgtggtggactgagcagagttacttggatatacattcagttgcccattctttaaaataaggaatctgctattaagaagtgtatgaggctgggagcagtggctcacgcctgtaatcctaacactttgggaagccgagatgggtggatcacttgaggtcaggagtttgaaaccaacctggccaacatggtgaaaccccatctctactaaaaagtacaaaaaaaaaaaaaaaaattagctgggcctgttggcgtgtgcctgtaatcccagctacttgggaggctgaggcaggagaattgtttgaacctgggaggcagaggttgcagtgagccaagatggcgccactatactccagcgtggtgatagagtgagactccatctcaaaaaaaaagaaaaggaagaaatgtatgaagtggatatttgctaggggttttttggttgttgttgttgttgttgttttgtttttgcttgccctgtgtccagaggtggattatattgtgaaactaacaaagcttaagcttcagaagccttcagttgcatgggaggtgctgggagttatggagtattctaggtggggagagaaagccaggttacaatcaacaagcatttatatattagcatttctggtaaattgtctaaatcgatctaagaagtaaagaacctaaatctccaagagttcaataatttgttgggatttattttctcattctaaataaaaccaacttttatacctgtttttaaatttgtattttttttaattaaagaagaccccaaaattataaggctttcagttccataaaatctgaatctatccctatctgcctcaattgcctttcttctgcagatcaaggtaaccaaaccttgatttgcctttgtggaaaggttttctgctcactcagcagtagacacatgatccaggttcaggaataagtacgtgatccaatttgggctaataagaatcaggggcaaagtttttgctggaccttctactggggttattaagttgaaagttactaagttgtgtggaaatgcaagtgtggcattgccaacaaccatcttgcttctataagaggaaactgcctgcgaataaaattcgtatagaagaaagcagagctaagggatataaagaagccaagtcttaataatgtgactttgcaaccctgaaacaatactgaagttactacagataatcctgggcttttcagacagacaaatcaataaaaacctctttttttcttaagctattttgagttgggttctggcagttgcaactgagtcttgactaatacaggtccttatatgctggaaaaataattattattatttcaactcagaaggtgatttttttagtgtatttgcctctgaatagttataacatagataacacttactgatcactcttattaagggttttactcatattagcccatctgaatctcaaaagcaacctcatgaagtatgtactggtattatcatatccattttactaaagaggaaatcgaaggcacatagaagttaattaacttgtctaattggtgtacactttggttttagaccttggattcctaactgttacactgtgctgcttgagccaactgattcagatgatactaacatccttttaagaaaagctctcataccaagacttcattagaggttgccagcctatgaattatatgcccttagaacaaatgcaagggtgggcaatgtagttcactttcgtcagaattggctgagaatgacagctaccaagaatatagtagactattcaccagccaatatatgtacaccagccaatgggacccaacatcaaatccctcttttcttatttgggaactttctaaaggttctctcatatgtgtttccctttgtcctctttccctcgattcatcccataactacatagctccctggtgtcagtatgacactttctatctgtagttcatctgtcattcctatcactcctgatgtgttgccactggtattaaggggaatcccaacacgattccacttcagtagtttccatgctgaagatgggagaatgaactgagggctcctaatcttcttaaacaacccccattatgcctccaaactggataatctctcagtttcctacaattccctcttcttgtgcctcttccagacttactcccttgtgttcttctctgcctatggctccagtctgacaggcttaagatctaaagcctggatcccactatcaccaaaccaagtatgtatttcagacttgaagccataatgatctgatcctttcatttttcagcaaatgtttattaagcacttactaggcactggagatttagggatgagtatgacacagttttatctttctagaagctctcaaagtactggactcaggggaagttaagatgggacacaaggccaacagttcctatgaatggagtgacttagaatcacagcagaggcagatgccaacttattgaagagaataaggaggctttttaatgcaggacagaagatggagtggcaggaaaagtggtcttgaggtgtagcaggaattatccagcagagaatagcattccaagcagatggaacagcatgttcaaggctaggaaggcaataaaggataagacgtgtttgagaaatagcaagaattttagtatggcaggagcagacagtctttgagggagagtggtgagagatgattctaaaatagtaggtagaagccagcttgtgaaatccttgtgtgttgtgttctggaatctgaaaatcatccattattcatagacagccaatgagatctcaagcgagagtgacatgattacatttgtattgcagacagatcacatgagcaacagtgtcgctctcttgtagtaatcagatctttctttccagccctgctctttggatttgaggttcttcagatcaacccaatttgtggcctccattatcactgcagacagatttttctctccctttcctcagcacacaatcagtgtaccttgaagttccctcttacccatccatcagcctgggaatggcatttcctcagagaagcaattctcaaacacatgtgggtgtgtagcttgtaggaaggatatatcatgttcacttggagggcattttcaaagtacatgtgcctttgcatcacatgcccctcttgctctgaaattctaataggccaaaggtttgaggggggtttctaggggaactagcattttgtaaaagtttattcttttaaagaatagagatctagacatggaaactctaatcaagacatactcctctcaattccttagttgttattaaaatactacaaaatctgcatttatattataatagtgacacctcttatagttggtcgaaagttggccccaaaaaggatgtgtccatgtcctaatacttggcccctgttaatgttaccttatttaaaaaaaaaaaaaaaaaaaaaaagtctttgcagctgtaattaagttaaggatcttgaaatgagatcatccagatggattttaaatccaattccaagtatccttataacagacagaagagtaaaagacaaagacaaagaggaaaggccatatgaagatgaaggtagagatcgccgttacgtagctagaagccaaagaatgcctggagacatcagaagctggacaaggcaaagaagcattctcttctagaaccttcagaaggatcatggccctgccaataccttgatttcagacttctgtcctctagaatagtaaaaggatagatttatgttgttttaagtcacgaggtttgtagcaatttgttatggcatctctagaatgtcaacataccttctttctaataggttatacctaatagttacttttaagagaggagacagtttccaaagtgttgtataatagcatgatgtaaatgaatttaggccaggtaacttaatccctttgagctggtttcttcacctaatcccatcctcacagaatgttgagatgattcaatgagataaaataaaactacccagcagacaactggcaaaaaccaggctctaaaggaagtatctatttgagaataggactcaacacatgttgcatagacactctggtgaaacaagctctcccaggagaaggccgggataattaacatgcaatgtctgggcctctatcagaatctcttttacatgtaaccacttacacccatctggtatcagctcttgtttgtcaccaactaaccactgccctctcctgcaaccttctctacttcctgtttacgtagatagctgcttcctgactgacgaaactgaatggtttcagccagactgcttttcccctggacccatgccaagaataccttctttactttgcatttctcattctgctttcttcttatagtagaagccatcatattaatgagttgcaaactgctgccctgagctattcccagctaatcagttagtcttcttcctagctattggattaaatcagatgaacacaagtaataacacgtcaggtatcatgtctgtatcaagaaatttgtccatcctttcttgctccagccctgccaagctactgacaatgatgcttttttcatttaactggacaagtcataatgctgacactctcaagcccagccctgtcctgtttatgtgaagcaattctaaccaaggccagcaggacaacaaacaatagggttaaacttgaccagaactccagattgggagactatttttttttaattatactttaagctctggggtacatgtgcagaacatgcaagtttgttacaaaggtatacacttgccatggtggcttgctgcacccatcaacccgtgatctacattaggtatttctcctaatgctatccctcccctagcccccaaccccccaacaggccccggtgtgtgatgttcacctccctgtgcccatgtgttctcattgttcaactcccacttatgagcgacaacatgtggctgtttaaatgatctaatttgtggttctcaatatgagtgaatatgcaaatcatgttagaggctctttcaaacaaacagataaacaaatatttggaacatgagttaggcatggatttttttgttaactcctaagtgggataataacttttccctcaactccaggcttatcatccttaacacaatagttaaggatgtgaacactggagcctgactgtctgggttcaaattctggctttgccacccataagctgtgtggccttgagcatgtcacctaacctcctttgcctcaatttcctcatctgtaaaacagttgtaataatacctacatttgccagggaattgtgaggaataaataagttaacttgtgaagagcacttaggctatataaatgctattattactattacttttattgttgttttataacttctctggagagacaggaagttggtcagagggtgagatgcctgaattagtgatttcaagatgaggcaggttgaggtgatgtgagggttcacagtatgacagtggaagtggatagcagaggtagaatggaggaaagatcatcattggaaggagaaaattagtagtagtattaaagcatgttctttatgagactggagtacctgagttcagatcctgccttcactacttaatggcagcgcaaccatgagcagattacttaattgttttctcatctgtaccactacagaaccatgagcagatttctcctctgtaaaatgaagataataatagtgacctatcttatagggctttcatggaatcaaataagttagtaaataacatactgatttcttagaacagtgactggcatttagcaagtgttagctcaggatacaaaagcaatgtgcaaaatcacaagcattcttatacaccaataacagacaaacagagagccaaatcatgagtgaactgccatttacagttgcttcaaagagaataaaatacctaggaatccaacttacaagggatgtgaaggacctcttcaaggagaactacaaaacactgctcaacgaaataaaagaggacacaaagaaatggaagaacattccatgctcacggataggaagaatcaatatcatgaaaatggccatactgcgcaaggtaatttatagattcaatgccatccccatcaagctaccaatgactttcttcacagaattggaaaaaactactttaaagttcacgtggaaccaaaacagagcctgcattgccaagacaatcctaagccaaaagaacaaagctggaggcatcatgctatctgacttcaaactatactacaaggctacagtaaacaaaacagcatgtcactggaaccaaaacagagatatagatcaatggaacagaacagagccctcagaaataataccacacatctacaaccatctgatctttgacaaacctgacaaaaacaagaaatggggaaaggattccctatttaatacatggtgctgggaaaactggctagccatatgtagaaagctaaaactgaatcccttacttacaccttatacaaaaattaattcaagatggattaaagacttaaatgttagacctaaaaccataaaaaccctagaagaaaacctaggcaataccattcaggacataggcatgtgcaaggacttcatgactaaaacatcaaaagcaatggcaacaaaagccaaaattgacaaatgggatctaattaaactaaagagcttctgcacagcaaaagaaactaccatcagagagaacaggcaacctacagaatgggagaaaatttttacaatctacccatctgacaaagggctaatatccagaatctacaaagaatttaaacaaatttacaagaaaaaaacaaatatacaagaaaaaatcaaacaaccccatcaaaaagtgggcaaaggatatgaacagacacttctcaaaagaagacatttatgcaggcaacagacacatgaaaaaatgctcatcatcactggccatcagagaaatacaaatcaaaaccacaatgagataccatctcacaccagttagaatggtgatcattaaaaagtcaggaaacaacaggtgctggagaggaggtggagaaataggagcacttttacattgctggtgggactgtaaactagttcaaccattgtggaagacagtgtggtgattcctcaaggatctagaactagaaataccatttgacccagcaatcccattactgggtatatacccaaaggattataaatcatgctgctataaagacacatgcacacgtatgtttattgcggcactattcacaatagcaaagacttggaaccaacccaaatgtccaacaatgatagactggatgaagaaaatgtggcacatatacaccatggaatactatgcagccataaaaaaggatgagttcatgtcctttgtagggacatggaggaagctggaaaccatcattctgagcaaattatcccaaggacagaaaaccaaacaccgcatgttctaactcgtaggtgggaattgaagaatgagaacacatggacacagggtggggaacatcacacactgtggcctgaggtggggtgggggtaggggggagggatagcattaggagatatacctaatgtaaatgacgagttaatggatgcagcacaccaacatggcacatgtatacatatgtaacaaacctgcacattgtgcatatgtaccctagaatttaaagtattataattaaactataataaatttttttaaaatttaaaaaaagaaatttattctgctggataccctaaatcatctcccccaggttcaaagttccacagatctctagggcaggggtaaaattccgccagtctctttgctaaagcaaagcaagagttcatctccagttcccaacaagtttctcatctcaatctgagatcaccgcagcctgggacttcattgtccatatcactatcagcattttggtcaaagcccttcaacaggtctctaggaagtgctaaagtttccaacattttcctttcttcttctgagccctccaaactgttccaacctctgcctgttacccagttccaaagtcacttctgcattttttagtatccttatagcagcaccccactatagtggtaccaatttactgtataagtccattctcacattgctgcaaagataatacccaagactcggtaatttataaaggaaagaagtttaattgactcacagttctgcatggctaaggaggcctcaggaaacttataattattgtggaaggggaagcaaacatgtctttcttgacatggtggcaggggaaagaagtgctgaccaaagcaggaaaagccccttataaaaccatcagatctcatgaaaactcacaatcaggagatgggggtaaccacccccatcattcaattacctcccactgggtctctcccacaacacatggggattatgggaactaccattcaagatgagatttgggtgagaacacagccaaaccatatcaccatacgtcttctgaaatctaggcaggggcatccaagcctcaactcttgcactatgtgcacctgcaggcttaacaccgtgtgaaagctaccaaggcttatggcttgcaccttctgaagcagcagcccaagtacctgggtaactttgagccacatctggagctggagtggctgggatgtagggagcagtgtgccctgggcctgacccacaaaatcatttttccctcctaggcctctggacctgtgataagagaggctgttgtgaaggtctgtaaaatatcttcagggtctttttcccattgtcttggctactagtacttccctctctttgagatatgcaaatttctgcagcctcctttaattccttccctgaaaatgggtgtttcttttctaccacatggccaggctgtgaattttccaaacttttatactctgcttctcttttaaatataagttccagtttcaggttatttctttgttcatgcatatgaacatagaattttagaggcagccagggcaattcttgaatgttttgctgcttagaaatttcttctgcccgatactctaaatcatatatctcaaattcaaagttccacagatgtctagagcaggggcacactaccgccaggctctttgctaatgcataacaaaagtgacctttgctccagttcccaataagttccagactttgctgaagttgcttatcagcttaaggagattttgggctgacacgatggggttttctggatatacaatcatgtcatctgcaaacaagtacaatttgacttcctcttttcctaattgaataccctttatttctttctcctgcctgattgccctggccagaacttccaatagtatattgaataggagtggtgagagaggccatccctgtcttgtgccagttttcaaagggaatgcttccagtttttgcccattcaatatgatattggctgtgggtttgtcataaatagctcttattattttgagatatgtcccatcaatacctaatttattgagagtttttagcatgaaggcctgttgaattttgtcaaaggccttttctgcatctattgagataatcatgtggtttttgtctttggttctgtttatatgctggattatgtttattgatttgcatacattgagccagccttacatcccagggacgaagcccccttgatcatggtggataagctttttgatgtgctgctggattcggtttgccagtattttattgaggatatttgcatcgatgtccatcagggatattgatctaaaattctctttttttgttgtgtctctgccaggcttggtatcaggatgatgctggcctcataaaatgagttagggaggattctctttttctgttgattggaatagtttcagaaggaatggtaccagctcctccttgtacctctggtagaattcggctgtgaatccatctggtcctggactttttttggttggtaggctattaattattgcctcagtttcggctcctgttattggtctattcagagattcaacttcttcctggtttagtcttcagagggtgtatgtgtccaggattttatccatttcttctagattttctagtttatttgcgtagaggtgtttatagtattctctgatggtagtttgtatttccatgggattggtggtaatatcccctttatcattttttattgtgtctgtttgattcttctctcttttcttctttattagtcttgctatcagtctatcagttttgttgatcttttcaaaaaaccagctcctggattcattgattttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcttgctttctcttgcaggcatttagtgctatatatttccctctacacactgctttaaatgtgtcccagagtttctggtatgttgtgtctctgttctcactgttttcaaagaacatctttatttctgccttcatttcgttatgtactcagtagtcgttcaggagcaggttgttcagtttccatgtagttgagcagttttcagtgaatttcttaatcctgagttcttgtttgattgcactgtggtctgagagacagtttcttaaaatttctgtttttttacatttgctgaggagtgctttacttccaaatatgtggtcaattttgaaataagtgcgatgtggtgccgagaagaatatatcttctgttaatttggtgtggagagttctgtagatgtctattaggtccacttgctgtggagctgagttcaattcctggatatccttgttaactttctgtttcgttgatctgtctaatattgacagtggggtgttaaattctcccattattattgtatgggagtctaagtctctttgtaggtctctaaggacttgctttctgaatctgggtgctcctgtattgggtgcatatatatttaggatagttagctcttcttgttgaattaatccctttaccattatgtaatggccttctttgtctcttttgatctttgttggcttaaagtctattttatcagagactagacttgcaaccctgctttttttttgttttccatttgcttggtagatcttcctccatccctttattttgagcctatgtgtgtctctgcatgtgagataggtctcctgaatacagcacactgatgggtcttgactctttatccaatttgccagtatgtgtcttttaattggagcatttaactcatttacatttaaggttaatattgttatgtgtgaatttgatcctgtcattatgatgttagctggttattttgctcgttagttgatgcagtttcttcctagcatcaatggtcttcacagtttggcatgtttttgcagtggctggtactgattgttcctttccatgtttaatgcttccttcaggaactcttataaggcaggcctggtgacgacaaaatctctctgcattgtctgtaaaggattttacttctccttcacttgtgaagcttagtttggctggatatgaaattctgggttgaaaattcttttgtttaagaatgttgaggcctggcacgatggctcatgcctgtaatcccagcactttgggaggccaaggcgggcagatcacggggtcaggagatcaagaccatcctggctaacatggtgaaacgccatctctactaaaaaatacaaaaaattagccgggcgtggtggtgggttcctgtagtcccagctacttggaaggctgaggcaggagaatggcgagaacctgggaggtggagcttgccatgatccgcgatctcgccagtacactcctgcctgggtgagagagcgagactccatctcaaaacaaaacaaaacaaaaaagaatgttgactattggcccccactctcttctggcttgtacagtttcttctgagagatctgctgttggagtatgatgggcttccctttgtgggtaacccgacctttctctcttgctgcccttaacattttttccttcatttcaactttggtgactctgataattatgtgtcttggagttgctcttctcaaggagtatctttgtggtggtctctgtatttcctgaatttgaatgttggcctgccttgctaggttggggaagttctcctggataatattctgaagagtgttttccaacttggttccattctccccgtcattttcaggtacaccaatcagatgtagatttggtcttttcacatagtcccatatttcttggaggctttgtttgtttctttttagtcttttttctataaacttgtcttcttgcttcatttcatttgatcttcaatcactcctttcctccacttgatcaaatcggctactgaagcttctgcatgcatcatgttctcctgccatagctttcagctccatcaggtcatttacggtcttctctatgctgtttattctagttggccatttgtctaatttttttcaaggtttttagcttctttgcaatgggtttgaacatcctcctttagcttggagaaggttgttattactgatcgtctgaagctttcttctctcaactcgtctaagtcattctccatccagctttgttccattgctggtgaggagctgtgttcctttggaggagaagaggtgctctgatttttagaattttcatcttttctgctctggtttctccccatctttgtggttttatctacctttggtctttaatgatggtgacatacagatggggttttggtacggatgtcctttctgtttgttagttttccttctaacagtcaggaccctcagctgcaggtctgttggagtttgctggaggtccactccaaatcctctttgtctgggtatcaccagtggaggcggcagaacagcaaatattgcagaacagcaaatgttgctgtctgatccttcctctggaagctttgtctcagagggctacctgcctgtatgaggtgtcagttggcccctactgggagttgtctccaagttaggctacttgggggtcagggacccacttgaggaggcagtctgtctgttctcagatctcaaactccatgctgggagaaccactactctcttcaaagctgtcagacagggatgtttaagtctgcagaagtttctgctgccttttgttcagctatgccccgcctccagagatggagtctacagaggctggcaggccttcttgagctgtggtgggctccacccagttcaagcttcctggctgctttgtttgcctactcaagcctcagcaatggcagacgcacctcctccagccttgctgccgccttgccgtttgatctcagactgctgtgctagcagtgagtgaggctccgtgggtgtgggaccccctgagccaggcgtgggatataatctctggtgtgccatttgctaagactgatggaaaagtgcagtgttatggtgggagtgccccgattttccaggtaccgtctgtcatggcttcccttggctaggaaagggaattccccaatcccttgcacttcccaggtgaggtaatgccccaccctgcttcacctcatgctctgtgggctgcactcactgtccgacaagccccagtggatgaacctggtacctcagttggaaatacggaaatcacccgtcttctgcgtcgctcatgctgggagctgcagactggagctgttcctatttggccatctttgaacctccccccagcagaagaaatttctaagcagcaaagcattcaataggaagcagagcataaaatttcagaaaatttgcagcctgatgacaatgtggtagaaaagaaaaaccaattttctgggaagaaactcaatctggctgcagaaatttgcacaagtaacaagaagccaaatgttaatcgcccagataatggggaaaatgtctccagggcatgtcagagacctttgcagcagcccctctcatcacaggcctggagtcctaggagggaaaaatggtgtcatgggccaggcctagggcccccctactctgtgcagcctcacaacatggtgccctgtgtctcagctgcttcagctccagttgtggcacacaggtgagattcagagatgaacaagaaagatgtccccgctacagtgaatcttgcagaagcaaagtcttatacaaaggactccagaaagcctttccaaagcagagtcagccaagacactaagagctatcactagccaagacactaagagctccctaagaggatataggctttgaaacagacaaataaatttgcttaaactctaaagttctttaagcctggcaactcagatcctccaggagtatgcttgattttgtaaggacacttttgcaaggaagataaagatttcatcttagatgccaactctgagtgactggtagttgtggtttagagtcctgagttaaggactgtgaaattccatctgagttcagcaggaaaagaagctatgatagattagcaatgtcagccacatgtatttaagggatgaatgagggcaaatgtggcacacattactatcccagccctaatgtagcctatcttatatttttcacagttgtttcacatacctgttgattttccaactgggcaacaagctccagggaaggcagcattatgcagtggaaggagcagtggaagctgagcaaaggagcttttctttctcttctgaaaggtagcatggtgggatggaatgagcacaaggtgcccagagttagaaaggtatggctttggagttgggcacttcactcttccacagattgcctgatcctagacatgttacagtcaattctcattctcttttatggtagttaatattctataaaatctgaagcattgacctagcatttgctatgagctgttgcaggggaaatacaaggttaggttcctgcaagcctctggtcacattttcatcaaccaatcaatacataacctagttttatgtgtgtttctgtttaaagacaccttatttaatatatattgttgatttattaacactgaactcacagcctacagggctataattcctacccgaaggaagcttatctaacacacgtttgttttctgtataaggcacatcacagccttcttactctcaggaacaccagacagcactgcaacgctattattaggaatcattgtaaagagcaaaatcaccaaaaaacacaaaaatgagaaaaacgtggcactaaatagactgcaaaaagattcttgtttacagtataagagatgaaacaagaaggcaaggcattgctttgttcaatctcagctgggaatattcatgttagacaactcacatttgtcacggatctgcgcatatctgtaaatgaccacaaaagttccatgagcactgatttgggctacaaataaattttggcaagtaggcaaatccattcatgaataatgaggatgaactgtactaagtttctgtgagccttagtaatgatacctccctcacactacagagtaaatgaaagaaggcatgtaaaatgccttgcatggttacagttagttcttctttataccagatatttacattttcacttcctgtaccttatctgccatgctcaaatctgagagataagtagatatcaagaaacttccagccaaatgtctcatctttatcctgggagcatagaccaaaaactactcacactagctaaaatagaaaagaaggtgttttgaacagacacaagaggcaatctcttgaggcaccaaagtgcagggttcagcatagctaggccaccctgcgttgggactgaaacaggaagatcagaagaagtcccaactctcaggtggatgcatcctctgccatctgtgcctctctgagcatctgctagctacacttttctgattctctcagcagacaggtttcctctgctttctctggctttcttgcaccctcataattttgactctcatgtggttctgacttccatggcactgattccagcctgactctacatgtctggtgcacacctgtcgtttttgcctgtctagcaccattctcccagttctggtaacagaggaactgactggctccaggattggcctgtgagcgagacccagccattgactctctcctgagggtttgatttgtcttggttatcttctatcatttatgttgttattctttgtatcttttcactgccttgtggcttctgtttgctcagcgctcctgtttattcatggtttctgcttactcatgaagtctgatactggcttcactctgcacctttgagctttcattcactgaagaatttttccctgtgtctctccagttctgattattgaaataaaatatcttattgacatagttaattgccatgtgtttgggcagaattttcctgccaggacacccaacaggccaatgtccagcctattgatcagctgcccctaggtaagggcctatcatagcctaacaagcagtaagcagagttgtaggggttggaggtgtgcatatggtatcacatgtggccacttatgttgaaggatttacatcaagctagttatccagacccttctctttttctaatacctcatgtccaactgtgaagaaatcctattagctctaccctcagaatatatttagaatataatcacttctcattgctcccactgctacccctctgctccaagccactctgcctttcacttgcattactccagtagcttaagaagtcacctgcttctacccatagtctattcccaatatagcagctagagtgattattttaaagccttagtcatatcatgtcattcctttgtttcacatatactcctggctccccatttcactcaaagtaaaagccaaagccctagccccattacctccaactccatctttaccactttcccttgctcacttcactccggccacactggccttgctttttgtcagatatccaggtatgctcccaccatggggcctttgttccagctgccctatctgtctgaaaaaaatcttctttcagataatggcttgagtaactcccctaattcctttagatccttattcaaatttcaacttctccagaaggcttgcctgactaatttattttattctacaactgtggtggataaatgccgtacagtaaatactgtggaaataaacactatagttccccacagatccatgccttcttgccgctgctttaccttttgttcttgcacttaccattttctaacatattatatacattttgcttactacttattgcttatctctccctgctagaatataagctccacaaagatagagatctttgtctgctttgctccatgatataccaaggatttagaacagtgcctggcccaagtgctccataaatatttgttgaattgaattccttggtaggtagctataaacatagcagatacactaaggctttctctatgcaatataaaatgtctctcagagaaattcatggcactaaaagcatatataagaaaagaagaaaattatcggatcaataatctaagctcacattcaagaacctagaaaaagcgaataaaataaacacaaagcaaatgaaggaaatataacaaagggcagaaatcaatgaaagtgaaaaacaaagaatagagaaaattaacaaaactaagagctggttctttgaaaagatcggtaaaactgataaacctctagcaggactgagaaagaaaaaagataaaagacacaactttctaatatcaggaatgaaataggagataccattacagaccctgcagacatctaaaggataataaaggcatactaaaaacaactctatacacataaatttgacaacttagtttaaatagagcaattccttgaaaaatgcaaccacaagtcacccaatatgaaatagatcatttgaagagccctataggctgggtgctgtggctcatgcctgtaatctcagcactttgggaggctgaggcaggaggattacttgagcccaggagttcacggccagcctggacaaaaagtaagaccccatctctacaaaaaaatttttttaattagccaagcgtggtgatgtgtacctgtagtcccagctacttggtaggctgaggtgggaggaaggcctgagcctaggaggttgaactgcagtgagctgtgattgcaccaccacattccagcctgggcaacagagtgggacccttctcaaaaaaaaaaaaagaaagaaagaaagaaaagaaaagtactataactattaaagaaattcacttacttgtaagaacggctgaaataaaaaatagcccccaaatgctgctaaggatgaagaaaagacaaatcactcatacattgctggtggaaagtaaaatgggacagccactctgacagtttggcaatttctttaaaagctaaacatgtgactaccatacaacccagcaattgcacccctgggcatttatctcagacaaatgaagacttacattcacacaaaaatctgtacatgaatatttatagcagctttatttgtaataccaaaaactggaagcaatccagatatacttcaatgagtgaatagtttaaaaattgagtacatctatattgtggaatattactcaacaataaaaaagaacacattatcaatgcatgcaaaacctggatgaatcgccagagaattatgctgaatgaaaaaaaaggccaaaaatttacacattgtgtgattccatttttgaaacgttcttcagatgacaaaattatagaaacaaagaacatatgtggctaccagggtaacagagtaggtggggtgggggggtaggaggatggtgggtatgattataaaagggcagcatgggatatcctatgatgttagaaatgttctgtatcaatatcagtatgctggttgtggttctgtattataagtttgtaagatgtttaccattaggggtaattgggtaaaggatataaggtatctttttgtattacttcttacaactatgtataaatttaaaattatctaaaaattaaaagtttaattaaaaatctttctcccaacagactttatttaattatggttgtttcatgggagaagagaaacactttattaaatttaatcattgattataaaattgcacctaaatttcaaaaatgtgaaaaatgagaaagtacaacttagaaactaggaaatatattaagtatgcatatttatttgtataattatttgcatcagaaatagggaaccatttaggagaggaaaagacaacaaagtcttcctaacagtgattatctctaaatggtagaattatgggcatttttttttagcttatctgcattttcttattttctacagtaaacacatattactgacataattttaaagaaacatgatattttaaagatgttatttagaccaacccttaatccattgcttgaaaacctgcaatgaatcctcaaataattagtcacttcagtctttaataccatagaaaccaatagctcccaaagcagcccaggcagctctaattatttgaaatgagagctgttgaaagcaaaggtctgcactgcctgtgccattagggggtttaaggatatgggtttgatcccagcacaggtcaattaactctgcttattcgtagaggaaaatggtaaaggtacactgcctgcatggctcacaagggacagtcactactcaaacactgtccacaagagacacaaacacgtgaaagtaaacaggcatctcaaatccatttctgctaagcacctcttctcatactggacaatttctcatttcctcaagtggtcagcaggaaacaaacagattgtaaaatagttgttacaatcaatagccaggaataaaagcgtaaaaagcaatcccatctccaaatgaaattctaaatccccattaaatactttaatgtcaacctaacaagaactaaaaagaaaactctaaaaccataatgacacaataaaggtaatcagactggatgcatagccatctttgcttgtaactggaaagattacataaatgacataataacactttccatattaattcatagatttaatgcaatgataattaatggggcattaagagttttataaaccagaacttgacataataattgtaaaatgctcatgaatacagccaggcccggtggctcacacctgtaatcccagcactttgggaggccagtatgtgggcagatacttgagtccaggagtttgagaccagtctctaaaactacaaaaattagccgggctactcgggaggctgggatgggaggatcgcttgagcccaggaggcagaggcttcagtgagccctgatcatgcccctgcactccagcctgggtggcagagtgagaccctgtctcaaaaaaaaaaaaaatgctcatgaatagaagcatatttattcacgaaggaaaaaagataatgttgtagaactctttcatggatttaaaaatattgtactgttataaagcagcaataatcaaaactctttggcagttccattgaaattgaaggagctgttctgagccagtatggtaaaggaaaatgttaggaaagatgtctgggctaaagaccattgaggtctgggctaaagaccattgaggcaccattgggtgccttggaaaggttttttggtttgcaagacacagagacctccttcaaagtagctcatgtacaagggggaaaaaaagctataacaagctttctcaattcatctaatgacagtaacagagaacagctggacctcactgctctgaaactatgaaccatggcaactctcttcatatctcaagaattcttcatggtcctgctccctgagatctaagcactagctgggggacacctcatcccacctcccacagtctcaggccctgaagcagtggtagctctggaggatgttcatagcattggctcacttttgttctcccagtcttaaaggtagaagcggcttcctgaaatatgaatctttggttttcctagcttcctctttttgcttttccagctttccaacacctgtgtaagaaattccatgaattaaatcccttctgtttaaggtatctagagtgatttctaatttcctgattagaccctgattgatacattgttagcttcaacactgccctttatttcgtttagtttatagtttagtttagtttagtttagtttagtttagtttagtttagtttagtttagtttaatttagtttagtttagtttaggactagagtgcacaaatcataagctgttgtccttttgtgcaggtatccacctctgtgcccccaaaaacagcgcagggcatggctacattgagcagatagtctatcatcccacactttctgatgcagctgagactaggacagtccaggtggagttgggaatgggtgggtaggtaacatgagagtgaggagggttgacaattgaggaaggactacaaagagatttgagaagaattatacaaacacacaaaggagaaaatctgttaccagaaatccagaaagaaatcagtgacactagtcactgtggtaaccagctgactgcaaaagccaaaggcagatgcagttgtagttacaggaaatagattccaggaacaggaccaatacagactgggataggagagttaggcatttcaggcacattagcaggcaactatgtggagatgtatagatagtggactggacagtctcaggtaatgttataaagcagcaatgatcaaagctcagttcaacggatattgaaggagctgttttgagtcagcatggtgaaggaaaatgccacataaagagagcaaatgcaatctatctgagttttcccataatgtgacatattcccaaccttcctcttctttttattttctaaataattgtgatttatttagcagttaatatttttatgttcattttatttagtttctccttttctaagcaacgaagtgatatgtgttcattgtgatacatattaaaatattcatatacatgaaaagaaaaatattatgttcatctgtaatccaatcatccaaggttaactgctgttaaaattttcctttcatatattttatgcttgcatatcgtatgtatgtacctatgattatatgcctatattttaaaaccaaaattattccactgttcctgtttcataccatacagcttctgtgtacagaagctgtcagcttgacagagtaatgaaatcgccttctgcaggtgcaactgaggtgctactttataggtgataccctgcaaagatagagtgatatcttccaggatgcagcatacactctaaatctaccatcattatatgggcatgtgttctcaataggtacaacacataagtctgggaaccaaaagtaagaagtaggagtggccctgggccctgcttaccatcgctcacagtgatccacttgtgttatttgtgcttcttatccctgcaaccctgggatttgtgggtttggaggtcctggtgattgactggtacatctcttggtatcactttgcccaattttgatggtaaatggaggcaggagcagcagccatggcccaagaaggacatagtaaccagaaacccaccaggtaaaccacctggatggcagagctgagggtgagtgaagctaaaatgggttgtagaacaggaacacaatgagtatcagtggcaactttcagaccagaggtcagtaacaaggttctagtttaccccactaactttctgcttgtaagtttacccagaaaaaagagtctaaccaggatactggaggaactgttcctggaacttgtgcaaaattagtagatccaacacaaagcattggctgtaatgaatgctgtggtttgccactcagatcccctggttggattaaggcagtcattcccacaactactaggaatattggccactgatagctctcatataatttatctcctgataattgttttcagctaaagagagtcaccttgcccaagttcataggtagcccatatctaataactagtccatgcccaggtattaaggcccagccttctttgcttcaaagcaggacaactccagagctccctgtaggattggccaagagacctttgttgtgaccctactgcagtttaacttcttctagccaatcctacttccttcactctttccctgatattgaatccctaggcactctccaataaactccctgcctgcaaatatccatctcagagtctatttctagggaactcaggatacaacagttatattcattttttgtgtttatattttaacagaagacactaacacttaaagctctaagcatttgactgtataaagatattaagaatccctgggtcatctttgtctgtaaagttcatttacctcaccagcagcatggacaccttgtttccttgcaacccagccctccttgcatgtgctaaataccaaaagcagccagcctttcagttctgcttccgtctagtggtcattttctatccccttctgctctctggttgtgttaagtcctgagcttttccatcccatccttccagaaagccactagtcccactagctgtcacttatctgcccgcacccattgtgaactaagttccggatgctgagggttgtgggaatctctccagtgttgccaggaggaagggaactaaaattcctctggctagcagtcaccatcttgtttctctatttctttcctttgcccttttctctcatgattagaaagttccttccttaacccactacatcttcaacttctgcttcccattgggatttcaacaccttttcacagcaaatccttgtattcgtgatttacaccttccaatttctgaattataaagctgtaaatggaaagtaagttctttgcttcctttcttttttgtttccttctctccttccttcagcaaatttcttgctcactaactctgagtcatctcttaagtaaaggtaggctatacctatgcttatttaaggttattaaatgtgatattaaggacacaactattccctctcaaaacttccccaggggccaaggttggcagcaaattggtggtctggctgagtcttgcagcacatcccacttgaccaacaacccagagctcatgcccttggatggagagtttattaacagcattctctttgtgtaggaacgcctccaagttttgtaaaggcccactatatttcgtgtagtaatgtggaatgttcctaaccagtagatttctatcaaccagccagtcttcaaagaccaactggacagggaggatggaaaccacaacctagccccctcccagtggctcctttaagacaccaggccctcctgtgcacttctaaatcaaaaaccacataaaattggatcttctctgtcctcacattgttgttgaccttagtcctaaagcctggacacacatctcaacttttccccaacctccaggtttctgatcttgcaattcgttctcccatttatagccttgcttctccctcagggaatagcttgggtcagtagagggaactacagctcctctttagcacattatctcaaagcagagtcttttcaaacagggaaatgtagagagaaggtagacaaagattgtgacttttatttattattgttttttaatttttttagagacaggagcttactctgttgcccagactggattgcagtggcacaatcatagctcactgcagccttgatctcctaggctcaagtgatcctgtctcagcctttctagcagctgggactacagatgtgtgccaccatgcacagtattttttttttttttttttttttgtgcagatgggctctcactaccttgctcaggccagtctcgagctcctgtccttaagcagtccccccaccgtggcctccctgagtgctgggattacagccgtgagccaccatgccaaggtagattgtgacttttaatatgattatccttccacttgcagaaactttcttgtttttgctcatcgtttgtatttgactatcggcaccatttctctggctttgacttcaaacttttgttttgctcctgaatcaggattcagattcactcatactgggacaaatcagagaaagctgaaagaaggacgataaatagcaccatggaaccctggacaattctgcaattggaggcaccagatgtctctgaagatggaattgtggggtgtaggtagaaagaaaagattatttgaaagctttataatgaccgtttagatccccagatcttcttcccaacatactattgtcaaatgactgctcttctgttacccaggaaaaagcctgaaggtttattctcatgaaaggctgggtcaaacgctctgggcagtatatgctagacacaactgaaaacaagggatttaaatggaagtctacagactgaatgatgaattccctcacccctctaggagtgaggggaaaacagagaactagaaatagcttttagaaataaaaatgtgatagcagaaattttaaaattgagtagaaaaattaaaagatggccaggcacgttggctcacgcctgtaatcccagcactttggggggccgaggtgggcggatcacgaagtcaagagatcgagaccatcctggccaacatggtgaaaccccgtttctactaaaaatacaaaaattagctgggtgtggtggtgcgcttgtgcacctgtagtcccagctactctggaggctaaggcaggagaatcacttgaacctgggaggcggaggttgcagtgagccgagatcacactactgcactccagcctggtgacagagtgagactccgtctcaaaaaaaagaaaaattaaaagataaagttaaaaaaatctcccagaagaaaaaggaaagataagaaacctagaaagtcagttcaggtgatccaacaactgaatcaggagttctagaaagaatgagcagggtgcagtcgcttatgcctggattcccagaactttgggaggccaaggcaagaggatcacttgaggccaggagtttgagactggtctgggcaacacagtgatacccccatctctacaaaaaatagaaataaaaaaagtagctgggtatgcacctgtagttcccactgcttggaaggctgatgtggaaggattgcttgagcccaggagttggaggcgacagtgagccatgattgctccactgtaccctagcctgggcaacagagcaagtcccccagttctatagatttaaaagtaaaatgtcaaaaacattctatggagaaaagatagtcttccaacaaatagtgctagagcaactggatgtctataggcaaaataatgaacttcaacctaaacttcacaccctatagaaaaactaactcaaaatggataacagatttaaaagtaaaatgtcaaaaaaattttttctcaagagtaagcagagaaagtggaggggagggaattactaaaataagatgcctgaagctgatatggccttttaaaaaagaatacacatggtagtttctcaaagctgaaggaaatgtgttttcagatttaaaaggcctattgtgttgacgttcattcctcatacagaatgaaaaaggacactattctaaggtgtatcatcatgaaacattaaaaaaagaagattccaaaactttccagagaggaggggaaaaaaccctttcatgtcccgtaggaaatattattaatgtaaaacatatcaacagcaacatggaaagttagaagacaaagaagtaatgcctttagaattctgagagaaaatttttccaacctagaagtctatactcagactttcactcaagtgcaatgctaaatttaaaacattttcagtcatgctaggtctcaaagaaatacacattccataaactttttctcaggaagctattgcaggataagctccaccaaacccagtgagtaaaccaaaaggaatataggagatctaaggaaacaggagatccaacaaaagggggatgtggaggaattcccaaaatgatgaaaagggggcatctcaaacagctggagagctgccctggacagcaacaacccagaccagagccggacaaggaaggtccccagggtgacatccagaagagaagtcagtgagaaaacaaaactgatagaaggagagatttataattctgttagagggctagggagaaattagtgattaattcatgaacattgatgttttaaaaagacaattattaactaaagggaaaacaaaatgattgtatcagatatgaagtgaacatcaagcagttcatctgtgaacaatattttcttaggcctaataatttaaacactgaaattgtgatgtaatgggaggatggggataggtgaagggtttatgttggagagggtggtagaagaaaactagatcctaaccaccatagtaggaaatcaagagatgatatctaaaactgaaaagtcaagagagaaaaagtacaagcaccagaagaaatggctaaagatgtgactacagttagctgtgtggagcaaaacacagaggtggggaagagtgagcaaaatactgtttctttttgttgttaaaagccttggatttgactttttatgctatgtgcttatatattttttcttttatttttattcctctagatatgatgcctgaagaattcttgtatgtttctattttttaaaagactaaagcaaaaaaaattttaaagaggaaataagagagaagggaaaattagggtagaaaaaaataagatgaagtcagaagtaatgcacatcatccagtacacatcattgctaaagataggctgaaaatttggttctgagctttttagcagcaagcataaagtgggaaatgtaattgtttacatggtttcacaatgtccaagagataaaaacaaaccacttactcaggagaaatatagctattcctggtactgcgatctgagagacagttctcccatctgttctcctaaagaggacacatgtgacgtagtgaaccacatcctccttaacttgccaacagtaaatgcaacaataagtttcatagagctgtttcttgtcatgtctctcaacataggtgaatggcaaaatgccaatgcagtgctcagtaaaagcaactctatgaagaaataaaaatctgtttagagaggcaataaagcatagtagtaagagtgttggcctgggttccaaatctatctgtcaaacaagttacttaactactttgtactcagtcttctcatcgataaaactggtctaataataccatctcatagaattttgtgagttatgcatgtgaagtacttagaacaatgcctggcatatataagcactaaaaaaatccgtttaaaaaatccacttttaaaaaaagtgaatcttacatgttaaggctactgtaaagaaaacagtgtgatattgatggagagatagacacatagatcagtgaaatataatagagaaatatatcacacaagtatagccaaccgattttcaacaatgttgcaaaaaaaaattcaatggagaaaagatagtcttccaataaatagtgctagagcaactggatgtcaataggcaaaataatgaacttcaacctaaacttcacaccctatagaaaaactaactcaaaatggataacagatttaaaagtaaaatgtcacactataaaatgttttcacaaaaacaaaggagaaaaccttcaggacttagggcaatgtgaagagttcctcaacatgatacccagaaatgatccttaagagaaaaattgataaattagacttcatcaaacttaaaacttttgctctgtaaaatatcacattaagagaatgaagacagacacaggctgaaagaaggtgtctgcaaaccaaaaaccactgcagaaaatatagtaaaccaaacatctgacaaaggaccataaagaacactcaaaaatcaacatcaaggaaacaatctaattagaaaataggtaaaagacatgaaaatatatttctgcaaagaggatatacaaatggcaaataagcaaataaaatatgttcaatgtcattagccattaggaagatgcaaattaaaaccatgatgagatatcattatatacctattaggatggctaaaataatgacaatactaaatgcctgtggagaaaactgactctctcatatatcgctggtggtagtgtaaaatggtatagccactctgcaaaatagtttggcaatttcttaaaaatctaaacttatacttaccacatgatctagcaatcacattcctaggcatttacccagagtaatgaaaatttatgttcacacaaaaacctatacaagaatacccattgtaagtttatttgtagtagcctaaattggaaacaacccaaatgtccttcaatgggtgaatggctaaacaaactgtggtgcatctatatcatggaatactactcagtaataaaaagaaacaatctattagtacatgcaacaatttgtatgagtctcaagaaaattatgctgagtgaaaaaaaaaagccaatctcaaaggttggatattgtatgatttcatttatctaacattcctaaaatgataaaattacagagatgaagaacagattagtggcactagggatgggttgggggcagtacaggtgtgaccatagagaggtagcatttgggatatttgtagtaataaaacagttctgtatcttgacttttactgttgttacatcaatttactacatgtgatgaaattgcatagaactacacacacacacgagtataggtaaaaactggtgaaatttgaataaattcaatggattgtaccaatataaatttcctgaatttaatattgtactatagttatgtaagatgttaccattgggggaaacaggataaagggtacacagaacgtccctgtactatgaatttcctatgaatctataataattttaaaataaaaagtttccaaaaaaatgtatcttataaaaaatgttataggctgggtgtaatggctcacacctgtaatcccagcactttgggaagccaaggcaggaagatcgcttgagcccaggaattcgagatcagcctgggcaacattggaagaactcatctctacaaaaagtaaaaagttagctgggtgtcgtgatgcatgccttagtcccagctaatagggaggctgaggtgtagggattgctcgagcccaggaaattgtggctgcagtgagctatgataatagcactactacactccagcctgggtgataaagccagaccctgtctcaaaaaaaaaaaaaaaaaaaaagttatataagctctataataaaacttcattaattagggattaaagtttacctttatttaacaaactgtgtattgtataaaattagaattaaacatttgggatgttggtagaaattatagaaattcatcaagttttgctcttgcaaaacttggtgaaggcaaaggggcccagggggactctaatgcagatgctcactgcttcaagaaggcaagtagcatattttcaagagttgttaaagaatagcacttattaccatagagtaattgtcttgcccttatcttttcaggttcaaaattttgatttcctagcatgaattcatattaactgagctcacaggactgatgtactatgtgtgacaatctcagccgcaatttcagatgtgcaagaaaaaaacaagtttctctctcttctttaaatcaacttattttgaactccacatccccatcatatgagctggagagaaattcagcctaagtaattccttgccaaggcactgttggtctggttactgtccagacacccactgttgtagtctgaagggcactctcaggagtagagactgtggcttttgtgatgcttcggactcgggaacttttcgtgctgaggatccagcctccatgggcactccaattgctctctgaggtcttgctatctttctgtgctctgacatctcaccctctccagcctcagggaaactcctagagaagcctctttcctctctaagatcatttctgtctcaaccctccaagaaatccagcaacatctagtcaatcagcttagcttttccagagctgaggaaaaccactaacttgaagctgcttctaatttttgtcctgccaacattcttattataagaaattataaagcctcactaccttgtgaaatgcagagaagaggaaaatatagagaggataaaataaaattaatattttaacaaattaccctaccaaactacaaaagccactttattaatttgcaataaatgtcacagcaatgggttacatccatatggctagcccactgtcccctctttaaagtagactttcatgatcctccttagactgttgcttggtgaacatgaagcagagccagaggctttagaatagttcaacatttaaagggatcaggttatcagagtctgatgtattaatcccacaatagggacattcacatcatggtaggggagctgggaacactggaagttcattggctatgatctcccaaatccatgtttactttgaaaatgtccttgtctgtggagctgcaatcgtcagaggcatttggctggctgggactctcttccccctgacagcacttggatgaacactgtcaacatttgtcctggaggccgtcttttttctatgcctcaacagctcaccaccccttccatcaaataacaggccaattctgctgaccaaatatccatgtctcttcaggatgattttgcatagatctgttccagtaaattacgtagggactctaaatttgaactctgaaagccatataatttctttgcttttgggttagccttcctgtacccatcacatcctgataatggcatatataaaacaaattatattagatcttcaatctaggattcaaaacaccagaagcatccaagcaaagaaactgtcttaagaaacttaaaaataattatacatcaaaaattacatcattatagtatttgaagactagttaattgcggcatgtatgataatagtgaaatctgctagatgcaaatgacacaacagtaatgtcactgaagtcagatttttaagtgttgagttcatgcactgtgctgtgtgctatatttagatacctaaactttagatatatcaataacctagttaggtcaagcaagtccatgacatttccccactctttgcatagaaataatggacgttctaatgaaagtatgatactccaaatttgcaaaaggcttaaatgcaatcttgatggtaattcctcacatatatatgtgtatatatacacacatgaagaattatcctattttcttccttacaggagaataagaaaatataattaataataataaattataaggttattttcccgtaaaaaaattaagaagtttcatcactcacgtcagcaaaaataacactccaactgatcccccaccctcaaactctaattagttatctggtattctctagaatccttttgcttgccttacctctcttttcaatgttttttttcttctctagttttcttaaaatgacaccttcacggtacccatcattactaataaggtcttcccaaactttgtcaattgattatgtccagtaaagccaagaaaaaataccaggcaactggctttatgagtgattttgtaataactttatctatcaagataaatagatttgctgtaacatgttagggcttctgaagtaattccactacaattttaggattccaaaggcagtatatgataaactgaagttttttaaagatcacttcaactgggttggggataaaacttagcataatatttctatcaagctgtgttttattttgatttgatttccttcagtatttttgaaacgtattaatgtttatgaaatacatgaatatatttactttgagctttgcttgcctctaactcatgcacaaggacgctttttcacgtaaacttgaaataataataataagctagttgtgttcagctctgtcctttgagatgaagagatgcagtcataaccccagagggcagtcatatggtctccattgcatctcagcatgattacaaataatgactgtgcccagaatttgttcagatgattgttttacccatgatatgttttgttaaatacagaataccagacattaggagaagatgaggctgagaagagttaacatctttcgttttgctgagataacaaagatcccatccaacatattacctactgaccccatcctcttgccattggagcagcagggcaaaatctgttcacattctcatggccccagacagagtgctggccttgagcacactgtgtgacactcatttgaccaagagaatccagtaggcacagggagagctgcctactattgccacgttgtatgaggtgacaagaatgtctcttttttttttttttttttgagatggagtctcactctgtcactcaggctggagtgcagtggcacgatctcggctcactgcaaactctgcctcccaggttcgcaccattctcctgcctcagcctcctaagtagctgggactacaggggcccgccaccatgcccggctaattttttgtatttttagtagagacagggtttcaacgtgttagccaggatggtctcgatctcctgaccttgtgatcctcctgccttggcctcccaaagtgctgggattacaggcatgagccaccacgcccggccaagaatgtctctttaggtttgatttccatttcaggaaatcacaaaatcagattgcatataatggggctcactccaagagagtagagtgagatttagaagcctttcaacctacttacaaaatgtgtacagttcccatttcactgcagatgaaacaataacaaatattgagcaaaggaggttaatccatatccagaagattttattaagttaaacaaaaaagtcatgcaggtcccaggcaataagttttatttaaaattaacagcaacctataagcacatttcatcaaaaaccataaatagatattgtaatgtatctttttcactactgactctatcatgagtctacctgaaaagaaaaaaaaaacagtaatagcaaccatcagggctttttaaaaaaatcagtatttttcataaaacaacatagcagatttcagactgatagagacctgtcataaggtgttgtctacagagcagtagcaaggcattattttctatactgaaatttagtttaacatttataacaagtatcttataaggaaatctctttattggatcttttaatcagtatagactgggtgtgagggaaagtaggtcaaaataaaatatttattacacagtcaagaaaagacaatatatttttaatttgtggcttaagatgcgaattaatttatttatgttcttggttacctatgttacatatgtctatccacatgatgtatgtgtctgtgtgatatgtatatccagtggggtgctgataaatcaactcttaaaaaaattaaatcctgatctattgcctttgctcatttccatactgtaaatatttccactatggccagtttcaagctgccaatatgatgtccctgaatatggagttgggaagagatatgcacacttgatacttgtacaccagtatctatacatatagacactactgtatctatacatgtgtatatatacatacatatgtatgtaaaagtatgtgtatacatgcacacacacacacacctgtgtgtacaggtgtgtatacaccacatacatataccaagaagtctgaagtagtgacagagactgaagccagtgtctaccttgaaatccacctctaccacctaccagtcatatgagcttgggcaaatcacttaacatttttgtgaacataataatagtacataataatagaacataataatagtaccacttactgcaatagtcctgtcccagttaaaaaataaataaatagaaaaaaagtagcacttagtaggtatgttataaatattaaattaatatctataaagtgctaacaacagtaacacataagagctatataaacatcagctattatttttgctatcattattattatctgtatatacaactctgtgtggtgtgtgtgtgtgtgtgtgtgttgtatatagtgatctctcaggatcttgcccaccagaagcagctgatgctcatctccatctcctcctctactctgggacctctgctccatctccctcctcctcccatttgcaggttcaagttagccaagtagggattaagttctgttccaatcagaatcacagtaaatctttagacctgaggcaggagctgtttttaagcaagcatcgtgtctgctctcttgcctgttttgcctccctccatcgatccctggagagctccagttaaggagtatggccctggatgtttggctacctatcctggtcccccacagagcctctgagctcctctggttgtctcttgtctattggtttctgactgatgatccctgttcagagtgtgtgtccaaatctctggaccttgaccccatgaccttgctttggcttggaatcctgaatgatgattttgctctggaccctccccagttcctatccattttttactgcactcccagttcccttcatctgtgatactttccctgaaatctataactataatgaccatttaacctggattttccagagagagtcaactttaaatattttgtccttttgactctaatgttttggcatgcaaagtatactgcccagaaaattgttaatgacgaaaagaaatacaaaattccctgaatttttaaattcacaaaatacagtcatttaaaaagatttctctaaccttctaatttccagtactgaagtgatgaccaattctaaaccagtgcccaggccctactactctaacaagctgcaccatattacatgatagaggtgatttggaaagaaggcaaagttcagaggaggacccagaaatctccttgccccagttttcaaattaatggcagatttctgccacacatccacacattccattcttatttttaaatattattttactgtatttgtgtatgcatattgtaatcatctgatatttgttgtcatttcattatgatggaaactaacaacttgagccactgttttccttcattccatctcttagtcaccatgtgtatattagcacctgtctatttaaagctttatcataaggcatgttctggtaagcacccctctaaattgaagagtgactaaatttttgcaaaatccaaaatgagtggtttgagctaggttactcccactctatatccaactgactcaatctctgctggcagcttttctgcttctccaggcattcaaaagcaaattctagaaagtagtccctctgaaaaaactttaaaatccccatttcctgggctggatgtggtggctgacacctctaattccagctctttgggaggtcaaggtgggcagattgtgaggtcaggagttcgagaccagcctggccaacatggtgaaaccctgtctctactaaaaatacgaaaattagccgggcatggtgacacacgcctgtaatcctagctacttgggaggctgaggcaggagaattgcttgaacccgagaggcagaggttgcagtgagccgagatcgtgccattgtactccagcctgggcaacagagcgagactctgtctggggggaaaaaaagccacatttccatgagagctctaaacaacaattatttctctaaagtaatgtcttctgctgaaagggaaaagcattctaacatcatttgctgtatatggttgtatgggtgctggtgttgttggggggcagggtggagaaaaaaggggagggtcacaatcaaaatcctcttttctttggaaactcctacataagcaaccctcttgcccctctctttttagaactgactcagtctagcggtttaaataaaaactctatctcttccacctaatcccctttactaaaaaaaaaaaaaagagagagagagagagagaaaggtagaattaggtaacaagagacttagagacaggaggcctgaattttaaaccagctcattcactaactctctttacaaaggtttttaacttgagcttgatggacccccccaaaggagtctagagacagaattcagggtgtgcatgaacttggaaggaaagtaaaattacattattttcactgacctctaatttaaatttagcatttccttcaggatctcccccaatctctgccctatctttcacctcttcctatgtgtaggcttagattggcacatggttcttcaattattaatgtagacaagaaatcataaagtattagcagtccttatgactttcaccagtggaaatcacagacttttttttattgctttcacatttgttgcagatatctaaaacatcacatatactaattacacttcaaaattatggtagttaatagatctactgctataccttataatttaatgtgttaattaaaaaaggaacaacatcatgtcctttgcagggacatagatggagctggaagccattatcctcagcaaactaacacaggaaaagaaaaccaaacaccgcatgttctcacttctaagtgggaactgaacaatgagaacacatggacacaggaaggggaacaacacatgctggggcctgtacgaggggaaaggaagggagagcatcaggataaatagctaatgcaagcaaggcttagtacctaggtgatgggttgataggtgcagccaaccaccatggcacacatttacctatgtaacaaacttgcacgtcctgcacgtgtatcctggtacttaaattaaattaaattttaaaaataaaataattaaacaatcacatgtatcactatatcccaaatttgtttttaatattttgataactgcatttcaatagaattggtttgctttggattcttatgtgttttattttttaaaacatctttattgagatacaagtcataaaattctccacttaaagtatacaatccactggctctaatcacagaattatgcaatcttcactataatctaagtttacagcattttttatcaccacagaaagaaacccattagctgttactctctactccactccatcttctggacttcaggacttcagttctttttaatgccaaataatattccattgtttggatttaccatattttgtttatcaatgttgatgcacgtttaggttgtttccccttcttagctattatgaataatgctgctatgaacattcatgtacaagtttttgggtggatatatgttttcaattctcttgggttattacctagaaatagaattgctgagtcatatggtaactctacattcaaacttttgaagaactgcgtgactgttttcctaagtgattacaccattttatgttactactggcagtggtttgagggtttcaatttctcaatatcctctccaacccctgtgattacgtatcttttttattgtagccatcttagtaagtataaagtggtatttcattgtagttttggtttatatttccctaatgattaatgatgttgaacatcttctatgggcttattggccatttgtatatctccttttagagaaatatctatttaataaataaaaccttagcccattctttaattgggttgtctttttattattgaactgtgagagttcttaatatattctggatataattccttaacagatgtatgatttgcaatttttttttccattctgtgggctgcctttccactttcctgatgatattatttgcaacacaaaagttattaatttaccggccgggcacggtagctcacgcctgtaatcccagcactttgagaggccaaggcgggcgggttgcttgagctcaggggtttgtgaccagcctgggcagcaaacatggcaaaaccttgtctccgcaaaaaatacgaaaattagccgggcttggtgttgtgcgcctgtggtcccagctactcaggagactgagttgggaggatcgcttgagcccaggaggtcgaggcagtgattgtgccactgcactccagcttggatgacagagcaagatcgtgtctcaaaaaagaaaaagttttattttgaggtagtacaagttattatattttcttttgttgcttgagcttttgatgtcatatttaagaagttactgcctatgtgagggttgtacaactctgtgaatatgccgaaaacttttggcataagaacactttaaatgagtgaactgtatagtacaataagtcctcaatgttgtcagtaggttcttggaaactatgactttaagcaaaaggacatataacagaaccaatatttttttctcatcattataataaaatgaagttgaactaaacagtcttattcaaggacctgatgtacattgtttcacttaaagttgcagtttccaaatacctggtaaggactttaagtgaggacttactgtatgtaaattaatttcaataaagctgttttttataaaagccaaaatggcagaaggacagagaaaaatgcagaccttggtgttattatattatttgactttctctgtacacaagccaataaatcctccttattgtttaaaaaaaaaaaagaaaccaaatcaagttttaaaattagatcatggtgatagttgcacaattctgtaaatatactaaaaccaccgaatcatgtatgctttacatgaatgaattttatggttatatgagttatatttcaataaagctatctttcaaaagacaaaagaagccactgccaaatccacagtcttaagatttactcctgttttcttaagaaactgtgtcttgctatgtagtccagactggatttgaactcctgggctcaaaggatcttctcccttcagcctccagagtagctggaactacaggcacataccactgcacctggctccattttgagttaatttttgaaatttggtgcaaggaaaggtccagcctcatgtactttattttatgctcttaaaaaccttattctggcagggcacagtggctcacgcttgtaatcccagcactttgggaggccaaggtgggtggattgcctaaactcaggagttcaaaaccagcctgggtaacagggtgaaaattagctgggtgtggtggcgggcacctataatcccagctactcgggaggctgaagcaggagaatcactcgaacctgggaggcggaggttacagtgagccgagatcttgccgcggcactccagcctgggagacagagctagactccgtctcaagaaagaaagaaaaaaatcattctgagaaggaatccattagcttcgccaacctgcaaagatggtttctggcacagaaaaagtgaagaactcttgctctagaattggaactatatatccttacttctctggaactcaggttcctgccctgtaaaatttaataggtaggattgaattgggaagtcccttccagccctgtggtgccatttattgtgcagacattgtaggtggagggcaatgactctttaataaaacacctcaggtttatgacaccagctgcttctgttatttttcttccaaaggaagccattgtctggcaatcatgggagggctcagccagagctttgtgaaatgttttagggggtagaggtgacacaataggggaaggaaacattttctattgaaaagcagtcaattgccttcaacaagttgccaacaaactggaaagttgttgggtttttttttccctgcttacagctgaatgccagcctttgaaaggtaaatagagtggtttagatgaatgggttacagatgcccccaaatgagggagaagattgtttgtacaaaattagcaggaggaaggatgccaagcatgtaactgagccatcatcattaacatcatgaaaggggaacaaaaatcaggaaaatacaatcaaatctttgcttttacaattgtaaaggtacttccacaattttataatttttattctgtaatatttacttttttaaaagttttaaccatggtatagagaatttttaatatagaattgttgggtctttttcaaaattaagtaattatagtttgcattttaaaaagctttagctattagctgtaatagctaaagctatatacaatagctgtagctataaactatttgatcattgtatgcgttataattttgcctggaatctaatcttacacagtggaaatactgataatgctcattataaaaaagcggcaatatatttgcaaaagctccattaaatatggactttcaaaaagactataggatatctgcagaaaggctagcatattcttccaaggtttataaactatccgccctgatgcatagaccatgctaaattctccatgtgtttgcaaattttccatgccatgtgttggtatcctttgaaattaacagtcctactcccttatcaagaaggaggggaactcctaagaggctcagacttgcacttttctctccctagtgcctctttctccagcttttctgccttccaaaaggtatcaagaatgtgggggaaaagagtgtgggcagtggggaagcagagtcaaggctccagagccctgccaattagttaaaggtcagcacggaagggactgtctgtgagaggacaagaaagctgaacttctcttgagccaactcaactggatggcagccaatctctatctctttcctgggccagagcagagctcccccagttctgtgtgcgcctgcacaaagacgaatatgttctgtacaaatagggtctagttttaccttaggtgaatagactgagcctgggggtcaagggacagaggacagagaggaccaaactggtgtttgctgcgtcagaagcatacaggcttatttggaaagactgaaactaaataaagacttcttattagcataggactagagttgtgaaatctggtcaaagggttttatgcaaggatgccttttatatattctcatgttaatgtggaaaagtagaaaaatacaacattttaattaggggagaaaactattgttatatataactttagaacatttttctttttttaaaaattatgctttaagttctagggtacatgttcacaacgtgcaggtttgttacatatgtatacatgtgctatgttggtgtactgcacccattaactcgtcatttacattagatatatctccgaatgctatccctccctcctccccccaccccacaacaggccctggtgtgtgatgttccccttcctgtgtccaagtgttaactttataacatttttcataccaggaacttttttttcttttacactagaacatgggagtgatactcccaagtttttgtcccccatcccaaaatgacaggggaagtaaaattcttttcacaaaaagtgtaccttttttaaaaagaacagtaagccagcattagatgacttattctaaaacaatcttcttctttaactgggcttttctgcagattttctaagaggaaaagttgatgtttaactccacatgttccttttttacgttcacaattttttttcacatttcctttctgataggagtagtattttattgttgtgtgaaaacccaattgcaatccatcaggtatcagcttttagtaaggtagtatgtgtagaactgaaaaacagacatttacctccagaaatgaagggcttttttgatctttctgcatttaggcgatctcagtttattttctggaagtgtgcgctgaaccataagcaatatcgtatctctcctgaggacgtaatgtttcctaaaagcctgtctagttcactgtgtttttcagagggaaaaatcctgaggactggatccaactgggaggagtgtcacccagggtggcctgagacaacgtagctggatggagagttccagttttcatcatcttagttgcaaaaagacaaggtcacccacagaaggcaactttgtgcatttgtgggccaggcaaatgcagagagcaagtagggaagctgaaaacaagggagtgaagatctgaacagagctgggtgggtagagagggtcaagggaaacatttcagttctgaagccacaaatggaaaccctgtgccagagtgccccttttatgttagtggtggagagaggttcctgctgcttagagtagtcacgcagcactacaggctaaatgctgcaaatctatagtgatatcaggtctatttttattctctcatttatatgtttcctttttatcttagccatataggatttttttatcctttatcttcctcctgtgggtcctgttgttgttttttttttctttgtttgtttgtttgagacggagtctcgctctgtcacccaggctggagtgcagtggcgcaatctcggctcactgcaagctccacctcccaggttcacgccattctcctgcctcagcctcctgagtagctgggactataggcgcctgccaccacgcccggctaattctgtttttgtatttttagtagagacggggtttcaccatgttagccaggatggtctccatctcctgacttcgtgatccgcccgtctcgccctcccaaagtgctgggattacaggcgtgagccaccgcacccggcccgtgggtcctgttcttaagctccactctttataactctagtttgttttggtttttaaaattatttttttcttcctttttttcctttaagagctttctaaaagctggcactttggtagatttcttttttttctttgttcacgtagtctgatctggaagccaggactttatgttggcctggatttgtcaggtctctaatcaactctgtgtaaagtggaatagcttggcaacaggcataataataataattaaaaataacagtgactgcagaactaagacatgagattcaaaaataagggggaaagtgacacagagtcataggctttcatctgaaaatatctcattccggccaactgagaagcacccttgcaaatcagttagaatatctctctgtgtagaaaaggaaagccagagagaaatgttgccttcaagtgtagtttgcctgtgtattaccttctgttgaaattcccacagacaaataagcctttgagaacccataagaaaacaatggctgccactagtaagatttccaaaggtacttttaaaacatggagtagatttgtttttctgtcccaacgacttcagagaagttcccacttaaatccatgcatggtcattttatatctgccattacatattcttgtttgctaaatgtaagtcttgtcaatgagttattttaaaaagtactttttgaaattacgcacaccccaaacaacagaactgctgtgtgtatacaaatgctctggaaaggcagaagtcaggtactgggtgtaggcacaggacagaccgcatggtctgccttggcagccctgtcctcacctgcaagctgcccacacacactcccttccaaacggtgctccctctgatgccacttggctgactgagctactgtgggaggaagcctgtgaaggggttggtggtagtgatgtgaataaatattttataaactaaacttcaagtataaaacttgatttaccctttcaaccaaattcacatgggaagtcccacttcttcttaaaaatcttggacattcaagagttaagggatatggaagctggcgtagcatggggctgtcatccaagaccagctgaaaaggcagcaggaagggtttggttctggctaggctacagacaggccatctggatgcagggaaggcctagaatgccagaagcagcttttctttttgattttagacttcatcgagtccagcctgggaaaagtctttagtttaagacccaaaccgagagtcttctttaaacagggattcaatatttgaattttatataaaacaaacatccactacacgtattctttttggcaaagaaggttggagacagcaatgtacacacaattaaacatacttagaaaaaaatgtagaccagattcactagacttataaatacataggaactatgtgtagtttttaagtaattttgctaggaataaatattgaaagattgcctgaaaaaaaatttttttatattataccccctcagttacttttatgaataattatttcgttgtttttcccatagttcacattaaaaagcaattttaggccaggcgcggtggctcacacttgtaatcccagcactttgggagtccgaggcaggcggatcacttgaggccaggagttcgagaccagcctggccaacatggcaaaaccccatctctactaaaaatacaaaagttagccaggtgtggcagtgcacatctgtaatttcagctactggggaggctgaggcatgagaatcacttgaacctgggagatggaagttgcagggagctgagatcatggcactgcactccagcctgggtgacaaagtgatactctgtctaaaaaaaaaaaaaaaagggtaattttaccacattaaaattgcctttaggtctttaaaataattttccttctctatttttattttatatttaataatgttatatttataattaatcacattaggcatgatgttagcatgggccaggaaatttttctttagtgaaactgaaaaaaaaaaaaaaccctgcagggaagttatagcaacttcctactctgtatcattcatgaacatacactcagtttggaaaccaccctctttaaaagatatgatctattcttccttagttattgcagtatgcgtttgatttgtatgtgttattcttaacaattaaaggaaaaggtgaatgtaaattcacttggacaaaacaggaataaaagaatattatccttaagggaagtcttaccttaaagaagagaaaatgcacgtatttttctgggcgagggtggtggggtcagggaggaagaattgttttttctaaataaggcattaatcgccacctagcagtagaggaaggaactgcgcacttagtttgccactgaaattctagaaaacattagttttaaaggacatattacttttattgtaaacaatatcttaggaattattggtctattggcagactaaggattgaattttttctctcttgtcttgaggaaagataaagaaataaaacaaatgaaaatatttggcctatttgtaagcatactccttccatcataaaatgtctgttctcttgttgccgttgccactccagcaacaagctaaaggaaaagaaattctgaagccatcatgacacgaaaaaatgttgcctttggcagggcgcggtggctcacgcctgtaatcccagcacttcgggaggccgaggcgggcggatcacgaggtcaggagattgagaccatcctggctaacacagtgaaaccccatctctactaaaaatagaaaaacaaaattagcctggcgtggtggcgggcgcctgtagtcccagctactcgggaggctgaggcaggagaatggcatgaactcaggaggcggagcttgcgataagccgagatcgtgccactgcactccagcctgggcgacagagcgagactccgtctcaaaaataaaaataaaaaaaaatttttttaaatgctgcctttgtcctattagaggaagaaatatctgagtttttttgtttgtttttctgtttgtttgttttttggagtcggagtctcgctctttcgcccaggctggagtgcagtggcaagatctctgctcactgcaacctccacctcccgggttcaagcgattctcttgcctcagcctcctgagtagttgggattacaggcgctcaccaccaagcccggctaatgtttgtatttttagtaaagacggggtttcgccatgttggtcaggctggtttcgaattcttgaccgcaggtgatccgcccccctcggcctcccaaagtgctgggattacaggcgtgagccacctcgcgcggcctaagagaggtttattttgaaaatgagaagacattggccgggattagtaataacagttattattgttagtaataatgcttagtatatagtaaggtgatcaacaaatattttttgaaggaatgagaaatgtctggctccaaaacctgtgcttttcactattaccttctatgcatatatattggtggctgaaagtgcttggctggacacttcagagtggctcttatataaaagccctacttgtggaccaacaaaagagatatttggtttcttggggttttaatggctttcaactcctcgaagcatgatttggggatttggatcaggatacaccctgattcttaaccagtatttgcaaaattgatcaatagaggtatcttgcaggaagaatggaacagaaaaacaacactaattctccaatttaaagaccattattagttatttcaggattttttagaataaaaaaaatccaaataaaagccaaactgaaattttcccatgaatggccgggtggggtggctcatgcctgtaatcccagcactttgggaggccgaggtgggcgcatcacctgagatcgggagttcgagaccagcctgaccaaaatggagaaacccccgtctctactaaaaatacaaaaattagccgggtgtggtggcgcatgcttgtaatcccagctactcgggaagctgaggcaggagaacctcttgaaccctggaggcggaggttgcagtgagccgagatcgtgccattgcactctagcctaggcaacaagagcaaaactccgtctcaaaaaaaaaaaaaaaagaaagaaagaaaaagaaattttcccatgaacatgtaagattcattgttactcaactatctagatgacagtctgtaataattgcttaatttctggaaaaaaatatttctaaacaactcaagtgtgccatggcttttgtacaggcctctcttttagtcacacactgagggaggaaaattatattatacagtttagatataactctaaattgttattcttcccaattatgtctattaattccagattgctctattccaagtgttagctgttgccagaaaaaaaaaaaaccttagcttctgaataaccagttaaaaataaaaagcttctaaaataccaggggtttttttgtttgttttttgtttttgtttttcctgagatggagtctcgttctgtcgcccaagctggattgcagtggtgcaatctcggcccactgcaacctctgcctcctgggttcaagcaattctcctgcctcagcctcccgagtagctgggattacaggcgtctgccaccatgcccgctaattttgtatttttagtagagacggggttttgccatgttggccaggctggtcttgaattcctgatctcaggagatctgcctgcctcccaaagtgctgggattacaggcgtgagccaccgcacctggcctcctataagcaggtttgtttgtttttttaatttttttaaatatgcatatgtacacacgatgtatatacatgttacacatattggaaaatatattctcaggatattctcccttctccagatggatagtattgaaagggaaaaaacacagtaattaaaaaaaaaatggtcagcacagtggctcactcctgtagacccagctactctagaggctgaggcaggagagttgcttgagcccaggagtgaactttgatcacaccactgcactccagcctgggcaacagagcaaaagcctgtcctaaaaataaacaaataaattaaaattaaaattttaaaaaggtgggagtgggtgcagataaggctagtttaaagcaagctgtttaaaggctatcaaatattagtcaaataaattatgaaacatttatatgatgtaataccttatagctatacagacatttaaagcatgtgacatgaagaaatgttcgtggtttaatgtttacatagaaaagcaggtttaaaaagaatcatatataatttgatacaaattttttgtggcagtttattttgagatattaatttttattttattttatttatgtatgtatgtatgtatgtatttttgaggcagagttttgctcttgttgcccagtctggagtgcagtggcacaatttcggctcactgcaacctccacctcctgggttcaagtgattctcctgcctcagcttcccaagtagctggggttacagacatgcacctccatgcccggctaattttgtatttttagtagagatggggatttcactattttggtcaggctggtctcaaactcctgacctcaggtgatccaccctcctcagcctcccaaagtgctgggattacaggcatgagccactgcgcccagccttgagatattaattttatgtgttctcctatcctactacccctttctcccattcaagcaagtatctagacttcagatttttgtaaggcaaaaagcaaacactgctcagaaataccataggctctgtcttgtgaaatgagaagagggaggtgaaagagggattcctcaaaagttagaagtctgggccaagctcagtggctcatgcctgtaatcccagcactttgggaggctgagctgggtagatggctcgagcccaggagttcaagacctgcctgggcaacatagtgagaccccgtttctattaaaaaaaaaaaagaaaagaaaagaaaaaagaaaaaaacttagaagtctgaagcctatagtttgagtgaatagctaagattcccatcttgttctgtaacaaagcccagatagtggcaaaacctcaaagaggaaagccacatggggtaccttaggaagctgtacttgggtgcaggggctgccacattcacttacttgattccagattcttgagtaccaacagtggtaaagaaatatgagagtcaccagtctgaagtgaagatggcacaaaagggaatcccagcaccaaatcaatgtggagagatgaccaagtaatttgagataattccaggtacttctataataattcaagccctagaaactttgtacaaccctggatggagaggaaatgctcaatgataactaaggtagaatttctcaccagcatggcaggatgggagctcaggcttagattcaagtggacctaaagaaatgcagtatttatttctatgaaataagaatcatatacacaatatgcatatgtacacacgatgtatatacatgttacacatattggaaaatatattctcaggatattctcccttctctagatggatagtattgaaggggaaaaaacacagtaagtttcactacctagtacaatatagtaatttatcatattgtctttttttagcagctatttttagattttttttaaatttttttttttgagacagagtcttgctctgtcacccaggctggagtacagtggcagatgtcggctcacctgcaacctccacctccttggttcaagcaattcttatgcctcagcctcccaagaagctggggtttcgccatgttggtcaaggtggtctccaactcctgacctcaagtggtctgcccgccttggcctcccagagtgctgggattacaggcatgagccacctagcctggccaatcatattgtctttattgaaaaaaaatcttcaatgtatatccccctttttttttttttttgagacggagtctcgctctgtcacccaggctggagtgcagtggcacaatctcggctcactgcaacctctgcctcccaggttcaagcaattcttctgcctcagcctcccgagtagctgggactacaggcatgtgccactacgccgggctaagttttgtatttttagtagaggtggggtttcaccattttggccaggctgatctcgaactcctgatctcaggagatctgcccgccttggcctcccaaagtgctgggattacaggcgtgagccaccgcacctggcctcccttttttaattagaaaaaatgtatattataaaaccagctgtaagctgtttttcctatatatttgaacaggtcgaaaatagggaagggcatagataataaacttaggttctattttccagctgttttagacctattgatattaacatttccagaagtataatacaaacttaatgtcaaaaaaagatgaggattttttttttttcacagaaaaaagtattggataactcctgtaccctgaaaaaaattaaaatggtattatattagtcagagtctcagcaagaatcagatgcactctccaaaggggtaactgaagagagtataatcagaatgtgggcaggggaacagcaagtggtaatgcagtaccactgccaacctgtggccaacatggagcgggagaaggtaatacataatctgatatctctttcctattgctttctgatctactagtgtcttccattagctgagcccaaccaggagctagagaggaagggatcttactgatgcaatctataaaagattaaagtaccatagaatactatacagccataaaaaatacaggaggctgggcttggtggctcattcctgtaatcccagcactttgggaggtgaagacaggcggatcacttgagctcaggagttcaagaccagcttgggcaacatggcaaagccccatctctacaaaaaatacaaaaattaggtgggtgtggtggcacagaactgtgatcccagctactcaggctgaggtagagggatcacttgaacccaggaggtcgaggctacggtgagctaagttcgcgccattgcactctagcctgggagacagaatgagaccctatctctaaaaccaaaaggaaaacacaaaatcatgtcctttgcagtaacatggatggagctggaggccattatcctaagtgaactaacacaggaacagaaaaccaaataccacatgttctcacttataaatgcgagctgaacattgagtacatatggacacaaagatgggaacaatagaccccagggtcgatttgagtggagggagtggaagaagggcctattgggtactatgctcactatgtgcatgatgaaatcatttgtacaccaaagttcaacaacacgcaatctacccatgtaataaacatgcacatgtaccctctgaatctaaaataaaagttgaaaaaaggaaaaaaaagggtgaagtatatctatagggttatcagagaatatctagcacaatgacaaagtataagcaattccacaattttcctataaatatttccagataaaactatctactagaagagtactagaaacatagagttttagacttcaacttttggtactatgtaaattatttgaaattattgctactactactagagaacttttattcattcactaatttttttttttttttttttgagacggagtcttgacctgtcgcccaagctagagtgcagtggagtgatctcggctcactgcaacctccacctcccaggttcaagcagttctcctgcctcagcctcctaagtagctaggattacaggcgtgcaccaccgcacctggccaatttttgtatttttagtagcgacagggtttcaccatgttggtcaggctggtctcgaactcctgacctcatgatctgcccgtcttggcctcccaaagtgctgggattacgggcatgagccactgcatccagcccactaactcttaactaaattttattgagcatcgagtcagtgtgacacattaaacatatgtacaaagataaatatgaaacattatcctccagcggctcctgatttaatgtgaggacaacatatgaacaaataagtgcaattaagctttatatgtgtagttgcattttaaaagggactctttctgtctcagtttggctgaggctccaagaaagtaaaatgccaatattctcgtattttataataaagtggaaaaccataaaaagtagaaattgcccaaaaaaggtggcaggagtggaaagggaactgtttttgcaactcttagctgtccatctacttctaattcagagactggagtttagaagattttgagagtttttggtgtgctgtgagtggacattgctttttcctcacctcacacctagggaaagaggctttaatgaaactttgatatatgatccctacacctagcaggggggtagggcaggggttgaggtcacagtggactagtgtctgactcatatctgaggaattcattcattcaatacttaatgtagcacttattaagtacaggcactgtattcgcctattctaggtataggcaaatgcagtggtgagcaaaatagataaaaattccccgcttcatggagctaacattctagtggatgagagcaagaaattttggctaattgcaaaaatgagtttgggatatggtcaaagtctgcactctcagaggcaaagccactctgtaggtatttggattagaccagggctacgagaaaggttcacaaagaaggatgagacttccacagaaaaaaagctgggagtgtagctatacatgctagctattaatattgagctgatagccagatgaaatatatttacccaagggtaagcacaagattaccagtattttctcattgggctaaggtgagagttaaggtgttaccaaagaacgcacgcataaagttacaagtgtcaactgtaaacatctgccaagctcaaagagtaccagcccttaatcacagaactgtagtagccaagttaagaatgttcttgcctgttcctctgtttgaacttgaaagaaggaaggaaacctggagttggtggtgatgatgggagttggggtgggggcagatgtggtggcgattaggagagaaattttagacagggacatagaagggaagtcaaacattttttacttgaacaaccagaaaactcatgagatttgtatcttattttattcaatgagcatgggaggattaactccaccaggtgtgttttaacatgtggagtgaaaataagttacttacaaattgcaccctatacatctatttgttcaatgtaccagttataggtgctaaacataataacacggtaagatttacacatccatgaaaaaaattttcaacttggctcttatttagaatttacttttatttgattcttttaaaagcctaacataacttaccaattacctttaattttttttttttttttttttgagacagggtctttgtcacccaggctgatcatagttcattgcaaacttgaactcctgggtgtctcatgtgtccgtgtgaagagaacaccaaacaggctttgtgtgagcaacatggctgtttatttcacctgggtgcaggcgggctgagtccgaaaagagagtcagcaacgggtggtggattatcattaattagttcttaaagattttgggataggcagtggagttaagagcaatgttttaggggcagggggtggatctcacaaagtacattctcaagggtggggagaattacaaagaaccttcttaagggtgggggagattacaaagtacattgatcagttaggttggggcagaaataaatcaatggtggaacttcgtcagttaaggctattttcacttcttttgtggatcttcagttgcttcaggccatctggatgtatacgtgcaggtcactggggatatgatggcttagcttgggctcagaggcctgaccttcctgtcttcttatattaataagaaaaataaaacaaaatagtggtaaagagttggggcagcgaaaatttttgggggtggtatggagagataatgggcgatgtttcttagggctgattcaagcgggattggggcagcgtgggaacctacagtgggagagattcaactgaagaaagattttggggtaaggggtgatattgtggggttgttagaagaagcatttgtcatatagtattggtgatggcctggatgtggttttatatgaattgagaaactaaacaaaagacacaaggtccgaataaaagaaggagaaaaataggtattaaaggactaagaattgggagtactcaggatgtccaattagagagtgtccaagggggttcaacgttattgtttgcttggctggcgagtttttgggctctatccttgagtttttttatgttgtcatataccaggccagattgatttaggtaaaaatagcactcttcatttaaaaatatacagagtttccctccccctttttttttttagtagtaagtcgaggcctcagcgattttggaggaaagagaaatgcaaagccagcaattgtttgttaaagaaggattagaaacagctaggagggagtgactgagattgatagtgtggtggagatagctgggagaggtagagggtggcataagattgggaacaagaataagagtaagtataaaagtaaagaataggacttcatcagggtgaaagtattgaagtgtactttgtcactgaagatcttctatccacttaaagagagacttaagggtggcagtttgaggtaaaaccaggtgccactgaataccaagagcctgagaaactgaggtgggaaggccaaactgaggaattatgtctgacagaagggatgaaatgaccgcggtggccttctcagaccctgtgggaaaggcctctacccagccagtgaaagtgtctacgcagaccaagaggtattttagtttcctgactcgaggcatgtgagtaaagtcaatttgccagtcctgggcgggggcaaatccccgagcttgatgtgtagggaagggaaggggcctgaacaatccctgaggagtagtagaatagcagatggaacactgaaaagtgatttccctaaggatagatttccatgttggaaaggaaatgagaggttctaagaggcaggctagcagcttgcaacctacatggaagaggttatgaaatgatgatagaatagaatgggcctgtgaggctggaaggaggtattttccttggcccaagaaccatttgccttgtttgggaagagattgataggtggaagtttcagtggggcagtaggtgggagtgactgatgagaaggagaaaaactggccatgagggacagaagttggaattctagctgcttctttagctaccttatcagcataagcgttgccctgagtgatggaatctgatgccttttggtggcccttgcagtgtatgactccagcttcctttggaagtaaagcggccttgagaagagtttttattaaagaggcattaatgatggaggaccttgtgtagtgaggaaacctctttcagcccatataacagcgtggtgatgcaagatatggaaggcatattaagagtcagtataaatattgacgcgtagtccctttgcaaaggtgagggctcgagttaaggcaatgagttaggcttgctgagagatagtggaggggggcagagtggtagcctcagtgatagatgtggaagatactatagcatagcctgcctttgctggtgagtggcgattaggcctggtggaactgccatcaataagccaagtgtgatcagggtgaggaacaggaaagaaggaaacatgggaaaatggagtgaatgtcaggtgcatcagagagatacagtcatgggggtcaggtgtggtatccagaataatgtgggaggccagattgaagtccaggccaggaacaatggtaattgtgggagactcaacaaagagtgagtacagctgaaggatctggggagcagaaagtatatgcgtcaggtgtgaggaagaaaatagattttggaaattatgagagctgtagagagtgagttgagcatagtttgtgattttgagggcctctaaaagtattagggcagcggcagccactgcacggagacatgatggccagcctaaaacagtaaggtcaagttgtttggacaaaaaggctatagggtgcggtcccggtccttgtgtaagaattctgactgcacagccctgcactttggctgtgtgtaatgaaaagggttgggatgagtcagggagagctagtgtgggggcagtcactaaagctgtcttcgaggaacagaaagaggactggggaaaggatttaggatctatgggatcagctaggtttccttttgtgagtttatataatggttttgttaggatggcaaaaccaggtatccaaaggcgaaagtatccaaccatgcctggaaggaaaggagttgtcgttttgtaggtgttggggtttgagagatcagttggacacagtcggcagggagagcacgtgtgtttttatgaagagttatgctgaggtaggtaacggatggagaagaaatttgagctttggagggggatacccgatatcctttggagaataaatgttgaaggagcaggagggtgtcttgttgagaagattcaaaggaggggctacaaagtagaaggtcatcaatatattgaataaggtgagaagcagaagggtggaaagaaagtaaatcaagggaaagagcttggctgaagtaatgagggctgtccctgaagccttgcggcagcacagcccaggtaagctgctgggactgatgggtgtcagggtcagtccaggtaaaagcaaagagaggctgggacaaggggtccaggggaatagtgaaaaaagcatctttaagatcaagaaccgaatagtgagttgtggaggaaggtattgaggacaaaagagtgtacgggttgcgcactacagggtggataggcaaaacaatttggttgataaggcacagatcctgaactaacctgtaagacttgtctggtttttggacaagtaaaatgggggaattgtaaggagagtttataggttttagaagcccatgctgtaacaggcaactgataacaggctttaatcctttaaaagcgtgctgtgggatgggatattggcgttgagcggggtaagggtgattagatttttatgggatggtaaggggtgcatgatcggtcgccaaggagggagtagaggtgtcctatacttgtgaattaaggtagggagatacaaggagaggatgtgaaggaggctttgaactggggcaaaaggtggcaataaggtgtggctgtagtccaggaataatcagggaagcagataatttggttaaaatgtcttggcttaataaggaaagtgggcagttggggataactaaaaagagtgcataaaggaatgttgtccaagttggcaccagagtgggggagttttaaggggtttagaagcctggccgtcaatacccacaacagttatggaggcaagggaaacaggcccttgaaaagaaggtaatgaggggtgggtagcctccctattgattaagaaggagacggacttaccctccactgtaagtgtgatggtccaggaggcttccgagaagattgggcagtgtcagtcttcagccgctaagccgagatctgggaaggagtcagtcagagccttggaccagagttccaggggctctgggagtggctgccaggcaagttggatagtctgatttccagtgggctcccgatttaaaatcggtgagatgttccttgggctggttggtctgaggacccgaggtcataggtggatctcttcacagagtgagggtgaggacagcggactggtctcccaaaggagtccgctgacccgggtcttcggcaccaaatgtcttacgtgtccgtgtgaagagactaccaaacaggctttgtgtgagcaacatggctgtttatttcacctgggtgcagacgggctgagtccaaaaagagagtcagcaacgggtggtggattatcattattagttcttagaggttttgggataggcagtggagttaagagcaatgttttgggggcagggggtggatctcacaaagtacattctcaagggtggggagaattacaaagaaccttcttaagggtgggggagattacaaagtacattgatcagttaggttggggcagaaataaatcaatggtggaacttcgtcagttaaggctattttcacttcttttgtgaatcttcagttgcttcaggccatctggatgtatacgtgcaggtcactggggatatgatggcttagcttgagctcagaggcctgacactgggctcatgtgatcctgtcacctcagcctctcgagtagctgggactacaggtgcatacaactacacctggctaattttctttccttcctttcttcctccctctctctctccctcccttcatttttttttttttttttttttttttttttgagacagggtcttgctatgttgctcaggctggtaactcctggccctaagcaattctcctgcattagcaggagaaaaaaaagtgtcgggattacaggtgtgagccactttgcctggcttccaatgacctttaaagaagtagtactatgttcgctgacctagtcttcctacaaaatatctttattgatcagtttttcagcttctgattaatgctcaagatgtatcttgaggccgggcatggtagctcatgcctataatcccagcactttgggaggcccaggcaggaggatagcttgagtccaggagtttgagaccaacctgggcaacaaagtaagaccttgtctctacaaaaaaaataaaattatctgggcatgggggtacttgcctgtagtcccagctacttgggaggctgaggtaggaggatcacttgggcccaggaggtccaggctgaagtgattgtgccattgcactccagcctgggcaacagagaaataccctgtcttaaaaaaaaaaaaaaaaaatgtatcctgagagctgaggagctgagtatggtggctcactcctgtaatttcagcactttgggaggccaaggagggaggatcactttaaggccaggcattcatgaccagcctgggcaacatagtaggaccctgtctctacaaaaaattttaaaattagccaggtatggtggtgtgcacctgtagccctagctacttgggaggctgaggcaataggatggcttgagcccaggagttcaaggttacagtgagctatgatcatgccactgtactctagcctgggctacacagctagactctgtctctaaaaaaaaagttgttgttgttgttgtttttaacgatgtatcttgagccaaatccccaaaacacacaaagaggagctgaaaatcatataaacctttaataagcccttgggactttcattcttaacaaaaaggtcaaccaaatgccccttcttttggtctacaagtagagctttgataacagccattctgaagagtacagacaattgctgtgaataaaggatgtatcgcaaagccccagatatttgcttaggaaataattatcagaaggacaggtttggagtgatagatctatcactcattcattcaacaaatgtttagtgagtgcctactatatgccaggctttgtttcaggtactaggaatatctcagtaaatttttaaaaagtcaaaaaattatgtttggatatttatgtgattccctgttgcatatttacaatgtgtgcttcaacttttatttaaactagattcagtgggtttcttttatttgtatccaaaaggccctttctataaaagtgacacagtaataagaggttaccatccctaattacaggaagctcctacaagtcagtaagaaaatgattaacacaataatatgaggaaaggaatgaagtggcaatccactaaagtaacataaacagccaagaaatacaacaaaagatttttttactagtaataaaaaactataaataaaattaaaaattaaagaaacaggttttcttttttggcctatcaaattgataaaagtaaaaagtacttataatatccagtgttggtaagaatacagagaaaactgactctcaggcagcgtagaatattaaatggatataactttttttgcaactcagccatatttatcataactgtaaatgtaagttccctttgaccccacaattctacttctatgaattcttcatcaggtaaggtaattatgcacacaataggtgtgtatgtacaagaatattcattatagtatttttatgataccaataacttggaaacaattgaattgcacactaataattaagcaaattattatatttccatacaataaaatactatgcgactattgaaaataatatagaccattacttatggacatatgatagctataactttttaagtgtattaataaaaacagtatcatcttatttttaaaaattgtatatttattacacatctgtgtgaggcatgtgactagagagatatatatggaaagaattttcaaaatgtttatgtagtatatgacaatttttaaatgagcatttatttaatcagttagcactatttataaacacttaatatgtgctacgcattgtgctaggtcctggagaaacgaaagagaacaatctattaatttaatctgttaatttagtccaccaaatcaacagtgtttttcagaaatacgacaataaccagtgttgatgaattagagaaggtaacctcatatactactgttgagagtatatgttggtaaaacatttctggagaacaatttagtactttgttttttgtttttttttttttgagatggagtcgcactctgtcgcccaggctggagtgcagtggcacgatctcagctcactgcaacctccgcctcccgggttcaagcgattctcctgcctcagcctcctgaggcacgccaccacgcccggctaatttttgtatttttagtagagacggggttttaccatgttggccaggatggtccgatctcctgacctcgtgatccacccgcctctgccttccaaagtgttgggattacaagcgtgagccaccgcgcccggctttttttttttttgaaacagaatctctattgcccaggcgggctggagtgcaacggcgcgaccatggctcactgcaacctcgatctccctggctcaagagatcctcccacatcagcttcccgagtggctgggaccacaggcccatgccaacatgcccagccttttttttttattattcttattcttattcttattcttattattattgtagcgacgaggtcccactgtattaaaataatatagtgatctcaaactcctgggttcaagcgatcctccgccctcggcctccaatagcgctgggattacaggcgtgagccaccacacccagtctcttttttacaaagaatataaatagccggtggatgtcagactatttcgttatggaaagatgctctcaaaagacgaaatagataaatcgaaagaaagtgtccattttttctcagtggcctaatctgtcaggtaccatgcttggttttgggggcatagaaagacattagcgccctcatggagttcaaagtctggtggaagaaatcaatcataataacaatgaggggttaacgacaacagacccttgaaagataacatctccagggaataaggaagagcattccaaagtattttgccaaatggcaaaaaccgcagttacttttgcaccaaccttaatgcaaataaaagcatgtacacaaacaagatactcgaggaagaatacagctgacacacagaaacggatcgttatcttgtggctttcctgcagcctcgttcctttcagtcacataacaccccaaatctgtggacggttaatgagagctagtatcacccagagtcacggctgttgactcggacgactttagatgcagcccgccagcgggagaaactggagggaatccgccatacacaggaacctagaagggctacgtgacaggggctgccccgcagctctcagccgccggcactcccagccaggttttcccgccagtctcagttcctagatcttccgaggctccgcccgccgccgagcggtcggaaagttttaaggagggggaagtgttgcaagcctatcgatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatggtacgttgaatcccgatctctggaaggtttagggcagagctctggtgactgggggatgacgagccacctctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcggtccagaatagctcctagtgctgtgtatgggagaggagaagacagagacttgacttggaggcctacctgtaccaccagtgcggacttgacccccaggtttgtgttcctggacagcgtccgttttcctggtgggtccgtctatttatctctcgcctagacttcgattagaagaggcccttttcaatcattttgtccagtcacctagttgcggatgagtaagccgaggctgagaggggaagtgatggaatcagggttacaatatagggttctgggtttccagttctgtctgccattctagcactcaatctcactcccatgactattattataatagtcgtaatagccgtaatggttctatcgctgcagctatttgtgtccacctctaactttgtgaggacatttttgttcattcaatgtgaatatacagacagcacttgtacaggcataactacagtgaacattaaaaaataagtcatacatgtccctaatcataaaaacagaaagggacgtttagataaagagctgtgggagtatatgttagggggatttgggaagaaaaggagaagacttcaagaaatcgacatttaagctaccttaaagaaaaggaagacttttaaccatttattagggcccaataaaagggagcagcataagcaaaaataggcaagaaagttgattgtgaactttagtaattgagcctaaaggggttgatatggagggtgttagaataagagtttggaaaaataggacccatttagatctgcttctccctctcccacgagtttatggtaaatgtagaattggcttacatctgagtacagtagtaatcttccagtaagactgcatgaacagagtgccttaacattgaatggaaatacaagcatatttcttaatgaatgttaagagttgggatttgaaatgttcttctattaacaggtatttttttcttttacttttagtttcgaaatcagtatgacaatgatgtcactgtttggagcccccaggtaaaataatgtttttaaaccttttctgtgaagtggctttttgtggctgcaatatatttagaaacttgtgagagcgtaggcttggggaaaatggaatataattattttagacgttcttggaagttgcatttataattaaaataggtttcctgatggacctagaggacattatgttaagtgaaataagccagaaacagaaagaaaaatgtttcatgctctcacttatatgtggaatcttttgtttaaaagggcaaatatatatatagagagagtaaaacagtggttaccagggtagggggtggcagtggggaggaaaaaagaggagatacaaagtagcaaatatgtaggttgagcaagtggaaagatctaatgtacaacatgaagactacagttaataatgcaggtagtgttttgtattcaagatttttgttaaatgagtagtttatagcccttgccacagcagaggaaaatgggtaactatgtgagacaacggatgtgttcattctgcgatagtgaccctactatatatgtgtatcttataacatcatgttgcatacgttaaatatacacaagaaaatttattttaaaagaagctttcagccgggtgcagtggctcatgcctgtaatcccagcactttgggaggccaaggaaggtagattgcttgagtcttggagttcaagaccaccctgaacaacatgaaacccggactctacaagaaatacaaaaattagctgggcgtggtggtgcttgcctatagtcccagctactgtggacagtgaggtgagaggactgcttgagcctaggaggcagaggttgtactgagctgaagattgtgccactgcactccagcctgggtgacagagtgagaacctgtctcaaaaaaaaaaaaaggtctcttgattaaaaaaaaaatcagttgagatttaactgtgctcacctgatatttgaaaaccctaatttttaatttataaaagatcttctaagatgtgtgttttttgttttttttttctttagggcaggattcatcaaattgaatatgcaatggaagctgttaaacaaggttcagccacagttggtctgaaatcaaaaactcatgcagttttggttgcattgaaagtaagtacagtaataaatatgtcttcctctgtagaaaacaatgtaaatttcaccatagaaaataaggttgtaaacttatttttacatttgtctcttttttttttttttttacatcttataatgtctctatttagagggcgcaatcagagcttgcagctcatcagaaaaaaattctccatgttgacaaccatattggtatctcaattgcggggcttactgctgatgctagactgttatggtaagtataatcatgaaaaataaacatcctttttgtttcataattgattagttttctcaaaaagatccagataaggtattttaggaagttgtctgccaaagttcttgtaaattaagattatgaataccttggtggttttgagtttgttattaaattttccattttttgatccctgtaggagtaactaataagattaaacattagcacttttcagaagtcactgagtaatgtgatgtttgttaatacaatgtatatcgtttgagaccctgttatgtctaagaagaacgtgatacttttgtctggtttctaaggacaagctgaaccacacttgttttctttgtgcttgttttcttcaatacatcagtatttattagacatttattttttgcaatgctcaatactggatactgcagggtatacataagtgactcagacatggatcttgtcttaagggaacttgaaggcaagtttatctataaactcaaatgtagtttatctataatataacagaaaaatttctgtgagagtctagaagagacagattatttatggttaaaaggcaatacataaatgaagagatagggctttgaaattgcacatattgagttctcaccttcaccacttagtatctgagatttggctaaatacctaaacactgaattttttccagtgttttctttatcaaggctatttttaaatgttatttatttatttttttgagatggagtctcactctcacccaggctggagtgcagtggtgtgatctcagctcactgcaacctctacctcccaggttcaagcgattctcctgcctcagcctcccgagtagctgggattacaggcacccgccaccacgcctggctaatttttgtatttttagtagagacggggtttcgccatgttggccaggctagtcttgaactcctgacctcaggtaatctgcccacctcagcctcccaaagtgctgggattataggtgtgagccactgcacccagcctatttttaaatattttaaattgcctactgtaaaccactaacacagagcctttcaggtattatgtgagtatgtgtgttgtggatggcaggtagttagctaaaactaatcttgtaaatttgtgatttgattaggaaagaaagaatataaattataagggtgggcctggcacagtggctcctacctataattctagctctttgagaagcttaaggtcaagaatttgagaccagggcaacatagtgaatccccatctctacaaaaaattttaaaacttagctgggtgtggtggcacacacctgttgtcctagctactcaaaaggctgaggtgggaggattgcttgagcctaggatttcaaggttgcagtgagctatgatagtgccactgtactctagcgtaggcaacagagtgagaccctattcttttttttttttttgagacggagtctcgcgctgtcgcccaggctagagtgcagtggtatgatctcggctcactgcaacctccgcctccagagttcaaggaattcttctgcctcagcctcccgagtagctgggactacaagcatgtgccaccacacccggctaatttttgcatttttagtagagacgaggtttcaccatattggccaggctggtctagagctcctgacctcgtgatccacctgcctcggcctcccaaagtgctgggattacaggcgtgagccacagcacctagccgagtgagaccctattcttaaaacaacagcagcagcaaaaacagtgtaaatagtaatgctatggtttaagaatttcaggctgagcatggtgtctcatgcctgtaatcccagcactctgggaggctgaagcgggtggatcacctgaggtccggagttcaagaccagcctggccaacatggtgaaaccctgtctctactaaaaataaaaaaattagctgaacgtggtggcaggcacctgtaatcccagctacttgggaggctgaggcaagagaatcgcttgaacccaggaggcagaggttgcagtgagctgagatcatgccattgcactccagcctgggcaacaagagcgaaactcagtattaaaaaaaaaaaaaaagaatttcaatttactcagccagtcccttgctctaagtcagcaatataatgacagccttaagggtttccacctactcttcaaaatggaaaatgtattatattatcaaacattttatttaacccaatctataaaatattgccatgccaacacataatcaatataaaaactttattaatgagttattgcacgtttttaggtactaagtctttgaaatttggtatgttattttgtacttggtgtacatctcaattcagtctagctacttttcaagagctccatagccacatgtgattattgcctgccatattgggcagtatacttttaggcagcattgggaaatggacttaaatataagtactgaacaaatagcttggttcctgtagtcaaccatgtgatgatcagatgtgacatacgcatatactggacaaagcaacattgagaaaaaggagcatatccatttcttgtttatcttatttataggcataaattctcttctccccaatgttaaccttgcttgaatttcatcagatttaacagtgagactcagcggctagtgtccagtatctcctctagagtgcttcttatgaatagaagtaacagtggcagaaacacgtaaagatcccccctgctgtgttttccatttcttatatttgctcttttggagaaatgttagtctgctttcaagaaaaaaggacagagtagataatctttttgctggttcgagatctagaattacgacaagcttgctgacagtgggaaggataagagaagagaggttgctgtttttcttttgttcagccttctcttctctgttccataagtgctctgatacaaagattttctagagctaaaaaatgtttcagtcttttttaaaaaccttatgtggctccagagtttagcacaaaaacgcacccttgcaggcatgtctttcttaccttctgtttttcttatatggatgttatccatgtaaacgcttggaagaatttgaagtgaaatcaaacaatttagattggaatagttgtctataatttgaaattactaaactttttttgtttcttttttagtaattttatgcgtcaggagtgtttggattccagatttgtattcgatagaccactgcctgtgtctcgtcttgtatctctaattggaagcagtatcctttttatgttagcatttatggatatgaactttgaagggttttgatacttgtgttaattattaggaatataataataatatgacataggtaagattgtgaaaactttaaaacaacaaattggattgctctttcattagcctttataagcaatttatatttgctagacacaaataagcccaacttcaggaaaatcatctaagcatctttttagaggggatttaaagtttcttaatggttctagatgtcccaagaaatcctagaccccttgtatccaaaacaaatcaggttttagatgggaagaaattattttgctggcactctttcttaggttcggtagaaagtcaaacattttatattaggccaaagaaatagtgtcctattgcattatttctctggtggattatgcaacaattaaagaataagccagagacctttgttaataatgtataatttgaaaataaagacagtacttcattccttgttaaaacaagctcgttaaccagtctaagagacccagataccaacacaacgatatggccggagaccatatggtgttggtctccttattgctggttatgatgtaagttcattgaatattgttatatgttaatgattttttttaattaactagaaatttttataatttttagttcaaccaaagtaaataattatgtggtgtatttatttctatttgtaggatatgggccctcacattttccaaacctgtccatctgctaactattttgactgcagagccatgtccattggagcccgttcccaatcagctcgtacttacttggagagacatatgtctgaatttatggagtgtaagtgacagccttgcttttttttttttttttttttgccttttccagtctatatagtaaataaacatagtatcctaaatgcataaaactgtaagtcttatagaaagaatttttttaaaaaaaattatgcccatgaagagtttattgtttctgtcacatatactaatcttaacttctggttaccacagtagtttcaagcacgagtagaactttttcaaaatataaatgtgttcccaaccttgaaaattcttgattcatttggtcagaagtgtgccctgtggagtggagagtggagaaccactgtactacctgccagttgtaagctctgttcacttttagttttctgtgagtcttttgttattttaagccacacagacatttctgcattagtagtccataaacaagaaataaaaaggcagtgtagttgagggagaagaaggtaaaagaggtaagatgttatgacaggacaggttttcaagtgctttgctttgcattggaaggagggtatcgggttttacatttctctttgtcatcttatctgttttctggtgacaaagcattctttggaggaaatatttggggtttagtgaatgcagagaaaaatagtttaattgacattactcaaagcaaacttgtgggatgacaataggtttaactttgggaaaagaggattccttggacaaataagcttggtaaatgctggcttaaagtttaacattgtaaattatggtaaatggtttggggtccccaaggttacccctaaatttggagatatgctaggacttaaagcgcacagcatatagttgtactcccaggtaagacttttaacaataaaataacagtacataggtggatcattaaggaaaaatacagtccagaggaatctatgtgcaggcttccttatgctctttccttcccataaggagtcacagagtacacttgcagcaatatgtatgtgatgtttctgcccagagaagctcattagaaactcagtgtccaaagtttggttcagaactgctcatatcagcaccctctgcctagcacatttcaacctggataggaaattcctaaagattgcaataaatctatagataattttggggagtactgctactttgatgatacaaagcatctgatccatgaacatggaatatcttcatttatttaggtatttaattctttttttttttttcctgagacggggtttcactgtttttgcccaggctggagtgcaatggcgcgatctcggcttattgcaacctctgcctcccaggttcaagcaattctcctgcctcagcctcctgagtagctgggattgcaggcatgcgccaccacgcctggctaattttgtatttttagtagagacggggtttctccatgttggtcaggctggtctcaaactcccgacctcaggcgatccgcccaactgggcctcccaaagtgctgggattacaggcgtgagccaccacacccaaccaggtatttaattctttcactgatgttttgtagttttcagtgtacaaatcatatttgtcttaaagtattttattatttttggtgctgttgtgaacagaattgttttcttaatttcattgcatattattcattgcaactatatagaaatacagttgatttttatatatcaatcttatatcctgcaatcttgctgaacttgtttattagttctagtcatttttttatagattcctaagatcatgttgtctgggaatagagatagttttactttctcctttctaactgccgtggctggaacctctggtacaatgatgaatataagttgcatgaacaaaccttcttttttttgttcctaaacttaagggaaaaggttttagtcattcactgctaagattgatgttacctgtcagctttttgtagatgccctctatcagactgaagaggttcctttcaattactagtttgttttgtgtttttattatgcaaacattttaggttttatcacgtgctttttatgcatctcttggggtggttatgcaggttttctcccttccttcagtgtaactgaaaattacactgactttcagttgttaaactaacttattcttgggataaatctcacttgtatatggtatataatttttttaatgtgttgccaggttccgtttgtagtttttgttgagggttttgttttgttttgttttgtttttgcatctatattgggtctgtagttttattttcttgtgatgtttttattcttgttatcggtaatactggccacatagaataagttggagattcctttttacaatgagcaaatataaggactaggattctacagaacacattctacaaaacttggagttgtataatttatagtcgggattttgatttgacctagcaaaagagaagatcaaaatcgtaacaaaaatcatgagtcctctcattaaataaaataagaatcagcaatgtcatagaatgctattaaaagattatatgactagcattaaacttggctgtttttactgtgataaatttagtgtgtaactaaaaaccacaatttgagactgtagatttgataaataacagaagcctagcataacaatgaaattaagaaataattgttaatttattacatataggtaatttaaatgaactagttaaacatggtctgcgtgccttaagagagacgcttcctgcagaacaggacctgactacaaaggtaagtattgtcttttccaattgtagatattaacgttacagtttaaacctttattgcataaatgtaatggagtatatatgcaacattctgtaatttgggatatgattgtcttggcagattcttttcctttaagctatttgctaagtaatccaattttattttttaaacatttctttttggtacaaagcagtaaaaccagtaaatttcatgcaaaatgtccttcattattttcagcagattggcatatcttggtattatttagttaacaaaaatatatatatattgagcacctaccatgtgcaggcactttctaagcattgaaaatacagtaaacacaacaaataactttttcttcatggaacgtacatcctagtagggaaagatagacagtatatacataagtacattatatagtatattagaagaagataaatgctatgtaaaaaataaaaaagcgttaaaaggagaaagaatgaccaattggatgtaggtaggtgtaatttaaaataggtggttgaggatattctcaccaagaaaatgaaatttgaggaaaagatataaaggaggtaagtgagtatgagctatgcagatctagagcaaaattattctaggaaatacaaatgcaaaggccctagtatttaaggcaaggaggccagtagtgttgaggtcaatcatcgagaggaagaggaaaagggaagaaatcagagaggtaatggaggtcccataagccattgtggttactctgcattttactctgggtgggctgttaagagtttgagcagaggaataccatgatttggtttaggttttaaaacagtcactctgtttggcattttaacgacagattgaggctgggcgcggtggctcacgcctgtaatcccagcactttgggagaccaaggcaggtggatcacgaggtcaggagatcaagactatcctggctaacacggtgaaaccccatctctactaaaaatacaaaaaattagccgggcttggtggcaggcgcctgtagtcccagctactcgggaggctgaggcaggagaatggcgtgaacctgggaggtggagcttgcagtgagctgagattgcgccactgcactccagcctgtccagcctgggcgacagagcgagactccgtctcaaaaaaaaaaaaaaaaaaacaaccggtttgtgggccagccgcagtggctcacgcctgtaatcccaacactttgggaggctgaggtgagtggatcacttgagatcaggagttcgagaccagcctggccaacacgatgaaaccctgtctctattaaaaatacaaaaatcagccgggcgtggcggtgcatgcactccagcctgggtgacaaagcaaaactccatctcaaaaaaaaaaaaaacagattgtaggggtagatagatagtggggctatgggtagaaatagttttaaggctattcaggtaattatgtgagagatgatagtgattgcagcagagtgacagagttaaagatgaagagtagtggttcaattttggatatcttttgaaattacagccaaaaaagtttgctaatagatttgttatagggtgtgaggggggaatgtctccaaggttttgggcctaattaattggaatgaaagatttatgatttactgaggtgaagaagatagtgggaggaacaggttttagagtaggcgttggggaggaaggtcaggcagtcagttgcggacatgtaaaatttgaaatgcctttttgtctaattgacggtacagagtaagcagttataagcaacacgtggagttccatggagagtggtccaacctacatttcaaatttttgaagtctttatatagaaatggcatttagagtctggactggaagagattcctaaaggaattgaatagttagacaagcattgtgaggactggaccaagaacactaacctttagcaactgggagatgagttaggtgttggcaaaaaagactgagagaggtggtcaaagaagtaggaggaaaacttggaaaatgaggcatctttggaggcaaacgaataaactttcaaggaggaggggcaatgaagttgtcactgaggacctgacaaaacaggcttaatggaataataaggcaaaaacctgatagtggaatcaggagagaatgggagacgaggaattgcagatagctttttggaggatatttctgttgacggtcactctgtcactctgctccaatcgctatcatctctcacatgaattacctgaatagccttaaaactatttctacccatagccccactatctatttacccctacaatctgggttttttttttttttttgagatggagtggtgactggaagaggagagaaataaattgttttgttttttaagatggaagaaattacatcacatttgctgcatgattgtgagagtaatccaagtaaatttagggaagcatttatgaggaaaaataatgagaaaattgttagaacaatgtcctttaatagtacataggtggaagggttggccttaggaagttttaatgggaaaggagagaatctagggacataggtacaggaaagagtggatacagtgggaacttgtgaaagttctcttctaattgcttctgttttcgcagtaatataggaacaaggttttcagcttcaaagagcttggagaatgttagaagtgtctaaaagaaggggagcatgaatgatgtagaaatgggtatagtgggatccaggaaccactaaggcctacttgaagttaatgatcattaataaagtgagattagtcagttttataaagccattttgttatggtgattggataattattgtttaatatcaatgtgaagactttatagcctgcattatctttttaaaaaaatgtttctagataacatagatctttggagttactcatgataatcaaaagttagtattaatattaaatctgcaaatgacaagggtccactagtttccttcttttttctcctacacataagtggtttttaaggttttattcaaatgctatataaattcttattctgcttttttcacccaatattttatcgtatgtattttttcatccaaattctcttattttacttttaccatattttacccttcagaatgtttccattggaattgttggtaaagacttggagtttacaatctatgatgatgatgatgtgtctccattcctggaaggtcttgaagaaagaccacagagaaaggcacaggtatataatcataacacaagaggctttagttctattgtaagctgctgttcttaccacaactgtgtctgtaaattttccattttgtcttaaatattgaaatgggcccataattcaaatggcaacaggaaaattaagaactgagtaaagttaaatattgaaagggcagtgatctccataaacacaaaaagggggccgggtgcggtggctcatgcctgtaatcccagcactttgggaggccgaggcgggtgaatcacgaggtcaacagatggagaccatcctggccaacatggtgaaaccccgtctctactaaaaatacaaaaattagctgggcgtcatggcatgcacctgtagtcccagctactcaggaggtgaggcaggagaatcgcttgaacccgggaggcggaggttgcagtgagctgagatcctaccactgccctccagcctgggcgacagagagagactctgtctcaaaaaaaaaaaacaaacacaaaaagggagaagtgttgattatttggttatctattgctaggtaataagctaccccaaaacttaggggctagaacaacaaacactacttctcacaattttgcggctgactggggctcacctacatggttctttgctggtctcacctgggatctctcaaacattgcagtcatttgtggggtgcaactggaacacccaagataacttcagtcacatgtcttctttactcacaccttttaggtgtcttagaggagcatctagaaggcagagacctctgctaggatgactgagcctctgtccacgtagtttcagggccgcttcttcagcagggtctctctagcatattggcaactcagggcttgcaaaagtcagaagtgaaagccgccaggcattcttaaggctgagatgcaggactggcacaacatcacttgtacacattctgttggttaaagtgagtcactggcctggcccagattctgtttgagcagagactgggagaaatgctcattgggggccagctttggacactaagatggctcttcataaagagaaaagcatcaagaagtgaatctcaggtgaaatatgggtctttttgctagatgtttagaatatacatttgctatttatagatgcttatttgatagcagtgtaattgaaagtaaaaaagaatctagtatggaaatttctacagcatgagtttttttaacttggaaaggatattgttggtactatttgggggatcaagatttgcaatatttaaactgtttttggtaaaaactagcactgttgggaagaatgctgtggaataccacaaactagtttggcaaaggggaaaagaatgtctaaaaagtgctgattgtattttaaacatagtagtgataatacaaggaaagcttttattcctgagcaatgcaaagtacgataaaatggtggaattgttcaatgatatttaggttttcagaaatgtgaaattatatatacagttatcctcgaacagtgtggggtttagtggtgccaaaccccagcatggttgaaaatccacatataacttttgactcctaaaaatcttctgatagcctgctgttgactggaagccttactgataacataaactgacaattaacacataaatagactagtttcttttttgttgttttttgagacaaggtcttgccctcttgtccaggctggcgtgcagtggtgccatcatagctcactgcaaggttgaactcctgggctcaagcgattctcctaccttcccccgcgccaccaagtagctgaaactacaggtgtgtgccaccatgcccagcacattttttttctttttagtagagatgggatctcactgtgttgcccaggccagtttcaaactcctgggcttaagcaatcctcatgcctcagcctcccagagtgttgggattacaggtgtgaactgctgcacccgaccaaatagactattttctacatatattttatgcattcggcatacctaactttttcttactctttttttttatatttctaggctacacagttggtctgctagtttatatttattggaaaacaaacaaacaaaaaaaagcttcaccctaaacaatgttagagtaaaagcaaacaaaaaagaaaaagaaaaagaaaaagaaatctgcatataagtggaccctcactgtttaaacctttgttgttcgagccaactgtattttttttaaataaaaaatctttattccctcaaatcatgagcactcaaggagaaaaaaaatactgctcagaaatgttaacaggacagtgaactaaaactgagtattcagaatatctctttacccctttttctcaatttttaataacgtaatatttgtgattagatgtgtatattgatcaagtgttcattttacatattttctttttttctttccctgttaagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggt

SEQ ID NO: 37443 - DNA, 9320 bp, Homo sapiens
cacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggtaaggggaccgagatcggtctcagacgacagcctgccaggcaacccccagccgcaccagggccccaggctgtgccagtctccggctgaactggccggcggcccaggtgggaggattggagccacctggctctccccctcccccgctcggtgatgtcaggccaggggcgggggctggagggggacaggtagttaagggcctggcgtctccctccctgaagacgtggtcccagccgggtgtcctgacgctcggggttcaggtaagaacccaagcgggcatttatcctttgggggcaggcacggccggtctggaggccggtagggaaaggctgggtctcctgatgggttgcttggcctcccacttttctcttttctgtccatttcccaccctgccccctcctccccacccgccctcttttcgtccccatcctggtttccagcgctccttgttccctccctgtacacctccctgcaggcagcagctgagaatgggaaggaagacctgattctctcctccgacttggctttcccgctgaaactagcccctccccgcacacccggggagagccgccctcactctctggctcgcccagtttaccccagtttgggtttccccaagtctctaagacagacgtctctgcgggctgcggggagatgtggggagggccccctccactttggagggcagtgaaggagagggatcctctaaattgtcgaggcttcatctctccagattgtatgcccttctcagcaacaccgcctccggccctccgatgggaaagtggaggccgggtgagacggggtccctcctggcttcagcatgaaatgggcaggaaggctggaggggtgtatgaggggctctgcagtgcggtggggcctggggagagtggggtgggggatagcagatggtttcttctgcttgatgaggctagggagagacccaggttcccggtctgggtctccctggcagattgaggacagagaatgaatgcatctgccggcaaggtggaacgccccccaccccgccccccaactagccgcaccgccccccaggaatgccctcttttggtccgccggtcttggactctgctctcccctctcctgatatcctactgtatgcttggtggggggacctcatggaggcgggcagcctgtaatgattaactgcagagacactccagcattcttcccgaattaaactttaaaagagctgccccgccttctcccattgggtatttttcctgagtgagagtgggcggggcctcagagtcctgggtcctcccttatactaggagtcatccaggggtttctcaccttctcacctgggccctgcaccctaaaaaattataagcctctcccgtgggggcggggcgtggagtactgggcggacgggggctctcccgccacatccaggcccctggcccaggcctcagtcccgcaagcccttccccctgctctgggaagcagagttgttttctgttggccctgaacaccgggccccgccacctgcccttagggccagccaggtggggcgtgattcaggaagtaaacaaggaggttgggaggacgggaacgcgggtggggctggaaccactgggggaggaggcagctgggaagccacggacggagttacctcgttgaggggacaaactgattttgggggtcggtgtttccaaccgaagctttaccggggcctcagtttgaaaactccagatctctaagctgccaggcccacagccaggaccccttcctcctccctgctcaccccattggtcttgacgattccacccgcctccagccttagaagcttaagggcacggctggggggctctgaaggcaaaccccagccttggactggccctctctgatctctgaggccaggctctaatgtgatttgaatctacttctaaccccttccaagcactgccctcccgaattctctgctcctctccccaccccactgttggtctgtgatttcgaggcaggcgtggccccctgcagcctggaatgaagtcactggggctgtttggagaccggggctgtttggaggttagactggggtgggagtgggggattgtgttctggtattgaggtgctggtgtctcttgctagcgggtgatgggtgtgtcgtgcccctcctggcaggaccctgagccccctccctggcctttcatcctgtctgtcttcttgagtgttttccctttccactcctgctcctgtggtacccctctggccgggacacccaggagaatgtgtcaggaggaacttcatccacacagggcaggggctctgagcgatgctttgggtggggaggggcaccgccgggatgctggcttctctccaaatgggcctctgaatccaggccgggcattgcctctctccttcccaggcgagggactccctggcgaggaggtggtttgggactgggggtgagagcagatcgtaggtcccacctggcctggagctaggccgagggtggggaggaggaggtgatgtcaggagcctcaggcccacatcctcctcccccatcctgttcccagccccgtgcctcccccattccgctctggctagcagtgggttggggagttgggggaagggtggaggcagggctgtttttgtttctcctaagccaggaagttgtgtggatgagtcaaggttgaatggagagccctaggcagtgttgtcccgcccgccctgactcacctgtcccccaaatcccctgatgccctcactgaagggtcaggtgcctgctccctcctgaggggtcaatcccaggtgccccaggtggcctcatagtactggcccagtgtttggagaacaggctgggggctgggattgcaggttctcccaggtctcagcccggccaaaggggtctgctgggttcctgcggagaaggtgccagccccacctccacctctagtgctcgtctttgcctgctgtcctgtctttacttgtcttgagtgtctgtgcagcccctataagtgataagacatgggtgagattggccttgcctgggggtaccaggtgccctcagacaaatgggtggataggacaggtgcacagtaatggatgatgcggcccccgcacagtgctgagagagagtcattcagtctgaatgtggaaggccaggaaggcttctcagaggaggtggctctagcactggggcttcaggaaagagttgggcaggaggatggcctggggagggtacgcaaggtttgggggctgctggggccaggacccctaccccaggccctgctctcccccttgcactgcagcggagcccgctctcctgcctttctgactcccatccttccccacctccttctcccctctgcatcactcatcacttgggcaggccaaacctcgccaagtatgaacaggctctggcaactgggtctggcaacaaagtgctggaaaaacccggggcacagcccagcgcagtgagtgccccacacgtggaggcaaaggagtgggcctttgccctgaccctgagggctgagcctgagagtctgtgggttgtgaaatctgttgtgaccaccaggcttgtggtgggtggaccctcagctcttcctgtgagcaactttgtgctaaagaaagagcactggagccgggcgtggtggcttacgcctgtaatcccagcactttgggaggccaaggcgggcggatcaggagttcaagaccagcctggccaacatggtgaaaccctgtctctactaaaaatacaaaaattagacgggcgtggtggtgggcacctgtaatcccagttactcgggaggttaaggcacgagaattacttgaacccaggaggtggaggttgcagtgagtggagatgacgccgctgcaaaaaaaaaaaaaaaaaaggagaaaaaaaacagaaagagcactggacttggagtctaaacacaggttctactcccgactcacctgtgactgagggcaagaatgctttcttctcagagactcggtgtccccttttgtaaaatgaggctcattctgtccttccccaagggcttcagggaaactccagttagagcagtgaggtgctaggtaaactctgaggggcaccctaaccgccgtgtgaggtcaggaggtctgaattctctcatcccctctccccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggtacgatggggcgtggggcttgggggaggtcagtgctggataatacacagaggcttgcaggccactgctcccttccccacacctctctccctttttcttcttgccacaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtgagttgtccctcagaagggaagggagggatgcacgggttctgggtctgtgggagatacacagccgcttccatggaggcaggggatcttggttaggagtccctgagggtctagcaggtgcggaaagggaatgaatcaccctttgcctcccctcaagtcgtgtgcaattcctggggcgcaggtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactgggtaagtcaggtgcatggaactatccgggctgggagatgatgccttgcatcttgggctaggcatgtggctcatccaggagatctggttgatctccaataacccctgctttttgcccttgtccccagagcggggtttggaggaccacgagtccgtggtggaagtgcaggctgcctggcccgtgggcggagatagccgcttcgtcttccggaaaaacttcgccaagtacgaactgttcaagagctccccagtgagtgcatgagggctgtctgggcgctgggatgccctgatcctcaacctggatgctggagccctgatccctgacacttgtctacccacagcactccctgttcccagaaaaaatggtctccagctgtctcgatgcacacactggtatatcccatgaagacctcatccaggtggggggaccccccatttcactgcagattcacgactccccagcattggccagtgcttctccacccttaagtcctgtgcctcccctctatgttgtagaaagagccaaatcacagtcctgtgtgactggggacagtcactttccctgcctgagcatcagtttcttctattaaatgggggcgagaaatgcatgtggagcatttccttgtaaaaacctgagggtgggctgggcacggtggctcatgcctataatcccagcactttgggaggctgaggcgggaggattacttaagcctagaagtttgagagtttgagaccagcctgggcaacataatgagacctcgtctctccaaaaaaaaaaaaaaaaaaaaaaaaaaggccaggaatggtggcatgagcctgtagtcccaggtgcttgggaggctgaggtgggaggatcacttgagctcgggaggtcgaggttgcagtgagctgtgatcgtgccaccgcactagcatgagaccctgtctcaaaaagaaaaagaaaaagagaaacatcctggtggtagaggggaagggaggaggtcagacctgtcactctcctctgctctcctctggctcagaacttcctgaatgctggcagctttcctgagatccagggctttctgcagctgcggggttcaggacggaagctttggaaacgctttttctgcttcttgcgccgatctggcctctattactccaccaagggcacctctaaggtaaggtcttgagggtaccagccccagcccctccagtccctggtccttttagaagttgccccttctctgctggaacctctgagcccttctccccctgggccccccaggccagccacctccagtttaccatctctccctacatccttgcctagctcacctgcccagggaggtagcaggagaaaagatgatcttagtttaagtcctggctctacttctatttgctgtgtgaccctgggtattcccctgcccctctctggtcctgaaatctccccacctggcttgtggggggaggtaatagtgggcgggatctacctgtaccaagtcctgctcactcatgctgcttaggatccgaggcacctgcagtacgtggcagatgtgaacgagtccaacgtgtacgtggtgacgcagggccgcaagctctacgggatgcccactgacttcggtttctgtgtcaaggtgaagacctggccaggcctggcccctggcctggggaagcaggaactgctcaggcccctggatcctgcccggggcttctgagccccaattcagacacctagactcctctccctgcaccctggcctgctggaaactcctggattcagctctgctatgtggagcaggggcagacatgtggtcctaaaggcagatatgggaccagtcaatttcctctctctgcagcccaacaagcttcgaaatggccacaaggggcttcggatcttctgcagtgaagatgagcagagccgcacctgctggctggctgccttccgcctcttcaaggtgagaccctgggagtggcatggggggctggcctggccagagggatccccagctctgccctcaggaagtctcaggaatgaggagggcatcacagccttgctctctgataacccccagtccaagcctgaagttataggaagtgcccatcgaaggcagaaacacagccctggtctgggcaagtcctggtctgaggggggcgtcacagccacgcccccaggacctctcgacctcaagctctctttctctccccacccccagtacggggtgcagctgtacaagaattaccagcaggcacagtctcgccatctgcatccatcttgtttgggctccccacccttggtgagtgtgcccaaggggatgggagggtgggtatgcaggccctgtcttacgggtacctgggccctgttctgacctctctcctctccttccatctccagagaagtgcctcagataataccctggtggccatggacttctctggccatgctgggcgtgtcattgagaacccccgggaggctctgagtgtggccctggaggaggcccaggcctggagggtgaggcctgctgtgtgtgtgtgtgtttgtgctggggacccactctctgggtgggatccctgaaataggagggaggaagagagggcggggggaggcccctggctgggaagaagtgctctaccttcctgaggtgctgggtaatgcccccaagcacgccccgactctcccgtatctcccactgctccacagaagaagacaaaccaccgcctcagcctgcccatgccagcctccggcacgagcctcagtgcaggtgggtgacggccccgagtcctggggcgggggctgcctcaacttctctttgtattcccagtggggagtagatggtataggggtcccctccccaaagtgaccgcccatgtccttccccaccacagccatccaccgcacccaactctggttccacgggcgcatttcccgtgaggagagccagcggcttattggacagcagggcttggtagacgggtaaggggcagggccgggcaacagacccagggataagagagactggggtccaggtggcagccatggtccttgggtagtaatgctgccccatctcctgtcttctggcagcctgttcctggtccgggagagtcagcggaacccccagggctttgtcctctctttgtgccacctgcagaaagtgaagcattatctcatcctgccggtgagcttccctgcgtccccggagtcctgcaatgagacacaggactcccagcaacctgtcctcctcaccaggcccctccagaggctccctggcccccagtgcgtctcccttttccctgcacaagaagtgggaggctgagtgcggtggctcacacctgtaatcccagcacttaggacggccaaggtgggagaatggcttgagcccaggagttcgagaccagcctgggcaacacagggagaccccatctctacaaataatttaaaaatgagccaggcatggtggtgcacacctgtagtccagctactcaggaggctgaggtgggagcattgcttgagcccagagggtcaaggctgcagtgagccatggtggcaccaccacactccagcctggatgacacagtgagaaaactgtctcaaaaaaaaaaaaagaaagaaaaagaaaaagaaaaaagaaaagaataaaaggaaatggtggggccctggcccaggagggagcttcccaagcctcgggcccctccctgaacttccaccccctttactgtaccccagagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatac

SEQ ID NO: 37444 - DNA, 431524 bp, Homo sapiens
gggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtaagacgctatggactatctttatgctttgaggcggtctttgaagaggcagaaagattgagataaatgttagcatcttgcacggagttggtgacttcctaggttttagagcaaagccataaaatcagaagtggaaaatgtttgataagtagaaaattctgagtcaattcgttttagcaaactgtcagttctaaaacaggctccatatagatttaactcttttcctccataaagtaagattttatttttatccctttttacgtttaacttatttattaattgagctgtcggatcagttttcctatttcttggcataacgtgaaacaaatacattttctcacacatcagtgtgaggtgtaaatgaattcctcccctaccttcctttgccaacagggagagtagaaagcacccgagtgacttgtgcttaataatcagtctccaaagagtattttgtgtctcatttaaaactacgaagattgaatttcttattattttacccaagccagtttcaatcatatgtcaagcttctcctgtacagcttaaaaggttcatttaaaaaaaaaaagtaaacacgtgaaatttcaggaattatttctgtcctaaatagtatttaatctgagttttggaaatttaaatgtcggaatcgaatttagtttatattaattttcctggattcactgcttgctccggtcacattttgtgtaatattttgaataactgaagtcaatctcaatgacactgacactcattataactcttttaaggcagccagaaatcactccagtcatatggaaactgtttgtgtccttacttatgtaatcgtaaaattacatttccacctgactgtagtctcttcaaggtaatcttaaatgtttaaatgtacaatatattagaaaagaagtttagtaatgaccgaaaaagtgtggacttataatgcataagatactgttatatttctgaatatttataataaaattcatcattttatagaaataaaatggtacataaagggaagaaatattcatgtacattttcaaatctattagatgaatacaaaatatactaagtgaaagatggagagctattttgacagttggatcataagaaatgaagtaactgttttcattataagtttttatatagtacaaggtgaccatctgctatattagctattctcaaattttatgctagaataacttatattgataaattttaactattcactgacaatttgtgttaaaacttcttaaatatgagaaaaagaatctactttttatatatgtggaagataaaatactgacttatctaaattatgatttaattaaaatctccaaatggaatttcagagaaggaaagaacataagagatggtctcctctaacaatggcttgaggttgtctacaagaagctgagaaatgggatttaaaagtgacctgtccaaggtcacacctctagctaatagaagagaggacagcagaaccacagtgccctgattcataattcagatacctttttatcccatcatcctgccctcccataataattatgcataatgaagtatgaacatgtccagtagaagggtgctttgcagacagaaatttgcagttcctctaatttaaaaaaaaaaaaaaaaaaaggtaaaactgtcaccaatgttaattatgtggggaaaaaaatcctaactttaaaaaaaaatcaaatcagtatgccttcaataaacactttacagtagtaacttgctttatgactattttattatatttgatgtttatgtcaagaaaatcaatccatatgctaataattatattaattttaatctgatgtttctttaaaaatagggctagaaaacagcttttctaatttatatccttgtactcaaatgatcataatgaaactgtcccaaccaatgactttcagaggcaattttacagcaccacccccaggcatcctttcttctatctagcctaaatcattgttgctgtagcttatttcaagttctatgtgggtcttttcactaaatatataaaaagcctaagttgacatataaaaaatatgtttacatttctccagcatgtttgcaatcccttaattgatttgtatgtctgctctaagccttctacaaagtcatttaattgtagaatgcagaatttttacagtatataaataaatgtctgaacaacgtggtataaaatgggagcgtgggctatttcatctgcatcatacttcatatatgacaatatttgttgctgtgtgtgctgaagcagtataccttctcagacaagaccctttctcataaatgtaacacattccatttctaatagctgccatttccttagagagaatgtgtcacgatactttttttttccattttcatgaccagattgagtttcctgatgttattactacttaaaagagacactattcaacacttcctttcaatgtcaccacactctacattattggaatgagaaataagtgcagtaaagtggtggcccttatagctgactgcctgattcctagaaggcctagtaaaagatagcacatcacttcattttcttcataaggacattataatttaaaaaaaagaattttttctctctctgtctatacctacccataccatataactcactacaaatacttatgggatggtttaatcttattcatagagttttagatcttacaggcttaaaataggtcaaaaattgatcatttgaaatttgtcttttgtttgttttttgtttcctcttgaaaaatgagtgatgtcagtgttataaaatgagaatcactctttaaaaactattacagtatggcaaagttccaaatgaccaagatctagatcagggattttattatcaaaatagagacatgtcaagaattgcacatgagaattggaagaggacaagggaacactgaaaactttcaaatttgagggaagtagtgtgaatattgggcctgctttccccacacgaaagataagccccttgcataaacaacatagaccaaacagagttacagagaagaatgactcttgattgactttggtgtgatagagaaatacagtgtttacttctatggttctgttttggctttcaactgatagtttacagagttttgataaataaatgggctaatttttaagaaagttaaacagaataataatgaataaactaggaccttgaggcccagttaaaaaagattgttaattttgattcagtggattagagtatataaatgaactttaaaagattaaacagtgactcaaatgccaaaaaaaaaggtgaaagataatgtaaacagcatgcatatgaacttgctcattaattgagataaatgggtggaaaagacaattgcatgtgtgaaaaggttgtttctgtattagcttgaaataacaaagtgttttagcaatgcaattcaaataattcaaagagaaaatcagccctgttaatggaaatgagatagaaaagaagtaggaagatcaaacagcaggtttagatactcaattagtgtttcttttattcccagcaattagcaaaatacctagcttgccaggaattatcaacacttatttgtcaataaatgtttgtgaaatgaatggaaggaaaagcgaaggaaaaaaaaaagaaaggaaaaccagggttgaggaatggtaatgtgtgggagttggacttctttcttattttccagacatcctgtaataatagaataataatttctaaaggggaaggaaaataagaggttggaaagagtcatcagagcctggggccagaggttaacaacactctcattagatgacatttcaagttcattaagcaccagaaggaagcataggcatccagaaatggtttgaaattaaaagttacatgaggccagtgagaacagagcactagtgaattttccacattttaaatggggtggtgtaccgaaaaaaataatggacaaagttagaaaactggctctgatttcctcttaaccacttgacgctctgtgatttgatgtttgccccgtaactactttgagtttctgctttttattagtaaagtatgggatttccaggtcatgttaggcattagatgagatttcatgtgtgcaaattgttttgcatacagtataatcaacaagtccttgtttaaaaaggcataagtcaattaatcaagaaagaatatgggaggccaaggcagtcagatcacctgaggtcaagaattcgagaccagcctgaccaacatggtgaaaccccatctctcctgaaaatacaaaaaactttagccaggcatggtagcaggcacctgtaatcccagctgctcaggaggctgaggcaggagatcacttgaatctgggaggtgaaggttgcagtgagccgaaattgtgccatcacactccagactgggcgacaagagcaaaacttcatctcaggaaaaaaaaaaaaaaaaagaataaagaataattgtgtttcactcacattttgttctaatcactcatctatattgaaatatcatggacatagaagagatagtttcagctcatactcagccctggattctgcagctaagatcagttgaaagctaaaggagtcatcatcaccatcaccatcaccatcatcatgatcaagtcactttacatctagtgagtgcttgaaatgtgccatggactaagtgttttacatatattataatctcattgttattaactcattatcattttcccctcaacagttttttcattattcccattacagaactgagaaaactgaggtacatagaatttaggtaactaaccctaatcaccagggggaaaaaagttatttcacagacatcctcacaaaaatgggagacaattcctgcccaccagtatgtatttgacactgagctagttaatcagtcctgccaaaattcttccctatcaaattaattagagcaataatggtatttgtttcatacaacatttgtattactgctaaaggagatagcttctaagtaacacaccgaatacagtacttggcccataataagtgcttaattaattgaaggatgtttttactataattatcattataagtttctaatgcacttaatatttcttaggtattaagaaaaacacttggtgataaaaataagctcaaacatttataggtagatgacataattaagatgagatgatagagatgtatggaagacaaaagttgatagcagagacattgaccccaggtaggacaccaagctaacagaagtaattaagttcctaatgacatcttgttcctgatttcagtgaaaattgtgcttatggaatgactaaaaatgtaattccctactgtcaacttgctatctgagcacctgggttgatgtagctatatctgttatttacgcggagtgattactgtgtctactgttggagtgttcttagaaatgatagcaaagctaaaaataaagtgaccacttaaagcaaaaccgcatctcaccatgatgatgataaaacattataatccgtgttccttgttgaataaaaatatctttttataatacagcaaaccacatttcaatcatactgctttgccatcaataataaaaaggtcagccacacgtttaatatcaactttaaccctaggctatttcctgttacatgaaaaatttcaagtgaaacaagatcagaggaaaggcaatacttctctttattgtaagaggttctacagaaaagagatattatggcaaagaagataattattcattaatgaatttatttgcagaattaatctaaggtacaatgtatttgtaaatgcccaaattattctgcataggatcaaacagtactattaagaagattgcatacttaaaaaaaaataaaacatggagatccaaataaaacatagatacttagaaattactacatctggccgggcgtggtggctcacgcctgtaatcccagcactttgggaggccgaggtgggcagatcacgaggtcaggagatcaagaccatcctggctaacacagtgaaaccctgtctctactaaaaatacaaaaaaattagccgggcttggtgatgggcacctgtagtcccagttactgaggaggctgaagcaggggaatggcatgaactcgggaggcagagcttgcagtgagcccagatcgcgccactgcactccagcctgggcgacagagcgagactccgtctcaaaaaaaaaaaagaaaaagaagttactacatccataaagcaatattgtcccacatggctctgttaattctgggatctcctagaaaccaatatccccagaaagatctcagtgatatcaggagaatatcataaaatattcccagtttcctcaaattacatgcgggttgcttaagaaaatgttaagagaatctccaaatctggctggcttgagccataaagtgggtggtaagtcaaacactgccagtatctgctctcctctctgcaagaaaattagacactactggaagcgacattaaatagcagcaacctggacgtaaaaatagagcaccgctgaaataatagcttgcagttttgcaacaccctgctcttttctcatgagctgacttctagtggattgaaagagttaactttcaaatttgcctgaatcactgagggctaagaataaaaaaaatgttttaagttgagtaaaaactcagatatacctaaaaatgggttaacaataaaataatatttttcagctgggtacctatttcttcatttttcttctaaagactaaacctgatggaacgttggatgtgtattttggaaaaagtgaaacactacttattccccttacttggctcattatagatgacttattctttaatttggtaaagtttttgatgctttccagacagcctaaagacatggaagctacttcatatataatattttaatctccattaagcaatttgccaataaaacttttaacagggattcatgttttccactaacatgtaatgaggtataacaagtacattccagcattaaacaaagtatgtaaaagtagaggaataatgattttgtgtgggattaagacacatattgctactaaagaaagggaatctgcatgaaatcatatggaggtaaattcttgcatcatgttattaaatgtttatccacccacagtctaattctagtcttgtctaatttagattagataacatgaatattttaaaggaaaaacactaattgttttttactgaaagttggctgtctggactagactcatagaaatgctttttagaaatgtgctcttacggtttttgctatttgtttgtgtatttacataaaggaattaagaaacataatatcttccctgggctttctggcttctaagcatatgtcaagtcagtttggtcgtaaagagcattcctcttcatttatcactgagctgtgtgccagtgggaaggcgcccaaatgtacacaatttagtttgctaggtaatttgttctttgacattatcattaagaaaatgggtttcattttggcttccacaaatgctctttgtaatgaagatttactttgacatgagttgaagaactatattaagttgtgctcctgtgatcatgtctgtttccaggttgttgatcgtcttttctagttgcctaattcaattcagtaagtgttttgggggcacatacgatgtacaagtgtgagtccccaagagtaggctaagatacagtaagatttcatatcattaccagatattcaggtttccaacatatgcatcttactaaggtgaccctcaccacgtagcaacaaaatgtgccaaatgtagaggtgtcttcttcttcgttcatatgctgagagagcattttagaaactgttaagttgcgtttaattaacatgagattatttcccttacatcttctcttccttcccacagtgactaagcacatgctatgcgatagctgttttatgtaagtgtgtgtgtatatttatatacatacatatgcacacatatatatttgggtgcatgtgtctctctgtgtgtatatatatgtgtatatatatatatatatatatatatatacacacacacacacatgtgtgtgtgtgtgtgtgtgtgtccatgtgtgtgtatgtgtataaagcagtaggtggagaacacgacctagaaatttaacatgggatggctaatcaggatgaaaaactctaagggaaaccagaagtaattctagctatctaaggaagaagtaagaaaagaaaagtaaaatggcagtactgttatgtctttattttcccttccattaaatattcaggatatttaatagaatatcctagagtcaatcatgtgttcatttatttatatcaatatatatgtgtacacacacacacactctcacaacccagaagtcaatagcgtgttcatttatatatatgtgtgtgtttacatatacatatttatgtgtgcatgtatttgtatacatatgtgtatatatgtgtgtgtatacacacatatatatatcacatgtattctcaaaggactgctttatgtatacacacacatatatgtatcacatgtattctcaaaggactgctttatatatacacacacacatatatgtatcacatgtattctcaaaggacaaaataagatacctgcatttgatgggatgaatacaaaagttgccatctttccaagtactgtgagtgagggattcaggaaaagtgggaatttgagtgagaattccccatttatgtgcatgtactaatgtaatgctatttatatgttattttatgtatcttaaacttctattcagataacattttaggaaaactatggcttagacaattcctaagaatacctgttccaaatttcaggaattccccaggagagttagggaaggaaaggaaactgaaagaactgacctaagaatctcatagaaattgtgctgacattggtgacataagataaatatccaaactggcaccttttctttgctacgtacatgagactggtgtttgtgtaattgcgaggggatgctgtggtgagggggaatggggcaaaaagaatggtttggccccaccagacatattgcagaagaactgcagtcgtgtttatgcatcagcttaaccttaaaattactgctgtagaacattttaaaatttaaattatttttagcatgaattctgaaatccagagataagactttcttagcaaatggcacacaatatcataatactttaaattatttttagctatgtcttctgatatttaactctgtatttctaaacaatatgattgtactatgatttttttttctattttaaacattatctgttaacttcctgctacagaaagtgactatctcccttaaattattttccctgctctccctaatctcactcctcacagaatcctatgcactgaaaatcattgcttcatatgttttggttaatttaatgtttactatttgcattattttgactacatgaaaaaaattagccacagcttatggagtatactataattatattttccttcttgtaaaactatttttcctgtggttgataattgatatccctagtgttctctataactattaataattcttccatccaaattgcttgactttattataaaattcctctcaatatgtcatatataatttattatttccctttttttagagacatctcccagagacaactttaggagttatgtgaaatgattgaccactggacttgctacacaacttttatcctgaaaattctataccttcctcacttgtgctgaattcttggcttccttttgccatgtctttcccactgtgtttattttttaatttggggttagctatctctccagtagcttttgagaagaggttaaaaaaaaagtaagacttttcatataattttaaggcagacataatttcccatccaaattttgaagtcgtatttgcctgtcgtcttccctgcactgttacttttgacaaatctgataccattgattcccagctcctaatatatcatctctttttctctttctccgattacatttagaaccatttgcttacctcctatgttctgaaaattcacaacgacatttcttacgtggtctattgttctttctggtaccattgcatcctcatgagttcccttcaatcggaagacttgaatcatttgttctggaacacatgctaaaattgttttctttgaaaaatttcttctcttaatgttctctgaaggccgggcgcggtggctcacgcctgtgatcccaacagtttgggaggccgaggcaggcggatcacctgaggtcaggagtttgagatcagcctcaccaacatgaagaaaactgtctctaggaaaaataaaaaattatcctggcattgtggcacatgcctgtaatcccagctactcgggaggctgaggcaggagaatcacttgaacccaggaggcagaggttgcagtgagctgagatggcgccattgcactccagcctgggcaacaagagtgaaactctgtcttaaaaaaaaaaaaaaaaaaaaaattctctgaaatgtttctgataaatgttaccctccaaggtaactagtgagttttcgagttgcaagcaattctctggaatttattgttacctctgctatcttttccaaagaggtaattctagaatagtagaaatctgaagccagaaagaaaggaagatttcttctatccagtaggaaactgtacctcaaataccatttgacttgaacgttctggaggcagaaaacttaccacagatagatagatatttaccacagatagatatctatgatagaactttctttgtaactattatccttgtctacaggagtttctcccacaaaattggtaagcttcagtagcaaaggtagactatacaattcaggtttatattcctaatgtttagacaagtttctgccactcactgggtactaaataaatgcttgatgaatagtgattatgaactaactactgtcagttctacagactgaacacttgatttcagccagtggtacttcatctgcaccttgctctctcaggctgtagaatcagcagtagtaattattatcaagctcttcttttctaagaacaattggcaggccaaattataaggtggtcttctatttcagagacaagtgcaaaaatagagcatgatcatttgatatcaaatatagatcagtgattttcaaactagaatgtctccaattgttaaatacggtaacatttaatttgtttaatttattattatttttttttgctctatcacccaggcaagagtgcagtggtgcgatcatggctcactgcagtcttgacctcctgggctcaagcaatcctcccacctcagcctcccaagttgctgggtctacaggtgcacgccaccactcctggctaatttttgcattttttgtagaaacatcatctctctatgttacccaggctggtctgaaactcctggctcaagtgatccgcacacctcagcctcccaaagtgctgggattacaggcgtgagccatcatgcccagtaattttgttcaactttaatgtatatattgtatgctataaaactcttacgttaaggcatggtaagtgttacaaaattaacccaaacaatgaattcaaaatcatgcacgaatatcacaaatttggaaatttcaaaagtattttccagaatcatagcatcattagaagtacatacagtctcttgtgatgttaatgtcacggtgcttgaacacatgaatttaagaagtgaaaaatccccatggaaattcacttcataaaaccaacatcctgaaatgacctacaattttccagatcctccatccaaatcctcagcaactgagctcattctgaatgaaactgcatgaataggattacaaaagaaatgtaatagaaatctgaaaaataagtagtcagttttttgaaatgtaattttaaataaggcggcccagtgaggaggctcacaggagaagtcagtcttttacaaagatttctctctattaggggatagattataatcaattcagatgatttaggaaatgagacctataaactcagatgtgattgacaataatctaatgctcctatttattaataatctggtctttaaatcatagagacagatttaactataaatcttacaaatcaaaatttaaatagaaactggataggagagcttgcagacattcatttttttaaaaaaactatcagaccacatgacatggaatgaatgaagatgccaaatgtaataatgatcgttatgaaaattgagaaattgcatatcttaaaaataaaagtgtacacttacagaaatgatttggaaatgttgaaagcacctagattagaaatgaaagcaagaagagttaatgctttattggatttatcttatttatagtctctctttccagttagattgtctcagaacttgttgaactatcttcctttgatttgacagaaatacttacctacttgtcaaggttgagtgacagaaattaatgaatattattgtcaagtcttaaaggcaaaatttttgtgtaattctttttgcctaaaaagttaataaaactatatttcttcttagtaaaagaaatgaaaccagaattcaggctcaacttaaaatataaatgtggcttaggagtgacatcgtaataccacttggtatttcttaagtgagccggctctttctacactggataaaaataaagagagaaaagtatctaaaaccctattacctcccaaatgtgcccatgaaagcagaaattttctggcttgcatctatgtgttctttccactttccgtagcctcccacgttataatgacttatgcatggaattcagagattttatattttcttttgagtgcagagtgaacgtcaacatggaaaatgtgaaggctgaccacttttcaagatggccacagacctctgagggaaccaaatagtatccagaaagatacttggtcaggctgggatactaaaattctagcacatgtcaatttcgccagtttttacagactggaaatatttacctctcaggcatgtgcttagtcagaacagctcgaaatttttgttggggagtcaaggccctttacaatagaatagactaaagagatcgaaaatcagtatagcagttaatcttgtttatagcagaaatcagtaactcaacccatgttgtgtgctgacagttctcgtgtgaagtaaaaactaaaagtgtctgctctgtgaatgggatttttcttttacagtccaataatatagtttcattgtggggcaaaatttgggttagtcatttttataacgttgagttgacactggtattatttctttcctttaactaagggtttgaagaattcaaggcaaaaatttgggtacctggtatgtgtttgtattctaagcttgtcttatgcatgattttcttgtttacttaaattttatggccatattctaacagaaatatgcaaactaaacttcttataagccaaacagaatgagactgaagtttctgaagaatagtcccaattgtcttatagtcatatcttcctttatgttcacttgaattcttgcataaaatatttagagtttacacatactaaagttatgtgggaagaagggatgaaggtagaatctcataattccatggagacaatgaagtttgttgactatctcagtctgggccttagaagcaggaccaagtttgaatctcggctcacttgctacatgtataactttagtaaattatttaatttcccttaagcttcaaaaataccagcttgcaagctagtagtagcagtagtaggatgcatgtacagatgtatctgtcctaattgtaaatggtatgtgttatgctttctaatccatgcattctgtgttaatatgtgctaaactggattattccatgtttcttagtcattccctggagtaactacatactggtcgtttgggttcggtgttagctccttcacacactaatacattacacatgctgtctctatagctcaagttttgcatgaacagttccctggtggctttcgctgtgattcaaaccaaacagtgaatagatttatttaacaacttgtgttcacaaaagtaaatcaggaaaacatgcaagccagaacaatgtttcttccagtgatttttattaagtattgcatttcacatattttcttaatggagttttaaatgttcagtatttgtatctttattcattaatggaccaatccaactgcctttaaatgcctttaaaagtattgctgatgatttttatcagaaatattcaatgttaaatttccttctagtattaggcttcttaaagaaatgacattattaaagctactaaacagaagctttataaaatctcttaactttgatagcatagattaagttttctcttttctaagatatattttgactttagaaacgtatctgcgactacatatttttttgaattttttaataggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaaaatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggtaagacatatgcacagattctctggcttttgaaattttgtaaatatccttggatttatcagttatcattttgcttggattaaaaagatatgaagatggttcttttgccctgttatgcagatgtgtaattcaacgactacccacttggtcaaaccatcaaaatatgtaaaaattaaagaataataatctatccgtttcactaataatgtgtataatggtttatgaatattctatttcagaattgtgttgaaaacaggattggtatccctttctttagttggaattaaatagccactagatagctcatagacatgcaattcaaggcattctgtagagtgatttctaattcttataaagaaagtcatggtactgttatagcatttatttgggcatatttctttttctcttcaaaaagactatgttttcataagaaaaaaaggtggtataaatcacatatttaaaataatcccctcacatatacaaaggctaaactactcccacccccaaaatgtgctggtgccattttaagtgataccctggcacactcaccatcaatatatatatcatagtctctgtttcttgccacaactgttacttaactgtcaaccagaaaaggctaataaccacaattatgttttatgctacagcccctttgactaattctaaagatgccatcctcccctgcgaagctttcaagtgagagaagcaagggctaagatggtgctacctgaattatggtttagcaagtgaacccttgaccaaaacctgtcttttctatagaatttccccacatttttccaaaaactgtagtgagttatagtcctgatataagtccaagcacagtttcttcttctataaaccccacatggccaatggcatggaagaaaccctgcatttttgacactggtatgcactgattaaaacatatatccttgcccctctcttgatacattcatccataactgcaattctcctaaacacaaaagtaatgttctttgttctgttcaactggggctatctaccatgagagagaaaaaaaaatctactactttctttgtagtgaagaaatctggttttcatagactgtggttttgcttacaaactagatcagtaatgtgtcgtgagttagtttaaatgaagtcaaagactttacagcaaaaatcagtgtccacaagctatatgctaacagagcattttgtgcttctggcagactctcacttccttacataagttttatgaaaatgttaatgctccataaagttgttatgattaaactgtttagatcactttttcaaaaactttcatatatcctatcaaatctgtttgagggaatgctgtaatgacataagacagtattaactgacctatggcatagctcccctaaaataaaacaaactccacccaactgccaatggaaacattaaacattccagaaacatatactcaccacttgaacatttatatcaatactaagaatgctggaaagaatttactcttggacatgtcactatagcatggttgccttttgagagttataattatatctcatttacaagttctaacttaaattttctattttaagcattctgtcattctaaagtgttgtgacattgcctgatggaatatttactttaactctacaacccatttaggatgccttctaataaatagattaaatgaaaacttttaggttgggaatttatcctagaaaactacaattatgtgagaagcccttagaactaaaacgtgtaagaatttttgttttatgcattattggatgagtgttaaaataccattgaattggcaattcgccatttttagaaatttaccagaagaaacaatagagcatattcatagaaagatatgtacagaggtgttcatcactatattgcatgttactgaaagaaaaatgaaacagtctacatttgcatcaataaagaatttgtttaggccaggcgcggtgtctcatgcctgtaatcccagcactttgggaggccgaggcaggcgtatcacgaggtcaggagatcgagaccatcccggctaacatggtgaaaccctgtctctactaaaaatacaaaaaattagccaggcatggtggcaggcgcctatagtcccagctactcgggaggctgaggcaggagaatggcatgaacccgggaggcggagcttgcagtgagccgagattgcaccactgcactccagcctgggtgacacagcgaaactccatctcaaaaaaaaaaaaaaaaaaaaaaaaaaaaaaaaggaaatggtctaagaatttgttaattatttatctattgtatggaatgctgggctttcattaaaaacatggagtcagatccaagcacactaacttttaaagaggctcataatatagtactgaaaaacaacagtagcagaccaatatgtatagacagccaaatcttaatgtcaaaatgtgtgtgtgtaggtatgtgtgtgtgtgtgtgtgtatatatatatgaatgtagatagtaatataaacctctctgtatggctgaataatatgtgaaatcctggctaaataggcacaaaattgttaacagcaattacattggatgagtggaattaaaagaacaggaggggttttcactttttaccccatataatctttataaaagatcacagaattatgtatgaaatgcatacactgaacagaaacacaaaaataaaataatatttagtatataagctgaggcattttctgcatggcacaaaacaaccttttatctgcattattattatgattctgcttttataaattatgaacaaatatttataaagtttttcacactattaacaagagttctaatctagttgatgtctaatactagtgcaactggtttagaagagataagttttttggaggcacacatgtgccacattttcatgtctgtagggaatgcagtggcaaatggtcaagtggtagaaagagtttgctaattgtctatatatttaaaactgtttgtcagccatagtaatacccgtaagataagaacttggaaaagtgaaatcaattaaggctaatatcattttagttatggaattgtaatcagctcattatctgataatcatgtgattgaatcaaatccttcaataaatttgtgcacattgatttcttttgtcaagatcacatcaaagttctaagacctgaagaaaaaaataaaagagcttataagggggatcttcaaaatgtattgaaatagtgctctagagatatcattgtacttttaataaaaattatccttccttgaagcccataaatcttagcaggcattcatcgttttgcaaagcttagttttcttagtttccgatgatatttcagactaccagggtttagtcacacgtatatttattaggagtctcaattggaggggattacatttgtagtatatgtacaagtatatacctttatttttagtatatatgtagtatataggggatcacaaatattgaccttttaagccaataattcctctaaataggatgaaatatataatgaaattgaagccactgatatcaaaggaaaaccaaacaaattgtgagcaaatgttagtgaatgtgccataaggttgggtgacatatgaccagcactcagggcctggctggtctctggggtgaggcggctggttaaaagcaattctgagacaaattccaaagtagtctggaggagggagacagtctaagaagtggtctctttaaaccagatgagatgtgaagatggaaaacatttagggaaagacttgaggttagacattttttcttaaagaagtgggttactaattagagagagtacaaaattcagtcttctgtaaagactacttaaatagttctgaattttttgaataaccataataattatataaatgtctgaacatatgtttatttgctcacataagacaagaaataatccatattacaaagcaaaataaactccaaaaaagatgcaaagataatctgaactttaagaagacacctaattctacattccaacaaaaaccttatattccaaaaacaaattaaatgaatgttagggtcttagtttatccctcaggtttgtgtgtgtttgtttatttctttgagatggagtcttgcttccttacccaggctggagtgcaggggtgtgatctccgcccattgcaacttccgcctcctgggttcaaacaattctcctgcctcagcctccttagtagctgagattacaggagtgcaccctcacatctggctaatttttatatttttagtagacatggggtttcgccatgttggccagcctggtctcaaactcctgacctcaagtgatccacctgcctcagcctcccaaagtgttgggattacaggtgtgagccactgtgcccggcctatatctcagtattaattaggctatagatttggctgctatctcagaaagcataatagtggttcaaatgacatatttctctcacacgcataaaatagggataagaagttctgaactaatatataggctctatgccttcagaatccacaccccttttatctaccctctctgctctcgagtcctcctctacattcaagtcagtgggaaggcaaaaggctacaggggtgatcgcaccctgtgtacaggcagtacccaggtcgtcggcttcactgcaatttcatgggctagaatttagttgcatgggcatatctagcaataaaggaactgaccattggaatctgcattctggacaagcatatgtttgctaaaagttctattatcaaagacgtaagggacaatttatattgagagataactcataacataaatattgaggaatacactctaacataaatatattccaatatatcatgacacgttgtgaaagaaataaccaagctgcatatatgttctgtggtattctgtataaacactaggtgctttaatttcatgcaacagaatacctttcctcattatgaaactatttgatatattaagtgatgtttatcagatgctatatcatttctcatagaaaaactgtccaggaataaaacattatattgtacatactgtactttacatctctggaaaacataatacattgtctatgactgataaaaatcaaatattttctccttattctatatttaaaatatgcaaacatttggtaaaaggactcccatacctgaaatgatactctctttcctttctatcccctgaatgctgatgggggagacttgtaacaaggggaggataacattgaccaatgggtgacataaagaagatagtaaattgtgcagaaaatggaatgaaccaaagtaggaggctgactgggacaatataaaaggaaaggaactatttaaagaaaataagttctagaaaataagtttacaatgtaaagaggtatagaatatattgtaattatatttaacagtataacaagtattgtaactatagttaacaataatacatagtttcaaatagctagaagaaggatattgaacgttctcagcacatatgttctcagacatgatcaatgtttggaacgatggctcttctaattacccagatctgatcactaaacattgtatgtatcaaaacatcatctatgtgccccataagattataaacaatgtttatgtatcaactgaaaaatttttaattaaaaagataaattaaaacaagaaatgaaaacctaaaagatagttaagccaagcctccagactaatgtagcaagatatgtggaatgaaagcaaggacaatgaaggaattagcttgtgaataagcttagtatcagccgacaaggagggaaggaatgtaaagcagggtaggtatatatagctctgcagataaattcataataacagtattattttacactaagcttgcactggttttaatgacacaggcctgttgagaagattgtgcttcccaaatccccttgttttgacacttgtttccctaggctaaagactggagctggcaatgaaacttatttccaagtggttagttggtgtgtaaattcataacaagttcctgtgacagttcttatccaacatattcttagtgagttttgtgtcccaggtaaagccaatagctttgtaaatagcttattttgtgcttcattgggccactgaaaactatcaaataatttcatgccatttaacctggtttttgccttataaataaccagaaagccaaaaatgtatttgcagatatttggggctcaaatatatcgtctcatgacaaataaatataagtctcctaaaaccaacttgaaatgcaaaaacatttaattgtaagataaatgaaaacgctaggtatagcgtctggtaaaatcaatcaataaatattgagcattttcaatatcccaggtgctatcctatgtgcttggtccaccaccatgagccagttagcagactttattccattgcaaagcatctagtcactgaaatcccactggagattccaagcagggcttctgtttgaatgacgtataaggctggcactgagagaggagagagtagtgagagaggtggagggagagagaaaacagagagagagagagagacagagagagtaagtgatagaaaaaaaaggacaggctaaaataggataccaaaaatagcactggtcatttgtaaagaaaaaaataaatacaagtctttgacaaaaagtgaatatgtagcaggctggaatcagattcaatttcaacaggatgatgtggttatcacaagcaggagtttagcaaagagacagggaacatgaacttgactccagagattatacagctgatggagctaaatcattgctattttttaacatcaggtgatgaccagagccagccttatgggctgtatctccaacaggctagaggtggaaccctcagataagctcatatttcaagatcctcaaatgttttactttttgggggtgtttaatttccccagttttctcagtcaagttagttgctcagttctctctatacccacagaagacttattactgacatgatgtatatattcctactgtaatcctatgtataatgtataataaacaaattcattggaatccaattgattccaccattgctaactaaaatgtagctcactgagcacaattattcaaccttgtgtccgcagtgcttagaacctgttcataaatgctagaacgaatgcatgtcttcgttgtggtaagatatttattttcagaggataatgctaagtgtcatgaacccaagttataaagatgcagaagaacttaagtcatacaaccaccaccattggccacatatcccctctctgttctgcctgctagttctgtgctaaatcaggacatgagggaagaagagggacaagggaatcatgtaaaatctggatctctgaggaaaccttcaagactgagatcattattacactgtgccacaaaagaactcactaatcataactaattagtcaatagcaaacgatgagtagtaaatgttatcccgaagatacttagttgtatccagagaggagtggacaaggatgagtgtagaaaaggaaactgttagaatatccattcacgtatattttatcatttaattttatgtatgttctataacatacatattaacacaaaagtatatgtgttattgtttataagtaagtaacatacacatgcttgcaggggagtccatatcaaaaatgtcagaggccactggtctagaaattccatagcttttctgggtaatgtcactatgaggaagttgggggtggagtggagagaagatggcaggaagaatagaataagagattgaaagacaaatgattggggagattgagaagcatttgtttagagagtgtcaaatgctgacaaattcttttttaattttcattgtgaaaatgacataaagttgggagatttgctgccagatgcctttaaggctatatatatataaaaaaatattaaatctgaatatatatataaaaaatattaaatttgaatatgtatatattcagatttaattgccctcactcagaatatatattctaaatttatatatatatatattctgaatttatatatatatgtgtgtgtgtgtatatatatatttatataaattctgaatgagggtaattaaacctgaacgttccttgttccagatattattgggaaaaaaaattagttacgatgtatgaggggcctctgatctaatcagtgatttgaaccaaaatcgcacatttacatcagctgttaacaggatcattaatgagttcacattaacccaacatcagcttttattggagcaagaattaatacacttttatgatgttattttaaataatgaatggttacttcagagccaattgtgcattggaggccatcgtaatagtgaaactgatttagcttgttcctcatggatttctgttactataaaccatgaccaatttattaatcttttaataccaacaaacaaccataggttttggctgcctccctcgaagaaatgccaatatccacacaagttgggataaatcacataacctatgtaacagagtcctgcctcttatctgggtaccagacacagtggtgccaacaggatctgtttttctggctcatgttcttacaaataatatacttatcccttgctgccaacaagatctctattctacagataattttctaaccgtaaagaaaattatagtgctattttaaagataacctcaccaatttcaaaggaaatataagtaactgggagaaataaacttttttcttagttctagttctgtattgacataggaataaaactagtgattaacgaacctcttcaattttttcacttctattttttgagccaatgaaacttcaaaagggtttgcagctttttatgcacattaaaaattaacccagagatttttgaaaatattgaaatagcatcattatttggtctagaaaatgaatggcttggactgaacttgattttccagccaagggagtaagctgtaatgaggaaaaaaagcacaacctaaagtggggggtgtatttaacctttgtgagcctttcatgcccctggaaaatggagaaaacagtctcggccttacaagattgttaggaacattaagtaaaatggaaaatctcattaaacatccacatagtacagcacctagaacaatggtattttttaaccagaattcgagatgaggatctgacagccaaataattggagtgcagaattattatatctgaaaataatgcaaattctagtagaatctatattcacagcatatataagcagccagcataagtagcttcttcagtgggaaatttctggactcctgcactgcccagggttaagtgtccacagattcttcactatgcctagaacaaactaaagaagccaacagcctctgaagccaaactgcctgggtttcagtcctgcttccctcacacgtatctttctaatcttgtaagttacttaatctctctatggcacagtttttttttttcatttgtataacaggattctccatctattgtcagaaatattaaatgagttaatatatacaaagtagttaaaagtgtctgtgtacacatagtaaacaccttgtgacttcagctattcttaatagtagcaacattttgtgtgtgtgtgtgtgtgtgtgtgtgtgtgtgtgtgtatggtgtgtgtgttttactaaattgccctaattatagatctgagagtttcttagaaaaatctcggggccgggggcggggactgacaaattcaagagagaactgagaaagtatgtcaacccacatggacatctgaggcatcaagttttatcattaaatagtagcactggccaggcacggtggctcacgcctgtaatcccagcactttggggagccaaagcaggcagatcacctgatgtcaggagttcgacaccggtctgaccaatatgatgaaaccctgtctctattaaaatacaaaaattagccaggcatggtggcatgcacctgtaatcccagctgctcgggagactgagacaggagagtcacttcaacccaggaggcagaggttgcagtgagccaagatcacgccactgcactccagcctgggcaacaagagcaaaactgcatctcaaaaaataaaaataaaaaataaaaaaaattgagcctagaatatgcattcgttggctaaatatttattatcttctctttcccatgcactttgctatgtgtggtgtagaatatgaataagcatatatgtgccttcttacctaaaggtgtttacacattagtaggggcaatgtaacacacaaataactaactttcatattaagcgtaattaacttcggtaagttttgaactacaagtaaagttatatcttaattaggtttcaacataattaaagttagaaagtattcagatcgccagaatttgggctaagggaggatccctttccagatggggaggtcagaaaagtcttcgctcagctggtgtctgggctgagctttaaaggatacattttagattttgcacttgtgggaataaatgagggaaagggatctctttgtggcattttaactgttctgttttctgtttctgtcttcaaacttctattttttagctacgtaatttcagggctcaccatattttaaacaattatctagatttcaatatactaatgagtcctgaaaatgatgctggctttatagctaatttatagttaatttgctccctagctagtatttgattaattaataaaaaagctaaatgaaaattgtggaaatgtgctttgtgactaaggcattagcaggagatatattaacaaaatggttcaactatgaaataatgatattaggtattcattcccactaattctcaattccctccctgatacataagaatcatgtacggaatgtttttaatacactgttttatatagttttgaacagttataacaaggtcagcataattgactgaaagcatgagaagtaagaaggcatgagaataattcctctttcattaaaacttcaatgctgatcatatttcatattctactcacatactggccttaggcataattagaaattttctgtagtatcactttgaagaggtccccaaaggtattttagtcagagtgtaaagcaggcaagaaatgtacttcataaatatctgataaaatgtaaaatatcaatgatcgccttctttaagtgtaaaacaagagattttcaggcctggtgcagtggctcacgcctgtaatcccagcactttgggaggctgaggcgggtggatcacaaggtcaggagttcaagaccagcctggccaagatggtgaaactctgtctctactaaaaatacaaaaattagccggacatggtggtgggcacctgtcatcccagcaactcaggaggctgaggcagagaactgcttgaacccgggttggggaggttgcagtgagccgaactcacgccattgcactccagcctgggcaacagagtgagactccgtttcaaaaaaaaaaaaaaggaaaacattttctaactctaagaacagaaaatgggagcatgcagaccctgtgagttcaacagctatgctgttcgtcttctcttgttatgggacaaacttggagtgggaaagattagtgctgaggttcagtgtactaagtcttaatttttaccattattgtataaattttgagactgaatgtcaatttagggcacaaaattcattgatgaatttccaaatgacataaactttttcttaagagaattatgacatgtagatagcccaaacctatggcaggaatattaaaataaatttacttaacaaaaatattatggatgtccattcattttcagtatctgtcataatcatccacaactggaaatgcaatattttgcttcttgcaaaagtatactctttgttgaaacctggagtagaagaggtgacaagcacaaaagaaccaagcggtcactactgcaggcactacattagtaagtcgactaattgtgctctgattccacatttccaaaggacttccaaaaggaaaccgcagcagacttccctcagagggccggtggataatttgcctcaccccatccacagaagcacagggagatgggactttgagtcaatatcacagctgaccagtacctacattaagaaacaatctgccaatttcttgtgtacagaatgattatttctcaccctatgtatttgctgttgtgtagttgggactttaacttccaatccattcatcaaggacatcccttgcattttgccttcgttttgttgtaggataatcacaagatcttgaatatcctgtcctatgttcatttatccaacaagcaagtaattgctcagtggaccatgctaggtgtcatcttacaaacaaatatggatgaaacacccagaatttgcatttcataggttcatggaatgtttcagctggaaaaaactaaatacccttgcatttcatttgaactaaaataaaatgtgtgggtattgacaagaccaaggagctgtaacttagaatgttaatagtggtatgtcgtggtaccagtgtgaagttgctgccccacagagaaaatgctgagttgaacattattatggaaactctataatttaaaagtaatcagaaagaattggccaacatcgaaatgtaacacaaacctaatattaagggttttcttaaatgatgaaaggaaatgtcttatgcctctttcagacatttgtctactttgtgtgcgggggaaaaaaacatctgagaatttaactgccatttcaggtatatgctgacaaaaacataaaatggattttttaaagcaaaatggaatggagtctaaaatgagctttgttttttctacgtttctcctggtttctagttttgcaataaaaatttgctttttcctaaggcatgaattttcatttcattcggttattctgtactccttccccatggtcaacatagacttttatcataaatgtgatctctgtccacttaaaagttacaaagtgctttctctcagatgttcacagtgtttggattgaggcatgataaattttaaacaagctgaaaagtatttcaaacaagtcccatgccatgagcaattgtcaagagggcagaggataaaggaagttagctagcggatttctgtgtactcgtcatgcaaatttttcttttaaacatgtcattgatcacataaagcactaaatttttatgcttaaaattctgcttagactagaaacaaaaagcatgctaagttgtgcatgagcctttcctgggcaactcaaaatggaaataaatctatttttgacatttcatacccgatagttattggaatcctaaatcttcaagcctggccattgagagaatgtatcttctgttagagaataagtgaacaatagttgtgtgggttatgtgaagtctgtagattacgagatttaatttctaactttcacatacgtctttccatttttaagaggaccagatttactcaggagatgtcaacagatacgttactacattgatacagtgagtgatgcatacaaactgctgcccaagatttgcacctccagtattcccttttaaaaacatggctgtgcagtgccaagctagagttccagttactgcacagaatgtcacagcaaaatgtggtatacataaggtcacttgagacagcagaaaatagggtagggtggcaagtagcaacaagaagtgcatgttcaaacaaggacaatgctactgtctcttttcaagctatattgaagtcattttaagcctattgtttgtttatgatgagtgaataaaaccaagtattgtggctaacaaagatggctacactatggttttctatactgcatcaggacttgggaaagaaaaataaaagtcagtctctatgtaggagaaaatagtagaagtgtgttagaattccaaaatccctgctattaaaagaaagtataaaggagctacgaagccatgtttaaagtaccaaagatttaaaatagccaccacacttaaggtgaatcataaccttgtctagggatttttattgttgttctatatttcaaatcctggagagctgtacttgacatagcattttcaaggaatgggtaccatttcaaccacttcataagtgcttaattctggaagaattattagcaaataagcaaatattttgtcataagtctcctggtccaaccactgtgagtcccacgtaatctctcttctgcttgctggtcatagcgcacatccctgtcatggtcagtaggtacccaggtgagaaggacgagatggactttttctgtatatatgacagatggcctccagggactgtttatgttcaaagtgacatatttaccttgcctactgttgctgccattagttccttctgggcagaatttcattgccactctgataacacccttctgcattttaacaaggatgttgtgaaactatgaaaccaagaaaactaaacagatacatagaatcaagaatgagttgtaaccaatagccatcactcgtgttcggttccatcctttccttaaggaaggagtttaaaagccaatttactttgaagcaaagcaagttaaagtatatccatcgctccaaaaactaaagagaatcagtccaggcatacaagacttatttcagaaattaaaaatgtttattgagaacggctgctagattcatattgttatctgtccatatgtacctgtgggctaatcataggtagagagagttaagctaaaaaacagagattgagaatgaatcttcactttagaaacactgtaaaaatgcatctgtaagcttagtcttatttaacaattctaatgaacataataattttacatcttcatgatctctcatatccatttcctttattctctaccatcttttcctcaaattactgctacgttttcttaactggcctcttggcctttggtcctaaccccttccaattcatattccacactgcagctcagattgtctttatttcattatttacttgtttatttattttgagacagagtctcactctgttgcccaggctggagtgcaatggcatgatctgggttcactgcaacctctgcctcccaggttcaatcgattctcttgcctcagcctccctagtagctagactacaggcgatgctaccacacctggcttttttctgtacttttagtagagatttgggttcaccctgttggccaggctgatctcgaactcctgacctcaagtgatccagcagcctcggcctcccaaaatgctgggattacaggtgtgagccaccacaccccgcccgagattatctttaaacaatgcaaatctgtacttctcccttctattgcttcaaaattccaatatggaagacatggttttcaaggacagtcacaatctgggccctgttcacctatgccatctcatcttcaccttctcctcatcccatactttacagcaaacttaaactttttccagttacctctcacacactctctctccctgaaagctctcccagctcacctccctgcccttgcctaactagtttttggttattcttcaagtttcttcttacctgatacttcacttaaaatgtcttccctgaacccctcaaaaactgaaatggggccaccttctaggtgtctctgtgcatcctgcaagtacgtgccctagcatagcacctgtcacactggattggaaccatctattcacttatccatactgtagtgattgaattgtggcccctcaaaaggtacatgcacattgtaacccctggaacctgcaaatatgatcttgtttggaaaaagggtctttgcagatgtaatcaagttaaggatctcaaggtgagatcatcctggatatcccaggtggaccctcaatctaatgacaagcgtccttacaagagacagaagaggagcagacatggacacacagacaaggccatgtgaaaacagaagcagagattggaccgatgcagccataagtagaggagcgcctgaagccactagaagccagaagagggaaggaaagattctgccctagagccttctgagaaaagcacagccctgccaacctactttgacttctggcccctagaattgtgaaaaaaattcctgttgttttagaacagttaagtttgtagtgatttgttagagcagcctcaggaaactggtatacaaacctccaattcaaactgtaaattccttgaagacagggaccgtcacactcattacttagtcaccattctctccttagcagctagcatatgcccagtgtacagcatgcatttattaaatttctgttgaatgagtgattgagtgaagacaagcacggcacttcaagcatgatcttatgtcacaataatcattaatcctattctctcactgtctctctgttccaattaaatcgcgtaatcacgtcaggctatattgacttatcttaagttctacctaatatctctcaagaaatgctaataaaaggtaactatgacgtatagttaattacatggggacatctctacattaaatgtaccttattttgcttgatagaaaacatgatttctatagctatagttttaagaagtcaagattcctgaatcaattccaagctttaaattatttcaccgcttaacctgaataaagacacttctagtcagacagcattgctctattcatcaactatttttatctttttaatatgtaaatgatacatgcacatggcaaaagaaattataaaatgaaaagttaaactctctctctctgacttgtcccattcttgtagacaccatgattaactgtctccaatctgtgcattagatatatgactagaaatacatgcttccatttatatacatacatattaattaatgatattacttcaaatttataatgtccacctgtgaaagatggggtatttcctttgttcatttaacaaatattctttgactgctgtattcattttcttgggctgtcctaacaaagcaccttaaattgcatgcttaaaagaacagaaagtcatcgtaattgtggtctagaagtcccagatcaaggtgtgggcagggttagctccttcaattggctctgaaggagaattggttcctttacactcccctagcttctggtgctttgctgctaatctttggcattctttggcttgaagacttgtaggtatattatctttctataggcctttatgttgacatgggcttcttcgtgtgtgtgtgtgactatgtccatatttccccctttttaaggacatcagttgagttggaatactggcctgtccatctctaatatgacctcatcacaacatgactagttacatctacaaaaaccctatttccaaataaagtcacattgtgaggtactggggataacatttcaacataagaattgggagaggggtccagttcaacctataaccagtgcttatgttttgtgccaagcacagtttcatataacagtacaacggggctgtaaattttctatcagaaacttacattctaatggagtctggtattctcatacttgctcaaagcttctccttcataacaacggacgtttattatttatgtcttttttcttcttccagtatttagctttatgaatgtcagttatttattttatttaaaatgcttattcttctgtttgtttgttttatttatttatttactttttgagacaaggtctcactcccatcacccaagctgcagtgactggcacaatcatggctcactgcagcctcaacttcccagactcaggtgattctcccacctaagtctctcaagtagctaaaactacaggcatgcaccaccatgcctggttaagattttgtatttttttgaggagatggggttttgtcatattgcccaggctggtctcaaactcttgagctcaagtgatccagctgccttggcctcccaagttactgggattacaggcgtgagcaactgcacccagcctatttgttgatttattcatttttaatattttagttaaatttattgtctttccatttcaaaagcgtagagaattatgatctctcatactcatttcctttattctctgccatcttttcctccaattactgctacattttcttaactggcctcttggcctttggtcctaacccctttcaatccatattctacactgcagctcagattatctttacttacatatttatttatttatatattttgagacggagtctggctctgttgcccaggctgcagtgcaatggcgtgatctcagctgactgcaacctctacctcccaagctcaagcgattctcctgcctcagcctccctagtagctaggactacaggcaatgctaccacgcctggcaaattttttatacttttagtagaaattgggtttcaccctgttggcgaggctggtctcaaactcctgacatcaagtgatccccttggtccacctctcttctccttcctactgtgtatcttaatttttgttggttgtatgaattttgcatttttacgattttagcatatgtattctatctaatgactattatcattctgtgcttcacctataggataaagattcaaagaccatagcagtctttatgatacataaatattcactccagaacaaagcagtaaaattggacccaaaggaagaagatatagtctatctttaaaagatcaaccaggcaggcatcaagttctaaaagattttcttttacgttctttctattttgttcctgttttctatgttatgcatctttcccatgtccatgttctttatctttcttatattcttatttttctggtttacatatctccctgaataacttaatcacattgtcgtgcatatatttttaagcttttatgggtccttgtttggctcatattttaaccaataatcaaacatatttaactgtctatgctctattttttcccttgagaaactggatgatatttctcaactctcctgtgacccagtattttatattagaagatctatatgtcacactgatgtctgtcttttgtaaataagttgttttgtttgtttttgagacagggttttgttctgtcactcaggtcggactgcaagtggcaagaacatagctcactgcagcccccacctcctgggcccaagtgatcctcatgcgtcagcctctgaagtgtctgggcctacagacacacgccaccacacaggctgatatgtatacttttcttctttctttctttttctttctttctttctttctttctttttctcttcttcttcttcttcttcttcttcttcttcttcttcttcttcttcttcttcttcttttctttctttcttttccttttcttttctttctttctgagacagattcttgctgtgttgctgggactggtctcaagtctcaagcaatcctcctgcctcagcctcccaaactgctgggattacaggtgtgagccaccttgcccaaccagtagcttgtttttaattctctagatagtcaagatatttttcctccctagagttataaaagttatcaaagagcagctttgtttcttttggatgcaacctaatgttaactaaaatctttcaatctgagaagccataacttttatcagcttcagaaatattccttccaatattttatgagtgttgccacctcccattgtttctgttgtttcagcccaaaattcctattagatttttttgtaataacttgtatctatgtctcttaacttccactcattatgcgacctttttttgtatttttgctttgcttattgtgagatcttcttgactcactggaccagatcagcagcttggtcttcagatatatccattttattattcactgtcctttgaaacatttattgttgcagtcatatttttaactttcttattttccttcagttacctagtcaacaaacaaatattaagtgcttaaaatgtactgagcactcttccagatggaagggatacaaaataacatcttttctccaaaggacctactttctacaggagggaagcataaaataaaacagtaaaccaactaaggggtggaatgaactaataagagaaaagaatcagagtggaatcctagaagctgggtgaaaaagctgtttctgaaaggaaagtaagatcaaatgtctcaaatgctatgcatagacccaagtagaccagaagaaaactgacatttgataacaggaggccaacaggccagcttgtttaggcaagtttttgtgggagcatctgcttattttcagtgggttcaagaacaaaaaggagaacgagaattgaagaaagtgagcaaagttatgtattaaaaattcaataattgctataaaagaaaacaaagaaagccagagagggatttttttaaaataattgtattgggagatatttgaacattatattggaagctgatagaaatgattcagtagaggaaatattattgatacctgaggagagacagttctagcggtgatagccttgaactgatgagaagggatgggatccagggctcggaggaaagactgggcttagactttagctaagagttcatcccttaacgggatgtcttgcattttttagctatgagttcatctttgaacagaagggctagactttagctaagagttcatccctgaacaggagagaaggtgaagaatatgcactgacatagattgaatatgtgtccctgtccaaatctcatgtcgaattgtaatctcaaatgccagagttgggacctggtgggaggtttctgggtcatgggaatggatccctcaggcttggtgatgccttggtgatagtgagtgagttcttctgagttctgatcgtttaaaagtgtgtggcacctccacctacccccttctctctctcactcactcctgctttcatcatgtgatgtgcctgctcccccttcactttccaccatgattgtaagcttcctaaggcctccctgagcagatgcctataccatgcttcctgtataacctgcagaaccataagccagttaaacctctcttctttataaattacccagtctcgggtatttctttatagcaatgcgagaacaacctaatacatggacggtgttctctgcctggttttccctagtaccatgttcatgttttacaaatgtaatattttctcaaatctctctgaaaatactaattacagggattctcttagaggttttttaatatgttattggtattacctgaatcattcctttttgtgtagcagtctgtttctctactattgattttttttttctaacgatttagtgatcttggttgatctttcctagttatgactaaagaaaattggttgggtggttaggatatgatttctctatgactggtgtaggaatatattatttatgtgtcttcatttctcgtctccatcccatccaaatcctcatctcagcatgtagaagtgatatgataaattgtttgccatctctctggatccagtattctctcttatacaagctcattctacacagtctaatcagatttaatcttcctaagaaagcatcatcaccagattatttccatttgtaaaagcactaacctatgtcttggttttttatcaaatgtagatcatatttcccagcctgcatttttaaatcctctgcgattagtccttgttaaaatttgaagccctactctcactactatagcaaagtcttatagaaatacaatgtacatccgtgctcctggtctcccacgggctcttactgcttctcagtagtggctgtacatacctgattacctcacaccagcacttaccgcgtaactgtttctgtgtcttccactttctttaaattaccaaagctacatcttccacgctgtcttcttgaagatatcttcactgaggaaggaagaaaaatgaatggggattagtattttttttttcatcttgtttgagaataaacctgaggccctgatttggggttactacatgctctttgaaggcagagagcatgtgcttcctctgcatagcttcagtaactgacatggaatagtgagaaataggaagctgtctagcagacggatgggtgaatagatgcacaaaggagtgagtccatattccctaagccacaatccaccatacaactctctgttttcagtaaggttgatgtaggagaaaagcacaacttcccttgctatgtacccagaaaaagagaaaaaaattcacttactgtgctgtcttcttatgtccttggcactgatattttaatcatcttctttgatttcacttacatgaaaaggtgtatcctacaataaaattatgataatttgcataaatatgtacatgtgttaattcaatcactaattcattaattcagtgggtttttttaccgttgaacatttgtcattgtgttcaaagatgaacaagatattcaaagttgaataaatgattgtcattctcctcaagaaactaagaataaaaacttataagaaaaactttcataactctaacatcttatggcacatgttcctttctattcattctggtttgtctggaccactctggtctgagtctgttgtttccacatcctgcctggttagctccccacgtccctctctggaatgtccgagttaggtgataaattacatggttgactatgtattagccatactaaaaaaaaaaacactgcactgtatgtggatgtgaaaatgaaaatatgtctcatctcctcttcaaactttaaacttcttaagggcataagaaaattatgttcgaattactgaaatacacttgcttatgttttcaatcttcctaatactttcaaaacctcaatccagattttttaatagagattaaacttgggataattagtataatgatttaaaatatcacgaaacaaggctattatcattggatgttcacagaaagccattaaaaacttttataaagcaatgagtgatgctaatcagggttctgaagcagtattataagcacttcttatttattctatctaaagcacaaaaagtgtaaaatgctttttgctttcaaccggatgtattttcctcatcacaattaacccctgcagtttctttctgcttcacgaggcaacctacttacttctcctatgccctaagaaatggtaaacattatcttgtggaagtttagtttcacaggttcagtattcagtggagaaatggttatgaaataatgacccaagtatgtgggaactgcagaaaataccagattgaagggagtgaaggcagtttaggttcattctcgtcttaagagtctgcataatttcactctagttttccaagatggcatgcatagtctccttcccatcacaagttcagttcttgaccccacacagccaacacttgccactcactgcagcctcacttttagcctcatgtacctcagtccttagtatgttcttctagggatttgagtaccagcctcagggtttgtattttccccagttcacctccaagctggaatacactgaggaatctcctctggaagagagtttgtggtgacagttatgtctttcttttcgttgtgaaactactactgtttataatctatattttctatggtcgctattcagaataggttattttattcactttctttgtttaattcactaagtaagtccaaaaatctccatggcttctgggcacacgctaagaataacaggaaatttattattttaaccactgtgcttagccagaaacccaatataaaagatggccttttactgggccctcaaaatcagaagattaaagtccttttgaaccagaatggaaaatcaatattttcttcaaagtaaagatttttttgaaataaactttaataattaagatatctgtgctatatcgtagggaacacctttttttaaaggctgttttaacaaaattcaaccctgatataaacgtttgaggcatgacagaaaaaacagcaatcaatatttagaaacttattttctttttaaactgaaattatgatctgatctctttggcttattaaaaaaaaatgtcattttgctggatgcagtggctcacagctgtaatcctggcacttagggaggctgaagtggatggatcacttgagtccaggagttcaagaccagcctgggcaatatggcgaaactctttctcaacaaccacaaaaatgcaaaaattagctaagcgtggtggagcattaactgaaaagtccacagtcctaagtctcatctgagacaaggcaagtgccttctgcctatgagcctgtaaaatcaaaagcaagttagttacttcctagatacaatgaggattcaggcattgggtaaatgctgccattccaaatgggagaaattggccaaaacaaaggggctacaggccccttgcaagtccgaaatccaatggagcagtcacatcttaaaactccaaagcgatcttctttgactgtatgtctcacatccagatgaggctggtgcaagaggtgtgttcctatgatcttgagtggctccacccgtgtggctccgcccatgtggctttgcaggttttagcccctctcccagctgctttcacgggctggtgttgagtgcagcttctccaggcacacgatgcaagttgtgggtggatctaccattctggggtctggaggacagtggcccttttctcacagctccactaggcagtgccccagtagggactctacttgggggttctgaccccacattttccttctgcactgccctagcagaagttctccaggagggcctcacccctgcagcaaacttcttcctggacatccaggtgtttccatacatcctctgaaatctaggcagaggtttccaatccccaattcttgacttctgcacacccacagactcaacaccatgtggaagctgccaagacttgggtcttgtaccctctgaagcccaagctgtaccttggctcctcttattcatggctggagcagctgggacacaggccaccaaatccccagactgcacacagcatgaggaccctgggcctggcccacaaaaccatttcttcctcctaggcctctgggccattgatgggaggggctgccatgaagacctgtgacatgccctggagacattttccccactgtcttggggattaacatttggctcctcgttacttatgcaaatttctgcagctggcttgaatttctcctcggaaaatgggattttcttttctatcacattgtcaggctgcaaatattccaaactttaatactctgctttctttataaaactgaatgcctttaacagcacccaagacacctcttgaatactttgctgcttagaaatttcttccaccagataacaaatcatctctctcaagttcaaagttccaaaaatctctagcgaaggggaaaaatgctaccagtctctttgctaaaacataacaagagtcacctttgttccagttcccaacaagttcctcatttccatctgagaccacttcagcctggactttattgtccatattactatcagcattttgggcaaagccattcaacaagtctctagaaagttctgaacttttccacattttcctgtcttcttctgagccttccaaactgttctaacccctgcccgttacccagttccaaatatgtttccacatttttgggtatatacagcagcaccccgctctactggtaccaatttactgtatcatggcagaaggaagaagaagcaagtcacatcttagatggatagcatcaggcaaaacaagagagcctgtgcagggaaacccccgtttttaaaaccatcagatctcgtgagacttattcactatcacgggaacagcatgggaaagacctgcccccatgattcaattacctcccaccaggtccttcccacaacatgtgggaattaaacatgagatttgggtggggacacaaccaaatcatatcagccactaaagaaggacttcaagaattctctactgaaaacctgtcttcctgtttccatgcagatggtatactcataaatagtacctgaacactgggtgtctcttcctgcacatcaagtctgcatatcaccccctgacctgcataataatagtcagcaccacaaacagtttagcccttggtggttctctaattccttctgtgtctcttcaactataacttcttagttcaaaggtagatatttctttttttccttactcttattatgactagtattcaggtactcagtaaatatttatttgttaattgatagattatctgtagtgctgagtgaaatgtttaccctgcccaaaaataaagaggaagaagaaagaaaataaatttataatggctatatacttacacagcacttgcagtaataccctcattaaaatgattagtggttataacacagtttaattatttgatagtcaattcctgcatttcttctgaatggggaatccctcctactaggaggaacatttgaatcactctgatttggcaaatggcatagtcttgtttaagacactagcattccctgccaattgaggcccaaggctggttcttcccaatgaaacatgaaccagcagagcatgagggggtttcaactatgtcctaggggactactactaaagatttctggggacacaggccaattctcacagtatgtcaaggattccgaaagattaatggtcatttgtccaagatatggaatgaatttctacgcaagaatatgaatcaatttcaaacagtttggagtaagttatagaaaactaaacattggataaaaacagaaatatatctacaaaatttccaccttctcattccctcactcattcccctcccccaagaaaatgaatgaaccaacactcccttcatttaatgtacatatgtgtgtatacacgcatttaaatctgtactgagaacagcaatcttttcttctggaaggagactcagattcctaaggggaaggatattgctctcagtctctcaaccattccctgggaaagttaaaaataagtcctgctgaaaaaaataagttggcgcttgttatttgagaaaattgctttattccaggaactgcctcatgtagcagaaatttatttaccatctgtgtggactttaaaaattttccatcttaactgatacacaactgaaatagaaacagactttccgtgcgtaggttttgcacaggcctcaattttttgaagggtgttagctcagaaacttttgggatttttgtggtccccagagtgggagagctccatggctgctcctcggccttgagatctccttctggggaagagcccaggctgatgtcacccagtgagcttgggagtggcttcagcgtgggggtggaagggagtgagataggatttgccaggaagcattccagggactttgctgaaaggctgcttttctttttttctctttctctctttctcctttcctccctttcatcctgccctttctctctcccttctctctttttttaacttttattttaagttcaggggtacaagcgtgggtttgttacataggtaaactcgtgtcatagggttttgttgtacagatcatttcatcacccaggtattgagccttgtacccattcgctatttttccttctctttctatttttccctccctccttccctccctccctccctcctttccctccctcctttccctgcctcccttccttccttccttccttcattccttccttcctcactcttttttccacaacataaattgtatataccaagggtgtatgacagtgttttgctctatgaatacattgtggaataatggccacaatcaatctaattaacatatccatcaccttatatagttaccattttctcttttttttttttggtgagaacatttaagacctatcctcttagcaaatttcaagtatacaattcagtatcgttaactattttcacacggctgtacgttaggtctccagaatagtatccatccagactaattaaaactttgtaccccttgatcagtgcctccccatttctccctccccccaacccctgacaactaccattctagccaccattctactcactatttctatgaatttgaccattgtagactctaaaaataattgagaacatgcagtatctgtctgtgtgtggcttatttcatttgcatactattttccagattcatccatgttgtagcatgtcaggatttccttctatttttggctaaataatattccattgtatgcatgcacgtgtatgggtgtgtatgtatatcaagttatctttatccatttgtccattcattcattgatggacacttaggtgtcacttggctactgtgaataaagctgcagtgaacatggggtgccaacatcttttcaaggtactgatttcctttcctttgtatatatacagagtagtgggattgctggctcatgcagttctattatccattttttaggacctccatactgttttccatatggctatatggctatacttttttccatatggctatactaatttgcattcccaccaacagtgtacaaaagtttccttttctccacgctttcaccaacacttattctaataaccatcccaacaggtgtggggtaatatttcactgtgcttttaatttgtatttccttgatgattagtgatggcaagcacctcttaatatacctgttgaccatttctatgtcttctttggagaaatgtctattcatgtcctttgtccattttttaatgaggttattaggaggggtttggctctttggggctttctgttgtttgtttggttgttttttatttttattgagttatatgaactccttatatgtttagataggaatctcctaatggataagatatatggtttgcaagtattttctcccaatctgttatagttagctagtacattgtgcttaaaagataaaaataaaagccctttgagaaataaattaccttatttctgaagtacttttaacttatgtagtcagataagacaaatatgctttcttcctttccagctgtatcaaaggattattttattcaaaagttttattaaaatattccacaagaggaagtaatggttcaccaaagggggaaaaaaataaggttgaatgggtggctgagcacaagggaatttattgttagatggtactttatataaatgaaataaaaattgagggaaatccaaatgccactttctatacaaaataagctgccctgcctggctattttcccacaatattgagctgtaataccattattctggagggcagaaactagaatttcttatatatttaattttcttcataatatgtgctttctcttcaggaaatctcagaatctttggggcatttgcatatccacatagactttcagcaaaacaatatgtttttctagaaaggcattgtaacaactattagaaggtcaaaatcataccaagttatgtagtctatatatctcaataatatctttcaatcatttattattgcacatttttatgcttatcttaaccttcaaacacagatttcaataaaacttttagggaatgaaaaattatacaacatatctatcatttacctttgtgaatatctataattcctgcgatttgaataattactatatgtcagccccaagcctagactctttatgaacagttttgcttttaatggccacaatgtagaaactggtacaaattgatgaaaaaactgaagccctgaaaaataagcaaccttttgcaggccacagagcaattcagttacagctatgactcagagctcagggagtcagagctccacagaccattattctgcccatggtacagacttttggaacagtcactaatgtgaaaacccaatcttaatggcatatatagaatttatttttcaaagcagtattgatctcagtttttaagtctttaaacacagaaaaatttagagctttataataagaaaaatatccaacgtgagctagaaaaggaatgatataaactcaattaaaatgaagaaagaaaattattaagatacaagcaaaaatctgggaataaaaagcagacacaggctgggcgcggtggctcacgcctgtaatcccagcactttgggaggctgaggcaggcagatcacgaggtcaggcgttcgagaccatcctggccaacatcgtgaaaccccatctccactaaaattacaaaaattagctgagcgtgatggcgcatgcctgcagtcccagctattcgggaggctgaggcaggagaatcacttgaacccgggaggccgaggttgcagtgaaccaagattgcaccactgcactccagcctggcaacagagcgagactccatcttaaaaaaaaaaaaaaaaaaaaaaaaaaaagcagacataaaattgggagaatcaacaacaactaaaaagccaatcctttgatttgaaaactctacagataaatgaatatgtcaacctccatcaaggtaagaaagaagaaacaaataatattagaaataaaaagtggcagcctgacatgctgatgcacctctgtaaccctagcacttcgggaggctgaggtgggaggagtgcttgaagccagggatttaagaccagcctgggcaacatagtaataccccatctctgcaaaaaatttgttaaattaggcaagcacggtggtgcacatctgtagtcctagctatctgggaggtggtggattgttagagaccaggtgttcaaggccacagtgacctatgatcccaccaccatactccggcctgggatcataataccagactccagcctgggcctcagagcaagacagaaaaggagaggggaggggaggggaggggaggggaggggaatggggggaagggaaagagagagaaaagaaaggaaaaaagaactattattaccgatgaagtaaagattaagaaggtaagagaatacgatgtaaatgtttaagttaataaatttgaaaatttaaatgaaatggacaaattactggaaaagtattacttagctaaatggaattgaggaaaattataattttccaacactttttccgaaagtgtttaaaattcttctataaataaaatgccaagtccagatgattttacaagtgaattttaaccatctttgaagaaacagattctttcgatttcttgtaaactcttctagagaaagaaaagaacgaatgtcagtcataaacataggtgcaaaaaacaaaacataaacaaaatattaaacagattcagctgcataaaaccacttaaacaccttaaccaaattgggtttatcccaggaataaatggaatgggcattttactattagaaaaatctatatatgttattttaaaatttgtataatacttattaacagatgaaaggagaaaaaaatttatgatcatatgaagagatgcagaaaaagtatttggaaaaagttgacatctattgattgattaattgatttgggacaggagctgtctgtgttacccaggctggaatgcagtagcacagtcatacctcattgcagcctcaacctcttgggctcaagcaatcctctcacctcaacctcccaagtagctgggaccataggcacgtaccatcacacttggctgattttttgtaaagacagggtctctctatgatggactcaagcaatcctcccactttggcctcccaaagtgctaggattacaggtgtgagccactatatccagtccaacatccattaaaaagaaaaaaaaaggaatataagaagagactagaactaccttaacctaacaaattgatagctacagaaaaaggagaggggaggggagaggaggggaggggaagaagagaaaactctaacaaatagcattccaaatgggaacatactatcattgtctctcttcaacttgaagtggaactacattccaacggggcaggtgaaaaatcaaatttttgaagctgattgtctactaagtaagccctctaagaataatcaggcaattatttggaaataagaaaaggatttagcaaacctgtgaaagtttagaaaatgtacatttttaagattgtcattttcaaaaacaacaggaactgtaagttacaaaggagtaaatctttatgtgttgtacatttgcatgttattcattggtgtaggaaatcaatgaaacatgagtgaaacatattaaagaagatctaaaataagtagagggatatgtcatactcacatatagagtcaataacgtggaggggttttttttttgtgaaatagtagacaaccactgttaactgactctgacatttgatgtattagacttttcagttattgccagtctacagggtgtaaaacggtacctcattatgactttaatttgcatttctctaatttccagcaagtttgagtttttaatgattaaaaaataaagcctgaaaaaatctaatgtacatagaactttggtgtatgataaaggtatccaggaagatcagttaggaaagagatatattttttacctctaattttgtgtcgtagtttctcttagtacagtggcaataaactctagccctgctctgatggggctccagggaagatggttgtggatgtttacaaggtgcctccatgggatacttcattaggtagacggcctagtatctaagtatctgacctgtgaccaggtatctctcccacaggaaatgttgatactggcagatattcttctggctcttgtctaacgtgtgttctctttatttctaccaagatagcgactctgtaggagagctctggccaggaggagagttaggttagagtgtgtcaagtgagacacagaggaggcaactcaacaaaacacatgaaacaacagaagtgttttattactcacagatcacagagaaagagggcagcacccttgcagggccaacaggaagtgggggtattgcgtccagaacacgcaggctcagcgagcaggtaggtagcaagagagagaggaagtgacctgtggatgatggcctttattggggcccggggtgttacctaagcaggattcccatgggggttctaactggtaggtttagaacaagcaggtgtgagctctgtggagtcacattgtggctgtgtgcttgtcgttgcagtatatctgccccgtctatgcccagtgaggacatcagtggggtgagtcaagtaggttgcatctagctgccccctagggaggaggtcaccaggaggtggttgtataatctgtataaaggcaggtatctggattgatcaccttgaggaaatggaaggttgtagaaactggaaactgtgtcaagggtgacaaagtcctgattctaactaaccctggttctggtatgagaaccaggacattggttctcacagaaccaatgagaggcattggaggggcatatggtaaggagttcataaataacatagaaagaatactaaaaagttatttcttagaaaagatggatatatttgaatatcttaaaatttagaaaatctatttagagaaacacagtataaggaaataattttttaaaataaaatgacagtagaaattagcaacatttagaaacaaagaatagtattcaaatactaatgagaatgtcctttaaaacaataaaaaaatacaaataacccagaagaagaacgggcaaaaaaatggatattttatagaacaggaaacccatattgacaataaataaataaaaagaatatcaaactcttgaaatcagagaaatgcaaattaaagtcatagtgacgtaccatttcactctctctagattggcacaattaaaatgtcaaatacaccaagtgccagagtcaggatcaacaggaactccctatacattctaggtatcaatataactgatacaataatattaggaaaaaaatttggcattatctcttaaatgtaaccattcacatactccaaaaattaggaacttcactcctagaagtgtgtcctagaaacactcgattttgttctccaggaaaggtggacaagaatattaattgcattactgctcataataattaaatactagaaataatccaaaagaccacggacaacagaatggacaaatactttgtagcatatcaatacaatggcatatcatacagatatgaactcacttaacttattcaacctacaacactagaattttgtaaagtaacattgcagggagctatgcatggtggcatgcacctgtagttcaagctactcaggaggctgaggtgggaagatcagcccaggagattactaacagcctgagcaacatagtgagtccctgtttttaaataatattgatataaatagtagtagtagtggtggtaatgttgctggcagtaatggggtgagtttccaagtattatacatttatatagctgtaaaacagcactaactaaaaccttatttaagcataaatatatatatatatatatatatataaatatatatatatatatataatttaaaattctatattttttaaaaaagcaagtaataaaaaacaaaaccaaaaaaattagtggagggttattccattgagggaggtggggacaggagaggagaggagcacaaaggtaaatggaagtcattggtaattttccatttccatggtggcggggggtggattcacaggggatcattgtaatattatgggttataatttacatatatgggacatatgtttcgtgtatcaactgatgtattaaaaggcaaaaaagagaaacatttaatgtgataacaaatgtgattgcgtttaaccataaagatttaggcagttttttattgctgttctttaaattgttatttttgagatttatgtttcctaattagattgcaaatgctcaaaggcaaggataatgacttataattctaactaacacatggtcaagaggatacatgaatgcattcagtcagtgaaagaaataaagagtagctactgttgcttttgtgtaaatctcaattacctctgaccctgggcacttggccttcttcaccacacatctagccctccagattaagaagacaaagatccatctgcctaaaaagcccagggttttaagaagctttgtttctctgtgtcctccaagaaatccaacaacaaccctgctggtttcccccggcctcagcccacatcaatgtgccctgcaatttttttcttgcattttgcctatatcttgagtctttcctaactctgggaaaacttttcactgtgctcaaatttcatctttttctctcttctttttatttcagtttatctccttcacttatttcatccctggggctacagacaaggaaataggttagctccatttttccttctggctctttctgagctctttcgtgtccccttgaaaagaacttttactctctccccagatggtcctctttccctaacagaaactctctagggaaggatgataatcccagtctttaaagacataggtcctgggaatccggcaaaaagtcaggttcctgtttcctcatcagagaataataagccaaaaataataactatgagtggctattagaacaacgtcctttccccatgaccagaagtgactagccccaatttggagcaaaccaagcacaaaagaattcttgtgtctattttatgagaaatctttaccaaattcactacattcaacaggcctatttcaaaggtaaacacaagtaaagccttttcatgaacaaacatccataagaaatcaatgggaaaaacaccgtaggaaatattctgttagtctgaatatgtatcagacttttaggtatatttattccttaaatcagacctgaagaaagtactccatgtcctaacaggtcttatttttaaaatattctctttcaatgattaatctctgttaccttacagcaaagaggttacaatcacccaagtattattctcctttgcagctaatagaatctgaaacacttgatcatgatcgagatacaaatttcagtaatcatattcccacaagaactgcaaatctgacagatattcagtcacacctagttactatgataggtaagtctgttgtgtagttccctaaatgccggcaaccagataaaaaaataaaataaataaataaataaaaccagctcataaactacctttgcttgttttttgtttgttttttaagactatgtaagaggctatgttggatagtcaatatatttcagtttgaaattgccagatgcatgttgcctgtgattccaaagttttaaggccagttacttctgatttatttttattctttgtgctaatgatacctatgcatcatcataagcaacaataaaaccataggggtagctatagcaactgatacactatgcgttcaacgttcttttttaaacactgctggaagagagtgagctcttcactaccttgtagttaccttgattccaatctggtgaatgtcttctgttttccaaaagctgtttaacttagatataaagaacagacatatctgcaataagaacaatttaccaagaataagaatagtaggccgggcgcggtggctcacgcctgtaatcccagcactttgggagaccgaggcaggcagatcatgaagtcaggagatcgagaccatcctggctaacacagtgaaaccctgtctctactgaaaaatacaaaaaaaaatagctgggcgtggtggcggacacctgtagtcccacctactcgggaggctggggcaggagaatggcgtgaacctgggaggcggagcttgcagtgagccaagatcgcgccactgcactccagcctgggctgtcgccagccagccagactccgtctcaaaaaaaaaaaaaaaaaaagaatagtaatggtattttattcctcttgttcaggatacattgtcagccaagttacaaaagaaaagttcccaggtggatttaggggttttcagacatccttgggtcatatggcatatgttattagacactacaggataaaatgacaaataaaaaattggtaaattttcaataaaaattttcttgaatgagtttggatagaatttgtacaaaataagttgaaaatatatttggtgaaccatgaggcgtctggccttgcagtggtaattctgtgtcctcctagaaaaaggctggaggtgagcaacaggaagtctcattctgcccctactattcctataatgtgcccatcccatttgtaatacaaagatggaacagagaggaacaagaagaaagatcgtaaaacggggctttctctccactactgctgaggtgagaggagcaagatatgaccagagataaatacctcactaatattgttgctggtagatccacagaagcatcacacagcatgtcacaggctgcatcctcaaatactgtgtgtattaacttaattatcaatgaggaagatagtacggggtaacgaagagcatcggcatcagagaggagagatgaggctccctctgccactacttagctgtgagatcctgggtgggtaagtcattgaatctgttccctatcctgtagaaaagacagagggaatggaacactttgcggagaggatgggcatggcctgggaccaagcataatttgaaactaataataaataataataaaccaatagtaaataaataaaccaataataattttatatctcagaaaaggacaaaaactatcatcatcattattaaaaactacagaagataaactcaacaaaaatcttgtctgatggaagttgatagactccacagtgtttatcacctaaaggcagaggcctgcccttggcagggcaaggacagaaggggtcaggcagggagaggcaaatacattaatgtttataaaggggtggagggaagctcctgtacatgtttgtaaatgttcagacatattgtgtggattgaaataccaaattttcatgtaaagaaatggagaaatctccataagacacattggtatgggatacaaataccctggcatggtagcttccctcattatcatgttattcctacacatattttgctgtcattgctgttgagacaggctcttgctctgtccgccaggctggggtgcactcgcaccatcatagctcactgcagccttgaactcctgggctcaagcaaaccttttgcctcagcctctagagtaactgggaccacagatgtgcaccaccatgcccagctaatttatttctttgtaaagacagggtcttgctctgttgcccaggctcatctcaaattcctgggctcaagtgaacctcctgccttggcctcccaaaacgctgggattacagggatgagccttggcacccagccctacatatatttttacacgcacaggaccctgtttttcccctcacactgtgaaataagccactgtaactccatagaggaaagaaaactgtttccagaatcaacgcacagagcacaggcgcttattgcatgcactgcgattcctaagaatgcctggctgtaatatcagacgtaagccccacatgtgtagtaactccttttacccttgcaaaggcaggagtctgccatcaggaaagatcagcagaagtgtctatctgcgtccctttattttgatccacaccatcatttccccccagagtatctccttgtcttttctcttgtcctttcctggaaccctctactaccacagcttcactctcataccctttagggtgacacttgttgccttggactgtaaatgcttccttactttgatcctaccctaggagatattccaggatggagatggatttttatttgcctttgcaaagcccacacacaatcaggtctaaatatcttttatgatgactgaatgaatgaacgcccagaacacgtgcagtgagcttacggtgaatctgtacagaagtcttttagtaagacagtcaatgttcatggagctgttataaaaaaggaagacattttgcaaggagccatgggagatgaaaatttgtatgcagaggagaaacatagtcttttaaatgctgtgaggcaatcagagagatgggccttttccaatgaggacaagcagtgtattttagaatcccccaaatgatacagacaatacacatcaggataagacatatcaggtaaggattcatgtgctcatgtgctcaaccattcttgatcgagagctttattgagttcctaacactgccttagatgccagtcctgcagcagtgagcagaatcacttggggaagtttcagagggggcaagatgaaataattcaattgaactgaagggtgggtagcttcagacacaggcagagaagaaccaggaggtccttcccggcacaatacacacaaagcgatattgggcgagatgagggcgtgtcaccaggccaccctcctactcataaaattataaaaagagttgtgcacagaaacctttttatagcgtgtgttatgtggcatttgtattcttcaagttttattatgcttattcacaggaagcagtttttccataacatttccttttttttctaaaaatcaaaggggtcactatttagaccggatgggaaagggaaatcataacagcagcccttctggaacttggctgtgcgggagaagttggccagagaattagcatagaccatgctggagtggcagaactgggggtcctggggcccagggctcaccactgtgcactcccagcccctgcccccattggaacacagcgcagttccaatgaacagagagacaatacttatttctctaagagaaaaactgaaaagcctggtaattatgctcaaaagagttacttggtcattatacagctacgaggaaggagagggaaaaaacctttctttcacaacttatttattgacacaattatctgaaaaataaaatcaggaagaaagccatggcttggaatctttttgaaaagaccaccttctgacattgggatagatccagagaaggtcaacaccctccacttcctgtcccagagaaagagaaaaaagacacagaatgaaagagggggagggaaaggaagaaatcagaaaaacacagaacttcacagagcttagaaattctctagagattaagaaaaaaaggaactttcaagagaactaatttttagcagttctctaaaagttcaagagaatttttagaagtgctgcttttagaaaatcaaactatggttcattaggttatttaaaaatcatatttcattattaaatattattcattagctggatgcaagaaatagattgatgtgtggtcatagaattgaatcaaaatttttagctggttagtgagttggactttaatctacaaaaaatgctgtttatatcacatgaggatttatctttcatatgctattgtgcataactaatttccaaatcaagagtaagtaaactttttaagatttttaacaatagtcataagcgcatctttttttttttccaaatgaagaaagactgtgggcttggttttttagattattttatattacacatatggaggtaggacagtagtgacagtgtccccaaatctgctttgagggaaagaaatcataattatggatttagcccttatttcaaaaggttatttgaagtattttcacctactgacatacgaagtgacagcaacatttgtgatttcataattgtagtagtgacttactatcagatgactgtttttagacattgcacagtgtgatctctgtggtaacagagagcaaagtattattttggagttttttcaaatgccaacttagcatttcaaataacaagggaattacttaatgagctcactctatgttagaacattttgctgactgtatcttaccaaggctccaaaaaaatcaaaacttcaattagtagaaatatcaatgggctgggagttaagaattctgtgctctaattcttactcagtttaattctgggaaagtcacctcattttttgtgctcttatttatggagcaaggttaaagtttcttccaactctaaaattatggatcttgccaaaattgctccatcaaagttacacaactaatggtaataaacataacactcaaattttggctagaattaaaaatttttatctcagataatttgtctgttaaagttcatgtatgacttaaacattgtgttctatagtgtctagactctttctactttcttttataaaatggattccgtactgattgctttagattctagcactgagagcctttaattttcacatactctcagtttttcaattattaatttactgtccaacttcgtggtctgtgttggtccttcttgaacctattctatactttaataaagtatttcaaaaaagataataaatgacaggaatttggatcaatgataaataacttctcttttcagctattcccacactaccataatacagaggcaaaaagtaaaggtttaagaaattcatgtttttcttccttctacgcaagcaaaaatttgatgctaccttggtggggcagggatcatcgggaatcagggctgctaaattgcatcattgaactaaaccacctgactccaaagaagggattgtgtgtactgtttttatttctttttttttttttttttttttttttgagatggagtcttgctctgtcacccaggctggagtgcagtggcgcgatctcggctcactgcaagctccgcctcccaggttcacatcattctcctgcctcagcctcccgagtagctcgggctacaggcacacatcaccacacccggctaatttttgtagttttggtagagacagggtttcaccatgttggccaggatggtcttgatttcttgacctcatgatctgcctgcctcggcctctcaaagtgctgggattacaggcatgagccaccgtgcccagcaacatcatctaactttatctcttttgattttgtttctaagaattttccaggcattaccaataatataacatagcatgacaggagcatattttatactatatagtaacatttactaaacagaatcatattttatataattcaacaaaatagacagtggcttttaaaataatttgtcttcattcttccattcagtagacatttgtcaaacactcattgtgagcacggtatagggctagatttagggaaagttcgcaatattctgacaaagacagacacatttgagaaaaatactaagtgcaaccaaaaggccgacccagggaaatagaattgaatcaaaaacaaagatttttaaatccaatttgtcaatgtaatacagattatctaagtggtaatgaaggttgtgttctacaactggacgtttccagtgatgacaactacaaaataagagggcaccatttgaccacattgataaccctgccgatttaattgattttctccagcttgatatacagctgcaccagtctttgtcagcacctggaaagagtactataatcacagctaagtcaatggtagtagaatttgtctttggagctgatctcagcattcaaaccaaaggccctgcaaagcagtatattatggaggggggcacggtggctcatgcctgtaatcccagcactttgggaagctgaggcaggtggatcatttgaagtcaggagttcaaaaccagcctggcccacatggtgaaaccccatctctactaaaaatacaaaaattacccaggcatagtggagcaagcctataatcccagctactcaggaagctgaggcaggagaattgcttgagcctgggaggcaggagttgcagggagctgggatccagccctgcgctccactctgggtgacagagtgagatgctgtctcaaaaaataaaaataaaaaaaaaaataaaaaaggaagtagaagtatgttattggagatctactacctgtcaactcccacaagaaagaaatgtagcacataattcctgctttcaagggcaatataggcaaggcaaaaaaactttcacatatgaaactattggctggtatccaacactctgtgatgctgattgtgaaagcaaaaataattgagaagaaaaagggcagaatacagagaaatcatacagcaatgcaacattcagtaaccatctatagatgcaaaggccaaaatgtttagaaactaaactgaagttattagggatccatggaccccagagtaagaagccctaatctaagattttgctgttacgggaaactctgctgcaaatctcgaaaagaaatgatgcttttcccctttgacacaaagctttttaattctttagaacactctttggaagacaacacttgttgaattagcaaatgaacaaatgaatgaatcaacaaaattaacacaaatttggggctttcagactgaactttgttatctacattgtttcagttccatatttgtatttatttttcttgtatttatttattttttgagacgtagggtcttactctgctgttgcccaggccagagtgcagtggcatggtcatagctcattgcagacttcaatctctgggttcaagtgctcctccagccttggcctctcaaagtgctgggattacatgcatgagccaccttgcctatcctcgaatttttataagatgcaacttgactgaaatgacaactattaagtgaaatgacaactgttgaaaagagaaaaactaattttaggcacagggtggccagagaagaattcactgagaaggtgattttggagaaaagactgaaagagataagggagagagccagttttccagatgggggtgaaggagctgtagagtcttcccgaatagcttgcaggagatgcttgagatggaagctggggatgcaggtgtgtctggagcagagggaggtagatgaagtctggaggagttaaggccacgagatgagccagctgcagcgacattaggctttggagaatctttggctcctgttctgaatgtcatgggacacttggagtgctttgaggagaggaagtgtacaatctaacacatgcattttaacagaccggccaaggatgtttctgtgtaggcaattgtgtgcaatggatatacaattgtgtgcatctgtacatgtaagagtctgcttaaatgatgttacctttttccctttatcaaaggcaaatattttcaattcatttgtaatatttgctttaataaataaaaaagaatcattttgtttgatttatatgaaaagtgtgagttatgaacaatggagtcatttcacacctcttatctaactaatttatttactcattaaatcattcaacaaacatttgttgcaagtctaccgtgtatcaggcacttggcacatggagattcagtgaacaacaaaaaaaaactagatctcagatttcaaagaagtcccaaacatgcttatctatctccaaaatctttaccacctatataccccacaacaaatggtcccaatactgcatgctctacaaatattacaaaactcttggccaggcacaatggctcacaccctaatcccagtgctttgagaggccaaagcaggaggatcacttgaggacaggagtttgagaccagcctgggcaacataaggagacgctgtctctacaaaaattaaaaaattagctaggcatggtgactcatacctatagttccagctacttggccagctgaggcaggatgatcacttgagcccagaggtcgacgttgcagtaagctatgatcacaccactgcagtccagcctggatgacagagcaagaccctatctctgaagagaaaaaactaaacaagaaactcttgtatacctccttctttattatgtacccatcaggcacatttgttccaagtctaactccttctttctctgcagtattgttgaaatttaaatattactttttgccttgttaggaacttcatggaaatgatcttttaagaaaataatgtactttgtgaatatgttttatatatgaattatagtattttaggaagacaggaactttttttttcccctaagagatgtttcaaccaagaaaatcaatttttttccaactgcttcttcattttctcatatttcatgctggttttctttacaagatttttttttaatgctcatgaaactatgaccttgtataagtttcccaggagacatgattctcagcattttgttggacaaacatttgttttttgtaactacatgaacaagccaaattgcacgtagtccaaaaaataattctggcctttttaactacactctttttctttttaatgccatattcaaggaatcccagtacagtggcaattaaaacatgcgaattttgccatttaaccatgagaaggatttacagccttggcacatatagtaagataagttaacactctgaggaaggtttcacagtatattctcattttaattgtcagttgagtggacatgaagaaggcatttctgttttacaacttcaaatacatttatttacttaaacaatatgcataaatcagaaacatttacatcctaatacatatagtagcaactcataaagaagacatcgttataatgaaatttaactgtaaaatagtagttctacaattataacaaagtactattgagtttcaaattacaggacgttgaataaaagaaaacctagccaggctaaagtcatttctataaattcttttgaggatagtcatgagatttccaatgagagattgcttccttaagccagacaaatgaattggctgctcaacttagtctcagtaaacatttctatctgaaaaaaaaaaaaaaaaaatatatatatatatatatgtatatatatacatatatatatatgtatatatatatacatatatatatgtatatatatacatatatatgtatatatatacatatatatatgtatatatatacatatatatatacacatatatatatatatatatacacatatatatatatatcctgggccatcttattcttttagtaaacatctaatgaatttctctattttaataattattaccaaaaacacctcctaaggaatatctataaatgacttgccgctttattaattttttgataaaatgaatctttagtcttcttaatgcttgcttatatatcattacattacattcttctttaattttgtaaatatatatttttagaattttttagaataattatatatttttagaatattttatttttttgatcctgatgaaaatgctgaagatgctcattctgtcttgggccagtcacttacctatttctcatttcttctataaaatgaggattaaattgcctgatagggttttgtgaggaaaaagtgaggttgtgactatgaactcattctgaaagattaaaacaacaacaacaacaagaaactgtgagctactattgttatttaattacaattactcatatcatggccattctcatccggaaattagagccagcacagctgtggaggtagctgagcaaacaagggcatgttagaatattttgatgttagagtatcccctcgtggaaagtcaacagtcccaaaatgaccaagcgtgtatgattgtatgcttaaactaaccctgaaactaaaaatttcatcaagtgagatcagcatggtttggattaatcaggggggtagcaaaattgcaagttttggttaatatttttgctatatgtgaggtaccagcaaaaacatattttaattctaagaccatctgagatcatcataatgtactgaaggagctcaagtcagaaaacaaagcaatactttccattagccactctattttcttctgatagttctatgatagttatttgtacctatcactttagcaaatggttgaaaagtaaataccttcttagttatagcaatctcattatagatttgggcatgaggctatctgaatattttgatgtaaagtagaaattgtttcagtctctcctctatccatagataggataacataaattgagttacttttttactctcactgtgtgatgtttaatttatacaatagatgtaactattgaggtcagtggagctataggcaagtatagatataagctgattgagtacaattcttaaaaatgttagtttttatacatgtttattttaatgcatattcataaagatatatataattataaaataatttttatttattttaattattaaattaacaaatatttttcattagataactcttcaaatgttgctagttttattgcatcttttatataagattttaaaagactatctctcaaataaaattggatgtcaaatgcagctaaaacaagccagacttaatggcaataaagtctgatttaaaaaaatagccaatagaaccctcgtactctgttggtgttcatggaaattagtacaaccactatggagaacagtttggaagttcctcaaaaaactaaaaacagagctaccatatgatccagcaatcctactgctgggtatataccctcccaaaaaaagaaattaatgtatcaaacagatatctgcaatcccatatttgttgcagcactgttcacaatgatcaagatttggaagcaacctaagtgtccatcaacacatgaatgaataaagaacatgtgccccatatacacaatggagtactattcagccatttaaaaaaagaatgtgatcctgtcattttcaacatggatggaactggaggctattatgttaagtgaaataagccaggcacagaaagacaagcattacatgttctcacttatttgtcagatctgaaaatcaaagccatcgaattcatggacatagagtgtaggaggctggttaccagaggctgggaagggtaacatcagggtgggggactgtggggatggttaaggagtataaaaaatagaatgaataagacctactatttcatagcacaacagggagactacagtcaataataatttaattgtacattttaaaataactaaaagagtgtaattggattgtctattacacaaagggtagatgcgtgagggaatggacgcccaattttccagtatgtgattaagaagcattgcatgcctgtaccaaaatatctcatgtacctcataaatatatacacctactatgtatacacaaaaattaacagttaaaaaattttttaaatagtcaataaatgactttaatgtggtctaagccaggcaaaagacctttatacatctttgttttttcaaacatatttactcttactttatttcgttgttatcttaagaaaatttgacctatatctatcctttttctttttttctttttttttttttttttttttttttttttttgagacggagtctcactctatcaccaggctggagtgcagtgacacgatcttggctcactgcaacctctgcctcccggtttcaagtgattctcctgcctcagcctccagagtagctgggactacaggcacaggccaccatgcccagctaatttttgtatttttagtagaaacggggtttcaccatgttggccaggatagtctcaatatcttgacctcctgatccgcccacctcggcctcccgaagtgctaggattacaggcatgagccaccgcgcctggcctctatctttattttcattgggatgacaatttgatttggagaactatgttgatggctgttaattttgcaagacttattcatgaaaacttttcactcttaaaatatgaagtcatcaaaatatcattaagttatattctaacaaaattaaaaagttgagaaaataaagaatacaatttcaagtaaaaatatagttttcaaattcaaatattgttttcaaaataagctttctaagtttgactacccctaattttaaaaaggtgtaactgcagaatttctcttcggcctttttttttttttttttttttttgagacagtctcactctgttgcccaggctggagtgcagtggcactatcttggctcactgaaacctccaccttccgggttcaagtgattctcgtgcctcagcttcctgagtagctaggattacagtcacccgccaccatgcccagctaatttttatatttttagtagagacagcgtttcaccatgttggccagactggtctcgaactcctgacctcaggtgatccacctgcctcagccccccaaagtgctgtgattaccacccaggccaccatgcctggcctctccttggttctttaaaataattatgatctattttactcaataaatttattttactaaataatgatttattttacttaatttgatttattttagtaaaatgatttattttactaaataaggagctaaaaactggcaattttaatggtgcatactataactgactgccacaataatacagagttggggaagcctgtaatctagtattataaagttatagctatcacctaattgaaaattttcctcaattagataagaaccccactgctgtgttcttgatacagattttgatttttcttcacattgcatcacagcctgccaccaagatgcaaaatggaaacacaggattttttttattatactttaagttttagggtacatgtgcacaatgtgcaggttagttacatatgtacagatgtgccatgttggtgtgctgtacccattaacttgtcatttacatgagttatatctcctaatgctatccctcccccatccccccaccccacaacaggccccagtgtgtgatattccccttcccgtgtccaagtgttctcattgttctattcccacctatgagtgagaacatgcagtgtttggttttttgtccttgcgatagtttgctgagaatgatggggaaataggattctttccacctgtgtcaggttcctaaatcctgtcttgtgtttgccaatgatgcatcctatagccagtacataatagataaaagtttgcaaattgcactttctgggttaaaacaaacataacacaatctcctctttgaaagaggtaattatccctcatttgacgctgggaaatattgccccacactttccaaaatgaccttgcctccttcttgtttcaaagacaaatgttccctccatttctctctattatatcaactctatggcagctgagctgtgtgccaatctccacatctccaaagactattatttactcaagtccaacaatatatttagctttctacataaaaagggtctttgtcaagcccagcgatctttgaatctaggtcgtttcacaatactaggatgatttttcttaattgcttcataaggttaacctctggaatgattgtggcttgtaaggtatataatatgctcattaaattgtttttttcagtaatccatgaaatgcctgaaaacaggcatcagctgacagagtttctcctgttctctaaacaaaaatgtctaaaaaaacccatagcgggaaagaacagatgctccaaaacctcctgaaactgccagaaaatgatcccgaaaactggtgtttccttgctgtgaaatctgctagtgtataatacatctgtgaaatctgctagtgtataacacatttgtggccgtatattagaaatgacctaatctgtgcaaaaactgttctaaaagattctttctgaaattaaaaggcaaaattaagcactgaacactatggagaaaggagaaacatggaattaattttaaaaaggataatgtagacactattcttaaaagaaattttaggaggctgggtgcggtggctcacgcctgtaatcccagcactttgggaagctgaggtggatcacctgaggtcaggagtttgagatcagcctggccaacatggcaaaatctcatctctactaaaaatacaaaaattagccgggtgtggtggcgcacacctgtagtcccagctacttgagaggttgaggcaggaggatcacttgaaccaggaggtggaggttgcagtgggccaagattgcaccactgcactccagcctgggtgacagagcgagaccctgtctcaaaaaaaaaaaagaagaagaagaagaagaagaagaaattttaaaagatacagcaaagaagatattctttcagtcctgggaaatcccatgactattgctcgaatatatacttctattccagggtttcatgattcattcccaaccttttttccatgtgagtgtaagcagatacgcacagggacatcccatgaacagaacaaatggcagtgagtcacctggagagacgctttcccagccataatcaccgatgttgcccaacttgactacaagtagtttccaagatgagttatagtacactcaaaaattatactcttcagcatagtaaagtcattaacatttagttatccatgcttccaaatattctaggccttgggtgtttcagagattttgttgtactgtggacagatttcaggaggattttcacacacacgccatcctaaatttttcagagcctcattgaatgggcatatttgtttcctaaaaatgttaaatttagagacagggtatttttatgtttgagaacagtttgcaaaacagtctcaaaaactcaggaaaactaatttagctaatctggtaggaaaaaaaacacaaagaacaaacaataaaaataaagaacaacactaataacacctcatactccagcatagaagcaaatattagaaaaatgttttcttatatgatcttgtacatttaatcttcacctaccctctttgtaaacccaagctgacaaaatcttttcagaaatattttattataacgtttattacctagaagaactaaagacctaatatctaatgaacgtttttttcttttctaaaatagtattgagatgtagataagtacaaagctctagaggcagagaggctgaacaaaaatcccatcttccttacttactagctgagtgaatctggttaataacaataaaatatttgataatgtgtggcaaagcaagtccccacagccacatatttgcctgaacaaaacctggttcatgccaaataggtattactcaatgtcacgcaaaaggttagtgtcataaatcgtatgccttaataagaaaatataagaattatgtaatattaacagtgaacacacaaaaaatatttagtaaaaatcagcatatattttaatctcagtaagggaaatgagtagactgccaaggtaaacattttgtaaccatagaaaaattaactatattctcattccaaaaatcaacatttggaaaacaagctgttaataaatggagactcatagcatacatgttagctaatgcaatgaaggctttagagctctacacacagggaaagtttagagaaatttttaaaaatcacaagaaacataagaattgagtactagattttcctttcttttcttctttacttccacccttcttcccttccttcttccgttgtctttcattccttccttctttttttttttgagatggagtttcacttttgttacccaggctgaagtacaatggcgcgatctcagctcactgcaacttccgcctcccgggttcaagcgattcttctgcctcagcctcccaagtagctgggtttacaggcacccaccaccacgcctggctaatgttttgtatttttaatagagacagggtttcaccatgttggccaggctggtctcgaactcctgacctcaggtgatctgcccaccttggcctccgaaagtgctgagattacaggcgtgaaccaccattccttttcttatttcctttcttttcttcttcccttcccttccctctcctcctccccttccctccgttccttccttgtttctttctcttttttccttcctttccttcttttttcttttcttctctccttctttctatgtacacaaagccaaagttcactggctccagtgtatgatgatttaaaacttagtcatgactaaataacaagcccaggcccatgtctgcaataacagtcttgctcagtgagaaaggtctgtggaactcaaaagatgaaaacaagaaatgagtgttgtttacatttatcacaatttgaaaatggcagagaaagaacaagaatagacttctttaaatgccccaaagtagtatattacacgaggtaaattttgcgacaattttgctaaaagacattatatcatatactttccatccccaagggatgttgcctgagtgataccataagagcctgatgagcaaagtcaaaagttctttgttttctggaaattatatgatctagttaaacaaaggaacacagagggggggagagttctttgtcttgatgtgatttttctgaaacgtaattgatatgttactaaatctctgaccacactgttcaggtagcaaccgtgtatagaaaggattttgcccgtgagctgatcactatttcagtcaacaactgtatgaccaagtaaggacttaaaccattcccttgcccctttcttagggttatcgaagttttttccttaaagatgaagtatactagatttgggcccaagggtctaaaatgtctatttctttgtatctctcaatagcacatagatatgcttaactttggctccttggagaaatttcaggtgctaagtatgcagattcttcaggttttaagctaataacctggaaagaagagagatgtctgggttacttttgttttgtttttctttctcctacagctgttgtacttcagggtaggatgatatcactcaaaaacttcggcctccctataataaagttcagttaagtctatagtcactggtctgtcatagatactaattttgtcctcactcattactgtggcttttctggaattgaccaagtgctctgctctttttgattattctaattgacagctttaatcattggtggttccttaccttgtgcctatgcatatacctttgagttgagggtagaatgttggacactacaggctctgaagctgttgttccattctctgacttataagccctgtgaggatttaaactatgtatctgtgcttttctctctgaagtacagacttctgtttgttagtgcctagagtttcctgcttccttcctcagatcattcgtttatcctcccacatctcctccaaaacaattctgctttctgttccctggttaaagatgtgatgaataacagccatctgtggccaactgcccactgacttttgaacagaaattgagacaccaagagcatgcaataagatccaaccataaaaccataaactttttctctttctctctcccttcctccctctgtgctctcttcctttcgccctctttgtcacacactttctctttctcactctcttcccctctctctcccctgctgtgtctctctgcttccctctctccttcccttctctcaatctctgtctctcctacctttcccttgtctgctatcatcctgcctttttcgttctctccttccctccctttctttcctacatcttcattcattcaaaaatgaactttgaagaatacatgacttcttcatacatgaacgttttaacacttacacttttttgtgtaatttgtggagtcagtgaaatgaaacaaaatgactatttttcaaattgcataaaaaatttccttgaacgattatagtcactaaatactaaaaatcatcatcctgaatctcttctaacatggaatgatatttgcttctattcttgtaatgttaaaaaacagcacagtgtgataatattttgtatgaaaaataactgtgtcaagataaatttgggaaaagagtagtactgtagcctatatttaaaaattcaatattattttggtctcaaatataattaaagattttttaaaattatactaatgttctttgttcctttcgtagtgtagaatgcacctaaacttgccacttcgatcactgaaaacttctctttgtcactcatttaatgtgaccttcttaaaaccaggaattcttttttttattattaaacgttaagttctagagtacatgtgcataatgtgcaggtttgttacataggtatacatgtgtcatgttggtttgctgcacccatcaacttgtcatctacattaggtatttctcctaatgctatccctcccccaacccgcaccaccggtcaggccccagtgtgtgatgttccccaccctgtgtccaagtgttctcattgttcaactcccacctatgagtgagaacatgaggtatttggttgtctgtcaatgggagaaaacttttgcaatctacccatctgacaaagggctaatatacagaacctacaaagaactcaagcaaatttacaaaaaaaacaaaccaggaattctaaacttatcctctgagcttatgattctgaaatatttttgctttactttttgagaagaatattttcacttagagtttaagatattgttttatttacatcatggccatgattcatacaatgctttgtggatttcagatagcttcaggatattgctggctaactgtgtacctaaataatgtcagtaaatcctggataatagggatagggagaaacgccaaacatgtgacgtttgttttaggaacacagccgcctaatagcaaagacatgccataaaaattcaatataacctctgtgtttttggatattcattatgctacttatcatgaaaagcctggggaaagtattgtaacagagaaatctatttgcctgcgtgtagcataatgcttccctaattatttttctttctgtttttttctttttcttttttttttttttttttgagacggagtctcgctgtgttgcctaggctggagtgcagtggcgcgatcttggctcactgcaagctccgcctctgggttcatgccattctcctgcctcagcctctcaagtagctgggactacaggcatccgccaccatgcccggctaattttttgtatatttagtagagacggggtttcaccatgttagccaggatggtctcgatctcctgaccttatgatcctcctgccttggcctcccaaagtgctgggattacaggcgtgagccaccatgcctggcctcatttgggcagttttttttttttttttttttttaagttttagggtacatatgcacaaagtgcaggttagttacatatgtatacatgtgccatgttggtgtgctgcacccattaactatcatttaaccttaggtatatctcctaatgctatccctcccccttccccccaccccacaacaggccccagtgtctgatgtttcccttcctgtgtccatgtgttctcattgttcaattcccacctatgagtcagaacatgcagtgtttggttttttgtccttgagatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatactgccacaataaacatatgcgtgcatgtgtctttacagcagcatgatttataatccttttggtatacacccagtaatgggatggctgggtcaaatggtatttctagttctagatcccagaggaatcaccacactgacttccacaatggttgaactagtttacagtcccaccaacagtgtaaaagtgttcctatatctccacatcctctccagcactgttgtttcctgactttttaatgattgtcattttaactggtgtgagatggtatctcattgtggttttgatttgcatttctctgatggccagtgatgatgagcattttttcatgtgtcttttggctgcataaatgtcttcttttgagaagtgtctgttcacatcctttgcccactttttgatggggttgtttgattttttcttgtaaacttgtttgagttcagtgtagattctggatattagccctttttcagatgagtagattgcaaaaattttctcccattctgtaggttgcctgttcactgtgatggtagtttcttttgctgtgcagaagctccttagcttaattagatcccatttgtcaattttgacttttgttgccattgcttttggtgttttagacatgaagtccttgcccatgcctatgtcctgaatggtattgcacaggttttcttctagggtttttagggttttaggtctaacatttaagtctttaatccatcttgaatgaatttttgtctaaggtgtaaggaaaggatctagtttcagctttctacataaggctagccagttttcccagcaccatttattaaatagggaatcctttccccatttcttgtttttctcaggtttgtcaaagatcagatagttgtagatatgcagcattatttctgagggctctgttctattccattggtctgtatcttgttttggtaccagtaccatgctgttttggttactgtagccttgtagtatagtttgaagtcaaatagtgtgatgcctccagctttgttcttttggcttaggattgacttggcaatgcaggcccttttttggttccatatgaactttagttttttccaattctgtgaagaaagttattggtagcttgatggggatggcattgaatctataaattaccttgggcagtatggccatgttcacgatattgattcctcctacccatgagcatggaatgttcctccatttgtttgtatcctcttttatttcattgagcagtggtttgtagttctccttgaagaggtccttcacgtcccttgtaagttggattcctaggtattttattccctttgaagcaattgtgaatgggagttcactcatgatttggctctctgtttgtctgttattggtgtataagaatgcttgtgatttttgcacattgattttgtatcctgagactttgctgaagttgcctatccgcttaaggagattttgggctgtgacgatgcggttttctagatatacaatcatgttgtctgcaaacagggacagtttgacttcctcttttcctaattgaataccctttatttccttctcctgcctgattgccctggccagaacttccaacactatgttgaacaggagtggtgagagagggcatccctgtcttgtgccagttttcaaagggaatgcttccagtttttgcccatgcagtataatattggctgtgggtttgtcatagatagctcttattattttgagatacgtcccatcaatacctaatttattgagagtttttagcatgaagggttgttgaattttgtcaaagtccttttctgcatctgggcagttttaaatgtattgatgatgaatgaaattcttcgtagtggtagtttggtagaattatcccaggttatattacaaatttgaactgtttggctgttaaaatcacatatcattattaaagtttgctatccaagaaagtgtgaataaagcagtgctcatgaaaatagcaccgttttcatgctgctgataaagacacacacgagaccgggaagaagaggaggtttaattggatttacagttccacatggctggagaggcctcagaatcacggcgggaagcaaaaggcacttcttacgtggcagcagcaagagaacatgaggaagaagcaaatgcagaatcccctgataaacccttcagatctcgtgagacttattcactttcacaagaatagcaggggaaagactgtccgccatgattcaattacctccccctagatccctccatacatgggagttctgggagaaataattcaagttgagatttgggtggtgacacagccaaaccatatcaactaccatggcctactctgaaatattcctatgttacatagaaagagaattggatgtttcatctcagaaaaaaaaaaagagcaaaatatcttcatatctttaccaaaattttaaatacataaaagcaatgtcactctttctagacatttcattgacacatgtagctaataaaggagagctgggacaggaaatttgagatttttatacgcaaactctatgtctatttatgtttgttaacatgttttcaaataataataataaaagcagcttgtattagtagcatttgtgaaacttggtaatacaataccaatgaagtctccagagaccattaaatcacttttagagggcataggatttcattgtttctctcaacatggatttcatagaaccctatttctacaagatacaccgcaaataaaacaggcttctatgatcgaaatgagaaacctatgcgtactctatctccttatcgaaaattcgtaataaagaaagtatgaatgtcctgaaaatcctgcagtaaagaaactagtatttcccaaatgtatttgaccagaagactttttcccctcctaatacctattaccgtctcacagattgaatgttcagtgaataggctttgaggaacacttaactatttttatggtcatttcattcttctgctgggaagatgctctaaggataagctgaaaaaactgatgacgatcagaaaaaaaaatttcacttctgtgaggcgattgtgtttaaaactatcaaaaggtttctcatcacagatgagtagtgaaggaagccattctttcctatggtgagcaggtttaggaaatataggcagcgagggttttctggaagctggtagttcacagggctcagaaggagacataatgcttctctgtggaagtctcgaccaactagttgtggtcctttgatgtcagatttgctctaaatctccaaagtaatagagaataataactggtctagattttatcgatgaaaggattgttgactaccaaagaaaatacaggtgtatgtttccattaggattggaaaaatacaaggattggtccaaatactaattgcatttgaaattggctaatttatacttggtaccttattcattagggatttaaaaaaaaaaagaaaagaaaaacagagaaagttgtatgaataaaagaaaatggagtgctcaaacttaaatatgtggaagaacctcacttacatggcagaggtcagtaaactactgcctgtgggccaaatcgaccctctgcctgtttttgtttttctttttgtttttttgacatggactctcactctgtcgcccagactggagtgcagtggcacaatctctgctcactgcaacctctgcctcccgggttcaagcgattctcctgcttcagcctaccaagtacctaggaccacaggtgcacaccaccacgcccaactaatttttgtatttttagtagagacggaattcaccatgtttgccaggatggtctcgaactcttgaccttgtaatctacccaccttggcctcccaaagtgttgggattacaggcatgagccactgtgctcggcctctgcctgtttttatgaataaagatttattggaatacaggcacaattatttgtatacatagtgtctatggctgtttttgcaccgtaacagcagagctaactagtcacaacagagatcatatggcacacgaaggctaaaatacgtacacttcagtcctttatggaaaaagtttgccgacccctggtttgcaaaggatattgcgtttctcttgataagtgcagtgaatcagagtggatggagagtaatcatggaaaggaggcggctgttttggacagcgaagtttcctgcacagagatgacatttgagcaaagagagacaactcaaaaaattggggaagtgagcctgtgaaaatcagaagattaggggaggcgtttcctcggcagaaggactcaatgtgggaagtttggaaaacagctgtgaatccagggtaaggaaagtgacgtgagtgttgcgtgggtggtaggagatgaggtcttagggacacggccagatcgcaacaacttctcagctacagtaaatcaggatttggggtgataggaaggcgttgaattattctgagtgagagaagtaacgtgaactgactggttttatagcgatcattctggctatttttttcaaaactgattgcagagaaacaaaaaagaatgcaagcgacaattccaaatttaaaaagaaacacgatatttatcctatcattagcttacaaaaatactattgattaagcacctgtccatcagcaagggccataagacaaagcaatcatttcaactctgactgctcattaaaaatctcctggacacatttttaaatatacccgtgctagagtccacaaagagattctgatttaatttaattgagatgaggcttgagcatcggttgatggattgtttgtttaaaagctctccaaatctctctaatgggcaactggaattgagaaccattgctttagagaaaagtattgaaagagaaaaacatgttaattttatataactgatagtatggtactgtaaaaaaaaaaaaaagaggtagatcataaacaacatgaattatataagatttcattcttcctggggacccttataaccttctcaatttttttttttagtttcctggacagttttaaaatcaaatcagggacccattagtctgaagcagccacaactctgcttagaagctgtgtcagcatcaaatggcctttagagatctcaagcagcctcttgattctgttatttgaatcaatttgtactccatttatgacctgatggtgtttgctggcagggaatttcataggttgggagttttaaacacatcatctgcagccaggtcatggactgaaagataggctcagaggcccctgcagctctgcctacacagttgtccctgggagccagtttccacagaaatgcaacaatattattctccatatgtaagcatgtggaccgaccttcatagcctcaggcatagccattaaatgaggtcatgtgtgctgacgtgatatgttgaaagacataaacatagaattaatcaggagaaaggagaccttattacttaatgtgaacatgatttacttggcttacatcatgcatacgatcgaactctatgttttgactgtaggaaaataaaagacatattttgactttcgaaagatgctcaattgactacagtgttcaccagcatgtcttaggaatagaagaaatcaacatacatctaaaagaaggctaaaagaaggctagcagcatgtctagtgaaaatcaggcagcaggccttaaatacactgtcccatcatctccttcccctatttgcactttactttgatttatgttttcattcaagaggaaactgagcctgttttctagagccttcacttctcaacttgtcaacttgagaaacagtaggaatggcgtagacagaggaagacagcaaaaagaggtaggaactacgtaaatattgaggagaaagtagaagttcattgggccatcagattttagaaactatttgagagatgactgagaactattttaatgttttagggtacatgacaatatcaaaaccaaaggtgttaaataagcatagatatttatagattcattttttcccattcctcttagaaacgaaaaataagattgatggagtcccagagagaagaaaaattccattgctacaaattagacagggcatcatatttaagacctgaaatgtgtgagcacccagtagtcaaatatttgcattttaactttatgtgattaaaaaaaataaataaattctatgcattttggaaatatgccaaataaatgaatcattacagcatcaagtatcttttatatggcaccagatcttaaaacacaaggcagtagagcagagctctgggaaaatacaatttcctcctccgttcgtctgttttctgcattgtccagttgctgtgtgttaaaatgctgcttaaaaaaataaaaaactgttttagttactcctacaggaacttttaaattggtaaagcccaattgtccggacaatgacattttaaaaaaaaatctaagaacctgttttatagacaagtctggaaaagtgaaaataatgaagattgaaaacgggtcagtccttttggtccactaacaaggtttctcatttcagagattaactcttgataggtaattgaatactggacagtaaaatttgatatgatgtcattttcgagaaaagtgtaaaacctgctggactaataataaaggaaaaccaaggtgtagaattagtctcttttaccaatttatctctacacagcaaaacgtgtttcctacgcacattcatacagtaggaaaataatgatagaatgtgaagcaagatgcaggcatgttttgcagatattataggttccattccagaccactgcaataaagcaaatgtcccagtaagggactcacacaagtattttggtttcccagtgcatataaaagttatgtttacactatactgtagtcaagtatgcaacagcattctgtcttttaaaaagtgcatatcttaatttaaaaatactttattcctaaaaaatgttaacaatcatctgaactttcagcagctcaatctttttgctggtggagggtcttgccttgatattgatgcagctgactgatgggagtaatagttggaatggccatggcaatttcttaaaataagtcaacaataaagtttgctgcattgatagactcttcctttcacaaaacgcttctctgtagcttgcagtgctgtttgacagcattttccccagagtagcatatctttcagaattacagtcaattctcccactcctttgtcaactaaatttttgtaatattcaaagttctttgttgtcattttaacaatgtgcacagtatcttcatcaggagtagatgccatctgaaagaaccattttatttgtttatccacaagaaacaactcctcgctgggcacagtggctcactcttgtaatcccagcactttgggaggccgaggcgggcggatcacctgaggtcaggagttcaagaccagcctgaccaacatggagaaaccccatctctactaaaaatacaaaaattagtcaggtgtggaggcgcatgcctgtaatcccagctactcgggaggctgaggcaggagaattgcttgaacccgggaggtggagtttgcagtgagccgagatcgagccattgcactccagcctgggcaacaagagtgaaactctgtctcaaaaaagaaaagaaaaaacaactcctcatccattcaggttttatcatgagattgcagccattcagccacatctttaagccccacttctaattctagttgtggggatattttccactgaagtcttggacccctcaaagtcatccatgaggattggaatcaaattctcccaaatgcctgttcatgttgatatttttacctccttccatgagtcatgaattctcttagtggtatctagaatagtgaattctttccagaaggctcttaatgtactttacctagatctatcaaagaaattctatccatggcagctatagccttacaaaatgtatttcttaaataataaggcttgagggtgagccggggggggtcacgcctgtaatcccagcattttgggaggccaaggcgggtggatcgcttgagctcaggagttcaagaccaacctaagcaacacgacgaaacaccatctctacagaaaatacaaaaattcgccaggtgtgttggagcagggcctgtagtcccagctactcaggaggctgaggtgagaagattgcctgagcctgggagtttgaggctgcagtaagccacgagactgcaagtgcactccagcctgggcagcagagtgagaccctgtctcgaaaaatactactaataataaaacttgaaagtggaaattacttcttgaaccatcagctgcacagtggatgtggtgttagcaggcatgaaaacaatgtgaatttccttgtaagtcaccttgccaacacttaacctaggtccccagccaaatccttctttgtgcctcttgctttctctcttaaacatatacatacacacatgtgcatgaacacacacacacacacacattctcaatactaactgtcatgcctgcacgtttttacagctccaaagaaaacactaataaactttgtgaattgaaatggagaaactcaaattactggttttcttcatactgcatatgtttaaaatctagagcagtgacatcttgggttatagagagttatctgataaaaagagcagtggtttagaactcactgttccatctcacctctattgttagctagttatgacatcatcctcatttgtaaaagtatggcattaaataggagtttgttctattgccaacaaaccatgattgtggctgggcgcagtggctcacgcctgtaatcccagtactttgggaggccgaggcaggtggatcacctgaggtcagaagttcgcgacaagcctgtccaacatggtgaaactccatctcaattaaaaagaccaaaaacaaaacaaaacaaaacaaaattagccgggcatggtggcacaggcctgtaatcgcagctgctcgggaggctgaggcagaagaattgcttgaacccaggaggcggagattgcagtgagccgagatcgtgccattgcactccagcctgggcaacaagagtgaaactccatctcaagaaaaacaaaaccaaaccaaaacaaacaaacaaaaatatgattccttaggaacatccactttttcttttcctctggaatgaacacagtgtatttggaaaaaattgttgccatttttttcagtatgtgttcccaaaagagagatataattgagtcaacagagcatgtcaaaatttataggacaaaaacacctgacattgtacataattaaagatatcagcctacctataattgcataatctcatttcagtctgtgagtttcagaaatttcttttaaaaatcagtttcttgccactttgaggaagaaagttagagacttgtggaacttatagttggatttatcactttttaaacatttgactgaccattaattggaaaagccaacttggttgttaactttttacatatgagacaggcatttgtgattggtttaggtaagtttagctgttaatccatgctttttcttgatctgtaactaccttaatagaagtttccactgtggaaatgtgacagtccccaaaccctattccaaagatttctttcatcctgcccattaagccttactgagccccagaacacccttacacattttcagtaagagcctcgccatttttatcaaagagaaactagagtcatgggtcaaaaaactccttcaagtccctgtcctctcctcacaaatgtgcacattttttcataaattcttcttaggcttcatggaataggaatgcctgttctcttcaatagctaacacatcctgtactttgcatctcatctcatcctacagttttcagtggctttactccatcgttctttccaaatgtctgtgctatcaataactgttccttccaaactgactcttttcttcaacttacaagttagattctctctcccctatgtttgaaaaaggaaaaaaaaaaaaaaaaaaaaaaaggaagagaggaacctcctccagcaggacagcagcacaattccccagcagtagagcaccacacagcagctactcttgaaagtgtttcccttctcaggccagctccttgtcagcgcagtctaatgtcactgtcttcattttctcacctcctgagtagacttcatgtgactctgtcttatatcttcaccactctactggaactacacttaaaaatgtcactagtcatctcctagttgccaaaactgaataacatttgagtctttttctcacctgctttttcactgaggcactttacacgttccctactcctcttcctatgggcagaagagattttccagcctccatgggtgtaaagcaaaaatcaaccttaaaattgatttagagtattgcctttcttagtgcaaagaatttaatatttctccaatgatgttcgataaaatgaaaataaacctgttatgtgtatatgagttataatattgtacgattaaaataagaattcgaatgtctccattagcatgagtgcatataagatgtattgtatcatttagcgcttaatgatatattgttttatcactgttcacattttaatttttcttaggtgcatgttttgctctcaaattagatcaccattcccatgtctaccatttatttaggatatctttcattagtattttccatagtcaaggacatgcaataaatatctgttctgaagttgcctatagttaggtctcattttcaatataatacattattgagttcatgatgatactttgtgtgaaaatagatatattttggtgaggatgttgaaattgtgtgattttagattttgtttgatttgctccatcattttcaaatatcaaccaaagaatactttccaataaatagatattttcttcttttcaacaggagatttgatagagaagcagaaaaccactggcatgaatataaacaaatacaagagttgtgataaaatgtcacatatgaatttctaagatctggtagaaaaatatttctttctttggacttattttctatataaattactgcaagaaaactattaccttttatctgtcctgaatctttttatgtctccatctgctctactcagctttaggaggctgtcactttcatggcccctatcctccacttgccaccccacttccccacccacgttccctttcccaagccctacagataggtaagcatatcacccgttctaacccatcagtccgtatccccctgaccacaattacacatgatttttttttcttttttctcagaacattctttctaaagcagatgtatgtcttgaatttcaggtagccatatttgccatggcattgagaaatcttacctggaaacaaagtcatcacaaagacaggtagagacaagagagacagagttgtgacatcaatgcttgattcttttctttttttttttttttttttttttttttttttttgagacggagtctcgctctgtggcccaggctggagtgcagtggcgtgatcttggctcactgcaagctccgcctcccgggttcacaccattctcctgcctcagcctcccgagtagctgggactacaggcacccgtcacctcgcccggctaattttttctattttgagtagagatggggtttcaccgtgttagccaagatggtctcgatctcctgacctcgtgatccgcccgcctcagccctcaaagtgctgggattacaggcgtgagccactgtgcctggccaatgcttgattcttgaacacatctgtgcctcagtcatcctcttggacttctcagttatgtcaccaatacattttcttttttgcttaagctactttgaatagtgtttctgagaaggacaacctaaagagctcaaactcatgccatagcttaataaaccctcagttgactgacatggaagaagcacttatgcattttatagattattctcatttgttgttttcaatttttcaatatgtttcatgcgacttcataggatagcaattagccatacatgccatgttataactcttttaaacttcaaaatgtattgtgaatatatttctgcctcagtaattattcaagcataatataatctattattggaaatttagcagcaataaaatgcaatttacaaatctagtagtttgtaaaattctgtgatttataaacattttgcttttagatttagaattttaaccaagaaataaatgttgattcttttcagccttcccattgtctagatttttaaattaattaccaaatttcctaaagcaacacttttcaggtaaatgttccaatctttttgttcaatggagaaactatgttttcaagttgaaagtgtgttcccttttcaccttcaaaagtactgcagaaaaaaggaagacagtgagcaccaccacaaaatataacctaaaaatcatttttttcaaaagaatgaaaatgagggcaatagcttcttggactctaatatgtaatcatcacctgacaaccatcacagatgaaaggtctccaataaccatgtttactagtaaatggtaattaagcagcattggaaataatgatcacatatttacttctcgtaccatttacttttggatttctttttaggatctatttgatttttttcaaaggcctttgtttctcaaaggccactaatggcacaatcacatgtgaaattcagataaacctattggatcagaatctcagttgcagggaggaagggaatttgcctttcaacaaactcccagaagactcatgcgctctccaatttgagaactattgatctaagcaggaaccttggctttcctttggactaacttagagaattttataaaatactgatgcctatataccattcccacagattctgaatactataattgttccagggtgtggcctaggtaccataattttttaaaaggatttcttaaggtgattcgaggtgaatctaatgtttagtcatggttaagaaccacctatatgcacacgcaaatatcagatagcatttaaatatgatatgaataacttaaagatatcaaaaacaaatgtggatttaacctttgaattttctgttactcagtaactacattaaagtatgcattattaaatatcagcatgttttccaaacaaatattttggcattctttaagttatacgtagctgaaaatttgtttgtgtgtctttctgagcaagaagaattatttaaaatctagagattctatccaaatagatactaacaagaaatgcaaggttgctgccaataaataaaaatatacttactgagtatcactatgttccctgcactgacatgggcatggcaaaagatacataggataaaactttcccttttttgctttcactgctaggaagctcaatgccaaacttgctgctgcatgatgacagtagctgtacatctaagctttttgtattttacttctccctacactatatccgtggttttcaacgactacaaatcactacaaaaagttttttgtttgtttttaatatggatgcctagactttatcccaaatttattaaatcagaccgtatggggatagtggccagatacttacattgcataaaactcaacagtttatccttctatgcacttctattttaaatcactgctctacatcactggttttcaaactttaatatgtttaagaatcatctaagggatttgataaactgcaaatggccaggtctcttccactatgatttggtaggccttggagaagacctatgatctgtattgctaaaaagaaccacagtgtttctgatacaggtgtttgataaaccacaccttaaacgccattgaggaatgtagattttatcttataattgtatttctaggtcatgttttgttcatccctttaatcgtaaaccatcagagtttatctaataactaaggtcaatgtctctagagtcataaaataccttagagatcactgaatccagtggttttctaatgattctacggaacttatttaggcagagattatgccttctctcaccccaccaggttgccctgtagcctgatcagagtctacttaggtctcttctataattgggttactgtataaatactctttgaagaattagttctacgttttcaagaacaccctcgggccacctaaaatggtatacattgagaaaaacacaaaggagtcacagcaagcatgtagttccaccatatcccatcacgttaaatggcaaaaaaaaatccatcttgcataggtttttaactctcagagactcaacagatggaaagagtgtaccctacaatctcccgaggcatatcttttcttctgaactcaagtcaccctggagcagctgggtcaccatttcccgaactagtgttctgtgagataaaaacaaaacaatagataaaaggatcttatgctcagatatgttcgagaaatgattggttaaatcaaactaaatattcttctttaggagctctcaaagctttcagtttgctaacagatatcataatgattcagtaaaaacttataaaagttaaaaatcgtagaaaacagaatttttgaaaattgatttgattattcaaacattcctctcaagccatgcctattaaaattaaagtgaaaatcctctactaacatcctcacaataacatttttgaaatattaatataaacccacatgtatgcttgaaatgaatttatgattgtatcagggcacacagcgtctcttgccatgccatgatgtctgtggacccagtgaaggtacctgcacctcccattcctctgttctcttttgccaccttatctttttacactagtacaacacacgcccatacaaaagcctggaaagactgagattaagactcccaagcaaaacaaaatgcctttcattcccaagccctcaactttcatcatagcccttcccctgctccccgaagccacctgcacagaggatgttgtctctctgcaagcaaactggaacaccgtaactggatttctggccagatggtcaagcagtcagagtgtggaatgaccactatatgcctaacattttatttggttctgtgagaggtacaaagtcagaagaagacatcattcctgcatcccagagcttcagtctaataaagaaatgaggcagaaattgtagaaggctcagaataaaagcatgcaatgtaaaggtttaagattcattttttaatctcaaggacctcacattttggggtgaagatagacatatatgactataattgccatgagaacaaggggcccaaggtacagtacaaaagactgagtaattccacgggaagtgggattgagaaagaagtcacagagagagggggaccaattatcccatggagaatgaatcaaatatttcgaggtagaggaggaagaggtgactgctgagctgaaaagcagcatagagttgaagctaacagagacagaaacagatccagggatgcttttaaatcttcatctatgttaagaaaatgtaattctgtacaatgggaaagaattggtgtgaaattatatggctctcactagaatgatgatgcagggtcaaggaaaggagaaatgggtggagactagggggagcctcaggactggagctgctgtcctggagacatccaggaggacagaacagaatgagccagtgtcgggacagagccccatgagccgagttggacagagaactgtgggaaaatcttggaggcatggggcaatgcattgatagtcaatgacagtttgggaaaacaactgcaaagctggggcattaaccgtacagtggggcatggaattgagtaggcagggagagagccaagagccccacatacatttgtatgaagacaaatgtgtaaaagacacatttctaaaatgacaaaacaaaacaaggcaaggagtgtggaatcagcaaacagcaggaactcccaaagtacaggttgaaaaatgggccacacctgcatcagacaaaagccagggggattcatacttaagcacggcaagttataggcttaaacttgacaacattaacaaaaactcgtgatatgacaaatttttccagtagagcatcattgaaagcaatcttgaggtaagctctaatgattgcagcaaaaactggaggatctcctaggatgagagacaaatgtaggcaattttaaagaagagaaggaaaaatatatatataagaacgaggcaatgggactataaacacaggaaccctgaggaaatatgaagaacatagaaaaatggaaagaacacagatctgcgaggaagaaggactgatttctaaatctatgttgcccctactaagtctcaattgtcatatttgcttaaagacgaggacacttttgatggtgtcaattctcacttgagctttaaattctgggaccttctgagaaaagatggcacagggtgagaaaggaggcaaacagactaaaactgaggttcatttgaatttagagtgtcaagggttttatctgagataaaaagaaggtatttattaaaatacagaggtaactattcagataactaaaagatgttggtattcaattactagtacaatggtagctgctactagtaataaaaacatgtgcatctatgtagcacaagtgtgtgatttagagaatactattaaggcttagaaaataaaggagaagaaaagtatttgtggagtatctaccacttgccaactttgatgtcaggtgtttatattcataatgactataatttccctatatcaaaagaaaactgtcatttaagagacaatatttggaatattaagcatggacatcttttcaatttgtatccaatcagattcttccttgccaaaataataataataataataattgccatacagggtggctcacacctgtaattccagcactttgagagggcaaggcaggaggattgcctgaacctaggagttcgagagcagcctgggcaacatacccagaccctgtccctacaaaaaataaaaagactagccagatgtggtggtgcatgcctgtggtaccacctactcaggaggctgaggccttcagacctttctttaacttgttctaaatagaggacaatcacttgagcctgagcccaggaggtcaaggctacagtgagctatgattgtgccactgcactacagcccaggcaacagtgagaccctatcaccccaaaaataaaaattttacattttaaaaacagaaaaatagtttttagtggggaggaggaagttggttttgctttatatacattaaactacaatcagtttgaccatgataatgtgattttttttttgctatgacacagtataataatgatattgactcaatacttcaaaaatgtccataaaatgcaacagtctcacttatcaggtaggctttataacatccctctccccttctgccaaatacagtctctctgcctcccagggatttctttaaatgagactgatagagaaagcgaaccattctatcaccatatattagtcttgaagatgtcagacagtgagtgttagcagcatcattcccactgctgtttgttttccaagttttccttttcatctaaataaaaatactcagtcctgtgaactctgagagcaagatgtgccattttcttgccctgccacatggctccatcaatattgatatgcaactaaccctccagggctgtctgtgttcctggcaacgtttcaacactaacatgtggttaattttctagaggatttttcttcccatcctgtgctcaagaggagccgaagagtttgtgggaaacagccgcttgactcgtgcatctatggagcttgcatatttccctgagagataatgacccttttttttttttactgcacattgtgttctaggaacttggaaagagaagcatatcctaaatacttagcagggtttcaaaacaatattcctggacacatggcatgtgaaaaaaaagtcatagaattctcagcacttacttcctgtcaatatttagcaataaatgcatatgatcatatttatagccatttatattccatatgcattggtacattatgtactaagcacagagattgcgataaatactcaaagtagcttcattttattaaattactaattttgtcatgcctgtaatcccagcactttgggaggccgaggcaggcagatctcgaggtcaggagaccaagaccatcctggctaacatggtgaaaccccgtctctactaacaatacaaaaaaattagccaagcgaggtggtgggtgcctgtagtccaagctactcagggggctaaggcaggagagtggcatgaacccgggaggtgaagcttgcagtgagccaagatcgcagcactgcactccagcctggacgacagagccagactccatctcagaaagaaaaaaaaattacaaattttggaccaacagcacaaggaagatcttaaggcaaatactggagatctgacttttattttattgttattattattttttgagacagagtctctctctgtcgcccaggctggagtgaagtggcgtgatctctgctcactgcaacctctgcctccagggttcaaggaattctcctgtctcagcctccagagtacctgggattacaggtgtgcaccaccatacctggctaatttttgtatttttaggagagatggggtttcaccatgttggccaggctgaccttgaactcctgacttcaggtgattggcctcccaaagtgctgggattataggggtgagccaccgaacccggccttgatttttatttttatcattatttctattttttccaggtaggacaatgagttattttgttttgctttaatttccaaagtttgtgaggacagtctgccagaacactgttgctgtgtttttgttttcaatagcataaggaaacacccccttaaaattccattaaatagaataaagacatttcttaggattgtttaatttactttctatttttatagctgtagtaaaatgcacatttggattacgttttgctgagcaaataacagaatcttaaaaataatgagatcataattcttattttcccctcggatgggccttctgagtctgtaatggatcagagctttcagtccacaaggacgtttagaataaaaatattcagccttttctttaaattgttttaaagagaagaacacggattttgaattattttattactaatggtgacaggatctgttaaaagatctatactttctcatgtatttgcccttttagtcatcagtaaacatctgtggttgaataaaatgtaaataagaattttatcaaattcagcaatggcacacatcagagcagaaatccgatttctgtttaaatggtcacagaatgtttaggaaatgcctagcaattaatcatagtattaatactccttagtactgaagatactaatacttcttataattataattagtattataattcattctttcttcaatactaagaatcaaggattatccacaaataacagagagatgaaactataccatcctagcaaagatccctccccatcagcttataaaacaagtctacttctccaaatcacttaaatggcaaatttaggttcaccttgaaacaaataagggcgatactatgccagtacatgtctcctgcaaagatggccctgtgaggtagtagggatcacaggaagagcagaaaatgttcattttatttttccactttcaatataattttacaaaaatgcatttatttccttctaaaaatataataatgaagacctggaaaagacaaatggtgagtgaagagaaaaatagaaagacatgcatgccaaacttggtagacaaggcaaacctgcaaaaatcaattcaattcagcgactcttttgtgtttagttgtgcctttcactgtgctttgcaataagaactgagctagagctagagtcttacatcaccccccaactccttcagaattctacacctattttgttaatatgtctatgccctgtgatttcccatcacaccatgcgcttccatggcttccttccttccattttactcaaattcaaggctcaatgtaattgtcttctctatgaagctgaccctgggccatatcacccaatcagaatctttttgttttgtttgctttaatagcactttgctcaaacactggacgcattcctttttttttttagctggttgtttgcatgttgatccaccagatgtagtatcaactccttaagagaggatttatttatctcttgtgtatactatattattgatctaatagttgctcgatatagaaagaaaaaataaaagaaaataaaccccagcaccctccctttaaccagaactaatgaaagaagtgacaaatttgctccaagattaactaaaacattcaaagagacttacactggcacaacacccatttgtcacctaatgtatgcagtaaacgtgcagagttttctaggatatgttttaaccttctctccagctccccactcctgcagtcaaaacctaggaagccaatcatttattaatattactatattatgtagacaacatactcattggtaagaaaaaaaaaaagcaatctctgaattcctttctagtgttgaaatactacttttactactttgtggtctggttctctcatacgaaaataatataattttatcactaaacaccatttcatctaccatgggcttctgagaacagtaatactgtattgtcttaaacctcatcttttgaaaacacagaaagattactttgaggtattagtttaaacctcattaaatatatatgctatatatacccttcaaaacataatattttaaggaatcctgaatcccaaactcattttaaaagtctgtttaatatttttcttaagctctctgactcaaaagatttatcagtcatagttttatttgtacttatacaattgataaccaaagaattactattcatgatgggaaataggtacaagtcaactccacagaagactcgaatattagtaactatgaccatttgaattaaaaaccatagaaacatatgggtccctttcatgggtacatagttcatatggagaacaagttagatacatatgtaaataaagaaaaatttctgttccctgtgccagagagattccctaggcagaaattagggttaagagttattaccatattgggaaagaagaagccattgtttggtttccttatgcacaaggaaaaggcaaacaaacaggtcttaatgatctcagggaattggaggatgagtaacctcaatattttggaagcaaaaggctatttttcaaatttccctttccctcagaaatattataccacaaagacgtttttgagttttgactaactcctgcaaggacacaaacaatgaaccagtctactgccaacacattttctaatcagtgcacctgaaaagttatcttccattaaacagaaaatgtcctcatagctgtttatgctttttccgtaggaactttgactttttttaatctcacccatggactcaggtcaaactttgacttttagagattgccagatatatgcagatggttattaaagattaggacttagtagataattgctaattaatttaaaaatatttttgaatcctactctgtgcatagacgctactgggtactttaggggttgcagagacacatcagcccagtcttttctcaggtagactttaaaaactgcttgaggagataatatatgcagaaaagcttaataatataaggcagctatactgattacttatcatcaaaaagagctcaatgaaagaaatagttatgttaaaaataaatgacatgtattctggatctgtcatcgagttttggaaaacttaaaaatggtgtctttttcatggttaagaaaagattaacgaggaattacagctatgatgctaactcccttaactttttaatcagaagtatgggcagttatcagtccataccggagagacccacacaagtttctcagtataatctgtaaggggtttagagaaagcgtccaagagctcaaactgatgtttctcctataaacagaatatagtggtctttctgccacatggggcttactgcatagaaactagtcatacatacggcctaaaattaagcaggttagtctgtatttgccactccatttattatatggagccactataaaggtcaaaaatggtcaggaaaatgtggcacatatacaccacagaatactatgcagtcataaaaaagaacgtgttcatgtgatttgcagggacatggatgaagctggaagccatcattctcagcaaactaactcaggaacagaaaaccaaatactgcatgttctcactcataagtgagagttgaacaatgaggggaacacaaggaggggaacatcacacacccgggcctgtcaggggttgagggggttaagggaagggagagcattaggacaaatacctaatgcatgcgagacttaaaatctaaatgacgggttgataggtgcagcaaaccaccatggcacatgtatacctatgtaacaaacctgcaagtttgcacatgtatcccagaacttaagtttaaaaaaaatagtcagttattggcaatttcatataattgaacttaattactgtagcgtaagtctctaccaatttcctccctactttctcctttcatgctattatgaggacataagaaaatccttggagacacacactacattccagcattaatggaaagaccctacaagaaaagtaggtactctgagcagaactcaaggaaatagagacacaaaaaacccttcaaaaaattaatgaatccaggagctggttttttgaaaggattaacaaaattgatagactgctagcaagactaataaagaaaaaaagagagaagaatcaaacagacgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaagcaggaagaagttgaatctctcaatagaccaataacaggatctgaaattgtggcaataatcaatagcttaccaaccaaaaggagtccaggaccagatggattcacagccgaattctaccagaggtgcaaggaggaactggtaccattccttctgaaactattccaatcaatagaaaaagagagaatcctccctaactcattttatgaggccagcatcatcctaataccaaagctgggcagagacacaaccaaaaaagagaattttagaccaatgtccttggtgaacactgatgcaaaaatcctcaataaaatactggcaaacagaatgcagcagcacatcaaaaagcttatccaccatgatcaaatgggcttcatccctgggatgccaggtggttcaatatacgcaaatcaataaatgtaatccagcatataaacagaaacaaagacaaaaaccacatgattatctcaacatatgcagaaaaggcctttgacaaaattcaacaaccttcatgctaaaaactctcaataaattaggtactgatgggacgtatctcaaaataataagagctatctatgacaaacccacagccaatatcatactgaatgggcaaaaactggaagcattccctttgaaaactggcacaagacagggatgccctctctcaccactcctattcaacatagtgttagaagttctggccagggcaattaggcaggagaaggaaataaacggtattcaattaggaaaacaggaagtcaaattgtccctgtttgcagaccacatgattgtatatctagaaaaccacattgtatcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggacctcttcaaggagaactacaaaccactgctcaatgaaataaaagaggatacaaagaaatggaagaaaattccatgctcatgggtaggaagaatcaatattgtgaaaatggccacactgcccaaggtaatttatagattccatgccatccccatcaagctaccaatgactttcttcacaaaattggaaaaaactacattaaagttcatatggaaccaaaaaagagcccgcatcgccaagtcaatcctaagccaaaagaacaaagctggaggcatcacactacctgacttcaaactatatacaagcctacagtaaccaaaacagcatggtactggtaccaaaatagagatatagatcaatggaacacaacagagccctcagaaataacgctgcttatctacaactatctgatctttgacacatgtgacaaaaacaagcaatggggaaaggattccctatttaataaatggtgctgggaaaactggctagccttatgtagaaagctgaaactggatcccttccttacaccttatacaaaaattaattcaagatggattaaagactgaaacgttagacctaaaacgatgaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacttacaaaatgggagaaaattttcgcagcctactcatctgacaaagggctaatatccagaatctacaatgaactcaaacaaatttacaagaaaaaaacaaaccaccccatcaaaaagtaggcaaacgatatgaacagacacttctcaaaagaagacatttatgcagccaaaagacacatgaaaaaatgctcatcatcactggccatcagagaaatgcaaatcaaaaccacaatgagataccatctcacacgagttagaatgacggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatgaacccaaaggactagaaatcatgctgctataaagacacatgcagacgtatgtttattgcggcactattcacaatagcaaagacttggaaccaacacaaatgtccaacaatcatagactggattaagaaaatgtggcacatatacaccatggaatactatgcagccataaaaaaggatgagttcatgtcctttgtagggacatggatgaaattggaaatcatcattctcagtaaactatagcaaggacaaaaaaaccaaacaccacatattctcactcatagatgggaattgaacagtgagaacacatggacacaggaaggggaacatcacactctggggactgttgttgggtggggggaggtgggagggatagcattaggagatatacctaatgctaaatgacgagttaatgggtgcagcacaccagcatggcacatgtatacatatgtaactaacctgcacattgtgcacatgtatcctaaaacttaaagtataataataataataataaagaaaagtaggtactcataggtgcccatcagtttgttccctcatttttctcttcctaaaaatcccatcgtgttgctttagtctagtacagcttgatctatttaaagtcatctgattagaaataattgttgacacatttctgttgtttactgatcagtcattttaactagcccgactgctctcaagaaatcctcggacttatttactgatttgaaatcaatcatattccttaccagcacaatacgagtactttaacaaaggcacataacagattttaatatgtgagggcataaaggagggatagaggtagtgaaaaaaaaaagttttttctcactatgtttttcatggagttcctttatcaaaatcacctggggcatttacaaagggcaggttcccaggccccagccaaaaaatgtcaaaccagaatctctcaagtgtaagccaggaatctacatttaagtaattaattgttctaatcaggtattcactatactagaatatacaaagtataagatgacaaaaccctatgtacccaccacctgggtttatgaatctgaacattttcctatttgttagagattttgtttatactattttggtctgttttatttctatttgattctgaaatgaaacatttcagagatggtgcagaataggtgggaatctctctgcttccacttccctccttaagttcataggtaaccaccatcctgaatcatccaaagtggccatattttgtatgtctgcactcaataaaatatatatcttttatatgttttgtatatatatcttttatatgcatgttttatatgttttttgaattttatatcaaatcacatcacatggtattcatcattttgcaacttccttttgttttcagtattaggttatggagattgttttcattggtgatacttttaactcaaggccaattttttaaattgctatagagtgatatttgcatatgtaacaagttctatgagcaaattttatacacatgaaacttaggatgtagaaagacagtgaaacaggaccaaagtgataagtccagagaagaataacatgggacccctagacgccagcatcagggtacatgggtacacctgtcactgaacatgtgaacagtcaaaaagaaatgaccctcagctgagcagtgtctaggtagaaagcatcctgaaaggcttttttccttttcacaaataagaaacttattttagggtgtgccactcccaagctgtatcctaactttggcatagttgtttgaaacttcccaggagaaatttcgagaagacatacaagaacatcagttggacttcttggggtgaaattacataatgctacttttcagaaatattctttatacctgtatacattcaatagttccatatttatcagtttgtgtatatgtagagaaaaaaaatcatgaacatactatccagcacttcttcttcaagttatttaaaggctcttaatggtaaaaaagaaataataataagataaaaattaaatcagccggttgcagtggctcatgcctgtaatcccagcactttgagaggccaaggcaggcagatcatgaggtcaggtgatcgagaccatcctggctaatacggtgaaaccccatctctactaaaactacaaaaaactagccgggtgtggtggcgggagcctgtactccctgctactaggtaggctgaggtaggagaatggcatgaacccaggaggtggagcttgcagtgagccatggtcgcgctactacactccagcctgggtgaaagagcaagattctgtctcaaaaaaaaaaaaaaaattaaatattttaccctgtttaaacatcactgagaagatgaaggggaaaattaaacatatccttatatgcttatgcttaaagaaacagtttttcacaacaagtgactaataatatttttaaatttcaaaatgtatttacttaaatcactagcaaatagtgatttatttaatttatttaaatactagtaaatcacttaaatcactaaataaaatcactaaagtgttttaaattacatcaaatcacattgtatggcactagttgccactgacttaaaaaaaaataacatcgtgggccaggcgcagtggctcacgcccataatcccagcattttaggaggccaaggtgggcaaatcacaaggtcaggagttcgagaccagcctgaccaacatggtgaaaccatgtctctactataaataacaaaaaaattagccaggcatggtggcgcacgcctgtaatcccagctactcaggaggctgaggcaggaatatcgcttgaacctgggaggtggaggttgcagtgggccgagattgagccattgcactccagcctgggtgacagaacaagactctgtccctgccccccagcctcaaaaacctcaaaaaaaatgataacatcgtgtcaaataaggatatttttcttagtttattgcatgtattgtataagctaattcactgaatgtttgctttaactcacatctgcaaaatcttctaactatattttatgtgctcacttacgaagtctctttgaatcttatcttttccatatagagtcccattatgtcacttcttagaaaatgtcagtttgggtttatggtagaaagccaaggtcataatgctattcttttctatctttgagctaaaagaaacagtgcaaatattcaggaatttgtgcaatctatgagaagaaaactgcaatcccgatgagtcataggaagaacagatcacacattaaattggtcaagccaggattcaacatattgagagtgatggtcacaaaaggagatcatcaccaagttctcaacaaaattagctgtgcattagttgtactggcaaagataaattgtctatacacataaagatggagattatcttaggtatactttagtaaccacatttattgaatatatgggcatcttttcataccaataataaggatactcagtcattatgttaaaggcttcagcatatgtcaatatatgaatgtaccaaaaaatttttaattcctcataattcaacaaaggtaaaaagatagtatatgaaaaatatattataaagtatgttatgcagttaaggaataaaattcctggggagctttttcgtgtttgtggtgtcagctttttacagactgtaatttttttgtgtttttgttttcaataagcgtttatttttatatcactgatataattcaccatcatgtacttgttggagtaatttcaaactgtaacatgtaggtttctttgcccctctcccagttccacattcagctcccaaggatgaatgttgtattagtctgttctcacattgctatacagatactacttgagactgcgtaatttataaagaaaggggctttaactgactcagagttccgcatggctgggaggcctcaggaaatttatgatcatggtggaaggctaaggagaagcaagtaccttctttactaggtggcaggagacagcaatagagcaggggaaaacaccacgtttaaaaccatcagatcgtgtgagaagtcaagcactatcatgagaacagcatgggggaacctcctccatgatccaattacctcccaacaggtccctccctcaacacctggggagatgagatttgggtggggcacaaagccaaaccatatcagatatccttccagatttattttgtgcatatacgtgtatatatatatatatgtgtgcacacacacacacagagaaataattttgcattggatgtgtctgtatgtgtgctcgtgtatgtgtgtgtgtaggagagagagagagaaatatattaaggattttatgctgtacagcaggggtgttcaatcttttggcttccccgggccacattggaagaagaagaattatcttgggccacacataaaatacactaacactaacgatagttgatgagctaaaaaaaaaaaaaaaaaaaaatcgcaaaaaaatctcataatgttttaagaaagtttacgaatttgtgttgggccatattcaaagctgtcctgggctgcgggttggaaaagcttcgtgtagtgttctttacctttctttccctacttagcaaactctctatagaacactttccttatcagtagcagggtcccaagtactgttgggcaggttatgccccgcacaaggacaccagactaaagtgctgagtgggggctgataggcaacctgtgttttgctcattaaacatgaaccctagcacatgggtgcatccattcaaaccggcatttttttttttttttttttttttgagatggagtctcgctctgtcgcccagactggagtgcagtggcacgatctcagcttactgcaagctccgcctcctgggttcacgccattctcctgcctcagcctccctagtagctgggactacaggctcccaccaccacacccggctaattttttgtatttttagtacagacggggtttcaccgtgttagccaggaggtctctatctcctgacctcgtgattcgcccacctcggcctcccaaagtgctgggattacaggtgtgagccaccgcacaaagggacatttttctaacttgcactgaagcattacgtaggttactcatggccctgtcagtgcatgtgaatctgcgtcatcgtatgcaactactgcattgtgatccaagaaatgatggtgccataactcattaagttaaaattttctattgatagtaagttatttccagttctttggctactagcaaaaaatgccacaacgaagacagtattgattatactgtctttgcatgcgtgcaagtaattttctaagataggtatctaaaattaaattaccaggttgaagaatgtgttctactttaaatttcgatagagactcccaagctactctccaaaggggaaaaaaattctatttccaaaatattgtcaaacttgagtgtggtcatgatttcttttttatgaaaaaaatattaattctcattcataattaattagtattgttttaattaccagtgatgctttggggttttaaatcattaggaattcttctattaatagactctttatatgctttgaccaattttattaggttgtctttttataactgcttcattcattgtcgtacatatgatctaaatattttctcccagtctataattgtattttaacatttatcaatcttttctttgtggacactttatacagtgtgctgtttcatagaacatttggatttttaaaaaagattttacaattttgactccttttctcttgcagatgaaatttaaaatcaacttttacctaagcatttgtggatgaaattatatggtctctgggatttacctaaaacactaaaaaaaatgtgaagagggataaatgagcaaaatattggtcatttttaatctgacagataaatcaaaatttattatttttctgtattttgtgtgtatttaaagatatccacactaaaaattttctagtctctttccattttctttattttgtttcatatttttaatggactttttaaaaagcagttttaggtttccagcaaaattgagtggaaggtacagaatgttttatatgccctctgccaatagccaccatcaacatccagcaccaaagtagtacatttgtaacaatcaatgactctacaatgacatgtcagtatcactcaaagttcatagtttacatcagtgtctactattggtgttgtacattctatgggtttggataaatgtataatgacaggtgtctaataatatataatcattcagaatagtttcactgccctaaaactcctctatggtctggattttcatcccttccttcttggtagccttcttaccctctccatagttttgcctctccagaatatcatataattggaattattcagtagatagctcgtcagactgacttctttcacttagtaatatgcatttaaatttcctccatatctttccatggtgtgatagctcatttgtttttagtgctgaataatgttttttgtctaaatgtaccactgtttatccattcacctactgaagggtatcttggttagttcaaccttcagcaagtatgaataaagttgctataaacatctgtatgcaggtgtttatggggacatacattttcaactcatttgaataaaaataccaacaggtatgactgctggataatatgtttcttggtcttcattttcgttttccaagaatcagctctgcaggtgggttcattttttaaaaacccataaaacccatgagggtttcatttaggctcctttgagtttttaaattaattcaaacagaatatttcattcattctttcattcaacaagcatttattgtgtgatgattatgcgcctctgctgcagattcttggtttgcatcagtgaacaaaacaaaccgtgattacccttgtggggctgacgatctagtggggaaacagagagtacacataacaaattagttgtacagtatgttggaactttcctctccagagcaagtatatatctttccatttattcagtcttttacattctttggtgacatttttgttttttttttataatggtcttgctcatttctttttttagttacttctaggtattttatagtcttttttgccactgtgatatgaggggtttttcctcctattccattttttaaatgattaacgggagaggacaagagtggtcttgcgtttttctttgttaagccaaattctttgatttgttgaaattatcagattttcgtattattctcttggatttttgaggtacacattttcttcctttgtaatataatcatctctgttttgttgttgttgtttctgttgcattgggcagaacctcaagtgtaatgttgagtagaatatgtgataacaagcattcttactttttcctagttttatagaaatatttccagtgtttcctcattatcctcaatgcttgctttaagtgtcttagactcataatcaggtgaagagcattgccttctaagtccttgccacttaaaagaggtttttttaattttaatttattttgttgtttgtaatcactagcaaaacatttcaaatcagtttgaaatgttataaatgccctttttgatatttacttgtcgtatttttttcttaaatctgttaatataggagattaatgacattcttattgtggaattaccctaggtgagactctaattcctgtcaccctaattttcatcagaaaccatgtaacggttttctctgcaatctactaaaatgttcctcaaacctagctgtgctatgaatacatccatggaactttttaaaaacacatagcttagcctccccgtaggcctactaaatcatgtaccaaattctacatgaaccttagcacgtagaagtgtccaaagctatacaagtatactgacaatctgccgctattgaaaactactactcactgaagctgtaaaattaaacataaagagacaaatactatttattcattcaaagaaacaagcctttgagagacccctctattggagtcacattgctcttgaagccaagggtttcgtctgatatacccagcaagaagtgggttaagccaaaagaaagttattacatgaatgaaaacacagttgccagataagacataaaatacccagttacactttaatttcagataaaaatgtttagccacagtaggtccaatgcaatattgtcttatacaatatttggaactacttccactaaaaacttattattttttatctgaaattcaaatataactagacatcctatcgttttatttgctaaatctgcaaattcaaattgcaaatgagggagaggatgacatatttgagagaccaaaacaagctctctacttgtagtaaagcatttcctaaaacatagtatggcttaattgagagtatatcagatagcataaagaatctttattttgataattttgtagtttaatatgtgttagaaatatatcagattatttatgtattatataccatgtatatacaatatttaaaatgcagctataaaatattaaggaagatacagtggtaaaaataataactacaaatattaaggaaaatatagttgttggactcaggatgattgacattcggaggccagtgggctgaatcagagagttacaacagtgccggtagaaaagtagacagaagtcaggtcaatacaagactttaaaaaaaaaataaggggtacatttttatgaaaaaggaatacatgtttacttatgtctttttttgttgttcatggcaaaggaaggatcatcataatattcctaaaaacaatttatggaatttcagtgttaaatagatatttttcttatgttttcaaaccaagaaaagtcttgtctgctttaagacctgagccaaagcaaagagttactaagtattgtaaaaaataaaaataaaaaagagtcacaggaattggcagataccacataagcatgatagtatggaatacatatcagctcagcaggactgatcctatattctataatgtatttagtgacctgagtgccaatctttaattttagcacttaaaatgaagactggttccagcatacttacgaaatgatttaggtagaaattatatcccagtccccaaaatgggcctcagttctccccgccggttcacacctgcacttctgaacacttctcaggacgagctgtatcaatatcctttgaaactactcaggaaactgtgtatggaagttacaaaagttctggctaatcagtgctccgtttgaagcctagttggagtttaaaaacctagcaaaagagaaaccaattttcttcaacatgtcttaataagtagaagcagattaatagcagataaatttaaacagataatataaagccatgatcgctaattaatgattacatgtcagttaaaagattgcttgttgcaactttaaataacaatattatctatccatcatcatgacctaatattatagtcatagtggcacatattattaataaaagataatatgcctagaacttggagttgaacggaatatatctagcaaacaggaaatagttgttgttttctttcctgctagtctacataagtttcaaattgaaacacagtggaataaaaattaagactgacttatttaacttgcctagaaattctgacttaggataattacattatcgttagcttcttactgtcaatttacatgaaaatcttcactgctctaaaaaaagagatttaataacattctggtttttaaaacaggatattattttaagaaaggaaagtctagaatgagaaatttattgtcaaatgaaacatataatgctaatatgagatttttacactagtccagctggccaaagatcaaatacttcaggatgaaactgagccaagtcttttgctaaaaggtccctttctttcacgggtgagtgaggagtattagcagtccagaataaccagtaacacacatatggaattgaagacagcataggggccagaaccttgtgtcaggaagtttcagttctattcccggtttagcatttaatttatcatgactatgtgatgccaccgttcattgacaagcaaagcgttcaagcaatgctatatatgccaaaccaatcgtccactatttggaagcatctgggtattttactaaactttttggttctcttccaaatgctggcattaggaaaacagagcctgtgtctctctagaagaggcacactcttttctggactttatatttctccagtctgcaaaatatccagtaatttgcacctcctccccaactgccttgtgtgtgtgctgtgtttgtgctgttcagttaagagcatttgtagaaagaggggtgttgggattatctttcccagatggaaggaaagaagcagagaggagactcctgttgtttaagcctcacagaatctgacacttttaggaaagaatgattctctaaaaaccctattcatcttccccagataccactgcaatcaaagaggcttcactgcccaggaactaaatagctcttccaagtaaattaggaacttctttcagatttccagtttaccaccatgggcttggacatcttaggtttctgacagtaaatcaaattgaattgaaatttctctcctaatttgcctcgtatctattgacctatgtctgaaagagacacaagtggaaatttcttccacagcagctacatatattatctaaactttgacagcagctggttgcagtcccaaagcaacaggatgtttctgttcttagcactacacagacacataatgggaaaaagagacatacatcacagcattgactcaagttcagctcacagtcagctaaatactttttcctcattaaaaaagcagactgtggctattccattaagaatagcctgttcatgttctaaacaggcactaaattcttagtctgctttaaagagggtatatagaacacagaagcacttgcctagtctgccccagtcagagaacacatagagtaatatatttaattctgggcaccaacagttaattgagtcattgacagaattatatcatatccagagaagagtaaacataattaccgaggatttgaaaacatgtcatatgagaaataattaaaggaactgaggatgattcacccaaaaatgaaagaacatgggcaccacatcattcttgaaatatttgaaaggctgtttcatggaataaagacactgctatttctgtctgtttcttgtgggacaagctgagaagttagagtaaggcagaatttgacactataaacttttttaaaatttatagctgcacaaatatgaaataggttgcttcctctgaaacagtgtacagcacatagtggtcaataaacataccttaaatgattgctaaataaaagtttaaagaactgggcaaggtcaggcgcagtggctcacacttgtaatcccagcacttcaggaggctgaggtgggcggatcacgaggtcaggagttcaagaccagcctggccaacacagtgaaaccctgtctccactgaaaaaaaaaaaaaaaaacacaaaaattagctggggatggtggcaggcgcgtataatcccagctactcgggaggctgaggcaggagaatcgcttgaacctgggaggcagaggttgcagtgagccaagattgtgccactgcactccagcctgggagacagagctggactccatctcccaaaaaaaaaaaaagaagaagaataaagaaagagagagagagagagagatgaaagaaagaaagaaagaaagaaagaaagaaagaaagaaagaaagaaagaaagaaaagaaaagaaagaaagaaaaagaaagaaagaaaagaaaagaaaaaagaaaagaaaagagagaaagacagaaagggagggagggagggaaggaagaaaggaaggaatgagaaaagagaaaaaaagagaagaaaagagggcaagacgacttcacaggtttcttgcaattaatgttgtagtaattgatggtctttcaaaacacagtttctgtatattgacaggaagaaaaaccaggatgcagaagttgaggagagaattcatgatacccaagtgggcataaaatttaaaatgtttaacatggagggaaaccaacatgtagaactcgaaagctaacaggaaggggagtgggaagagccaggctctagtctcgactttaccagtggattttaaaaactccctggagttcagttttctcatctgtaaaatcaaggcactggaaccttgaacttttatatttccgaattatttggtgttgagtgaagtgtccaaatgacatatcagtaacttaaagaattgtgttttgacttaagtataaatgtcaatataaaaatatgttaattgttgggcactcaaagacataaagatgggaacaatagtcactgaggaccacagaggggagaaggagggagggaggcaagggttgaaaaactacctcttaggtattatgctcactacctgggtgacaggatcagtcataccccagacctcagcatcacacaacatacccatgtaacaagcctgcacatgcagttctgagtctgaaagttgaaataaaaaatatgttaattataataaattttaaagaagtttacaaacataaataataaatagagcaaggacgagagcaaaaggaaccactactaaaaaaaaaaaatcctccagaagtacacaaaatttatttatttatttatctgagatggagtttcactctcattgcccatgctggagtacaatggcacgatcttggctcactgctgcctctgcctcccaggttcaagcgactctcttgcctcaggactcccaagtagctaggattacaggtgcccagtaccatgcctgtctattttttaaaaaaatatatttttagcagagatggggtttcaccatgttggccaggctggtttccaactcctcacctcaagtgattcacccacctctgcctcccaaaatgctaggattataggcgtgagccaccatgcctggcccagaagtacacaaacttgacatctacaattcatactaaaatttacctgggcaacaaggtaaattccttgttgctcaggtaattccttagtaatgttaatccctgttgcccagggaattccttccaatattaaggaaaataaatgtatttaaaaaataaaatgtgttattttagtatgttattatgttgactaaaccataattataactatatatgtaactatcaatgtttctattcaagtcaaattctaagacgaattctctatccttctggccccctaccccagtgtgtttcggagtcaccatatgccagctgacactggttcacaccagctcgaacgggccaattatgcacatttcttccaaccctgcagtcagtaacatcttcttggcagcttgaaatgggtcaggggagtatttacaccacggaaatccacaaatgctacaaataaggactttcattctatttggagattcagttgctaaacacttaccaacataccatagcccacccatttcctgctcctaagaaatatgctccccaaacagtgccttttcctattccactttgatcttaaaatgtatgaggtcttgtaataaaataaccttgtatttctttacaatcactgaatatgtgttcaatttagacttcagcataacaagaccaaaactagaaaaaataaccttaggataaagagcatgcattagtcatggggcattactggatggaaagtattgtaagatttcaaaaatgtttgattcacaatatgcattaagaaacctgtaatcccagcactttgggaagccgagacgagagtatctcctgagtgcaggagtttgagaccagcctgggcaacatggcaaaattctgtctctacaaaaaataccaaaaaaaaaaaaaaaaaaaaaacagccagacctggtggtacatgcctatagtaccagctacttgggaggctgagatagaaggatcacttggatcccgagagatccaggctgcagcgagccaacatcgtgccactgcactgcactacagcctgggcaacagagtgagaccttgttgcaaaaagggaaaaaaggaaggaagggagaaagaaagaaatccaaaagtttataaaatgtactaaaccactcctttgcttatatcttgacagaggcctccgttacacaaagaatgaaacttaccactttatagcaacctttaagttgccaaacacaactttggtttaaaagaaaaagaaattatataatgaagcccatgggaagagtgattactgggatttaattactatttaatcagattgttccattatctggaatattcagaagggaattaacctaaataagttataagcacaatcatactatcaataacacttctttgaatgtaacaaagctctgtagcagtgagggataagatacatggaaaagatcaggtctgtttgcaaatatcatggacccctttataagaatagtttatgatgacaaaaaaatgtagttttctgtcacagtcttgtttcaaacagcagggacaataggaggagactgaagtaataacaacagcatagtattctgaaggaattagcatacctcaaaaaattcttaacgtattctcaaaattaatctgtctttgtgaaaacagggctagctgtttcaatttgcattaatctgttaaaccatgcacaagttcggtttacttaagtaacatatccaatgttagcttaattgattgtctgaaaaatttaatctgattaaccaattatccgacatgtgaaagataatacctgtgtaatattaacaatctgctcttgctgtttaagatatacagagttctataaaattagattaacccacaaaattatcctagaccctgttctttgggggtgccttttaatggtggctgggggaatttagaaggattaaaataaatggcaaaaaattaaaaaaatgaagttgtgattcaggccatcatcaattttcatctcacaacgaaccatcaccaaagtgaaccctcaatctgcaatcactgtactgatagccctcaggcttctgtcaagatgtatttttccactgacatcagccactggtggtccttttaaagctgatttcacccagatcaatacaatcagacagatggagaggatggcaacataagtcacaaatgatgacttgcctcaaaagagccaacactgcatgtgcgacatttctctgtagatgttgcttttgaagaacctaactgtgctttctacagtatttttttttagccaataccgtaccccatcctaataccttgtacaacacagggaatctggaagattcctagaactaattgacttgacttaaacacaccagaatggttgagtcatgcccaagtaactctatatgctctatgagaagctttagctactcctatgattaaaaatatttctatcaacatatgtctgtagtacagagaactgagaataagtaaccatactcatttacaaaaatacaaattgttgtgggagctgttttataagtgtgtaaaataaaagaaactcaagagaagagattttagtaaggatatatctttaagtagcagtggctaaatggccctgtgctaggaaaactgttcccctgcacaaactgaaaacttgcctcgcttagttcttttccagtgtttttactatactgcaaaagagtcttccaaaaatataatctcatatgcatccctaaatgtctagccacaaataattattagtaccttttaaataatcaatttgtactctgaaaaaagaagaaaaatatataacctttcccaaaaataggtagtgggaaaatagtaaatacatgccattactcataggtgttatacttcttttttcattgcactttgctttacaagatatatatttaatattcatgtaaaatgctttcttggcactaggtcagtgtcttcccaatgaagagcccattgatgatacagaatggaacttctcttctaattaaagactgcctattatccagtgtactttttgtcacattgaagaacagggaactttttattcttattaagaaatggcctttcagattcagtaacaaaatgttctgttcctcaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgtgagctttccactttctacttcttttcccataggagtcgtaactcttgaccttatacagtccctcttgcaaaggcaacatccttgttaatggcatctaacaacatgtaaccccagtacagtaccataaagataaccaaaatacttctatgcatcatgcatacattctatgcataattctatgcagagaggccacagagaaatgggtgatacaaaagaacttgtttatcattaaacaggaaggaaagtcaccttaggaaattatggtttgtagtgatcaaaccttccttaattgtcagtcttctctgatacgagagagactctgttagcaagcactatgtctatgactggcccacaaatctgtattgcatatagaagaatcttattatagatttgctgcatgagtaaatggatggatggatggatgccagttgaactaacccaacacactacaagaaacaatttagatgagattaacttgggaaaactctaaaattcacttagtgaaatacagtgaaagagacagagctgagaattgtattttattatgcatcagttttacataatatagacactctcttaagagtccaacactcaaaatttggaagacagattctaggatcaactatatgctttacatatttactatcagcatcatattaaaggccttagtttgtgcagatctaggatggttgagtttacttataattaagctatgaatcacttttcaactcatctattatttgtgttattcaataataaacatattaagtcaagaaatttgtatttacctgagatcaaagcagtagaaaatcatatatataaatttgagcacctactgaaatataactgttgcatatcaaattatttgatacaaattcttctgcctttatttaaattgtaaactgggttttatattgcacacatcagcccacagaatataacaattgttagctctgtaaatagagatgtattcagaataggcaaaataatacagtggaataacattatgaactttgtagtgtaaaggtctgagttcaaatgtcagcattatacctgactttctgggaacatcaagttatttaatttctcaactgcaggttcatgtgaaaaatggagatgttatttcctaactaatggctcgttgggaggcataaatgaaaaaatgtatataagaagtaccgcacggatcaagcacagagtacatatttagtgatggtcagttctccttccttccccttatactagactcactcacaccaggccttgagctagagatgaataagacatatcccaaagccctcaaaactcctttttgatctttatgatattctaggtcacctcttgttctttatttatgttccttggaatttaaagctaattttaacattctttcaccatcaaatttttttccacagaactttccactccttctgataattgtgtagtggaataagaggattataatggcaggattaggacctggaccatctaccaaggagcactgacccagatacagaggacaaactgcctctgccccatcctcatacttcactgtgaatttatagatcagcaggaagaacaagacacaaagtgaaacactcaccgcccccctaccccaccccagtttgagaatatttatgagaaaacgccagaagaagttctgcatataataaaaattatcaagaataatatagtctttaaggatgtctttaacataaaaataaattaaagcacaggtagagataaaggtttaaggaggctgcatagataaaaccttatagattggctatggcctgatgaattgacacagcccaggatccggtggttttctcctttgcaagcctggttttacccaggcactcagagtgtgccagtctcttagggctcgctgagatagccaatctcataggatgaatggggataggggatcagatcaagactaagtatttagtgagtgctaagctttatgtaagttacttcatttaacctcttgacagtcctaccatgagaaatgtgagcttcagagagagaggatgagtaatttacctgtgttcacactgacggagagtggtgagttatttaccaaaggtcacccagcaggtgagatttgcatccacattagtcagactccaaagcctatgctcattctgctacattagaaaccttcccaacatgccagttttttctttacaatgagataagtaccacttccagaaccagaattccctggttgtcagacagtcagagcatgttcttcctaataatgacatatttttgaagtttgaattaggaatagttttctagtcaatgtgtaattaagggaaagttgacggtctcttgggatatttcactgataccgtagggaagttcagacacacacaggccagaaccactgtaccacctttgattgggcctcccctgctgttctgcagtatcttttggtctccctggatcttctcccacatttcaaggtggctattcaacaattttacttgcacttatctcttagcatccttacctcttaacactcttgccttcctcttctcatagaaaattgagaccattgagagatgtcccggcatcacacctgcaaatagctataggtgcctctttgcttctttctctcctccaacatcaatcaaagatgtgttgctcctgtcatctaatactgatctgtctccatcctcatctccattccttcccacctcctgctttgctctaccagttattcagactctcacttaggttcaaattccattgctctgttcctactagtcctcaccctttttctctttagcaagtatagttgggactacaggcatgcatcgccatggctggctaattttttttttttttttttttggtagagatggggtttctctatgttgcccagctctatgttctagggctcctggcctcaagcaatcttcacacctcggcctcccaatgtgttgggattataagcatgagccatcatactcagcctctttcttgatttaattattggctattgctccatcatttctccccatcctttctcttatttgacagatccagcagtgccagtgcagtctctcaccacaacattctgtattttctccaccacctacctattcaataaatccttccttagtttgactctgctgttagtggatagggagaagagatgtgatggggaagagttaattgttcctttttcctcttgactctctttctggaattgctctagctcatcccttcctttataagccaaactttaatctcctctttgtcttaatttctttcttgatttataatttatttttattttttagagacaaggtcttgttcttttttttgagatggactctcgctctgtcaccaggctagagtgcagtggcgcaatctaggctcacggcaacctctgcctccctggttcaagcaattctcctgcctcagcctcccaagtagctgtgattaaaagcatgcaccaccatgcccagctaatttttgaattttcagtagagacagggtttcaccatgttggccaggatggtctcgatctcctcacctcgtgatctgctcacctcggcctccagaagtgctgggattacaggcgtgagccaccacacctggccaaggtcttgttcttttaatttgcatgcttaatatgtgttgctcaggctggagtgcactggcacaataactcactgtggcctcaaactcctgggctcaagcaatcctcctgcctcagcctcctgagttgctgagaatacaagcgcacattaccatgcctggctaattttttttttttttaatttttgtagagatggggtttctctacattgcccaggctggtctagagctcctggcctcaagcagtcttcccacctcggcctcccaatgtattgagatgacaggcatgagtcatcatacccagtctctttcttaatttaattattggttattgcgccatcatttttcctcactccttctcttgtctgacaaattcagtagtgccagtgcagtctctcaccacagcatcagatgtgatttacctgcttctcttccttgactttcactgctctcctggcttctggctgctctccatttttccttctattcttcaacagttgctttccagacccttcagtggctcctcttcctatatctgcccctgaaatcttatatctagattctagactcaattctccctttatctggctttgaatattctccctgggaatcaccacagcttccattcccttctctatattgagggtcagcagtgagaccttttcttgtggtctccagatcagaacaaccaatggatcacaagatgcacccttccctgggccagagttgagtggtataagcacttctagcacacatcacactggagtccctgccatgataaaaaccccacagagagctctatattcccaaagaatggcataactggaggcatagggtaacactgatagatggagtcttgcaggaagatggcctgtaggattaattacacaaagcaagttgggttggggggggcgggtaacagggaaattatgagtggcagttgtaatgagtacccagggtttattcactgcttggtctgcttatggtagcagtggaaaattaaaggagggagcggatgtgagagattttgggagagcttttgggtaatttctcaaattgaacagagaacagaagagaaaataataaagatttgtactaaactacacattgatggtcctattaaaattacttatttagttgtgtttgaggcctctgcagaatatcatggtggttactttaaaaagttggattctggggtcagacacacctgaactctaatgccagctctaccttgggatacgactttggtcaagttatttaccttaagccttggcttcacccaccatctctcgtgtgatgatggtaacttccacgtagaggtgatgaacattgaagcagataatggttgtaaagccttgtctgtgaaaggtaaaaatgcaataaacggtagtttttaaaagttattatttcaccttggaagcattacatggttcaaaagatacaagattactctgttatttatctaatcaaatcacaaacaggaaattaatgcaaggccaggcgcagcagctcacgtctgtaatctcagcactttgggaggctgagacggacggatcacgaggtcaggagattgagaccatcctggctaatacgatgaaaccccgtctctagtaaaaatacaaaaatttagccgggtgtggtggtgggcgcctgtaatcccagctactcgggaggccgaggcaggagaatggtgtgaacccaggaggcggagcttgcagtgagcagagatcgcaccactgcactccagcctgggcaacagagtgagactccgtctcaaaaaaaaaaaaaaagaaagaaaagaaattaatgcaaaatatttctgatatacctaaaggtcaaatataaatggcttataaattacctgctacttatgattatgcattcaatgtttataaattatctgctatttaagactacttgatgttgatccaatttgaaattctaatgaatcatattcttagggtaaaatgtagtttgtcttttctatgcaaaaaaacaaagaagaagaagaagaagacatggccctgatccaaaatcattccaggcatcagaaatttgctcagagttatgtcttctacacacacgcacacgcacacacacacatgcacatacatttaaagagtgtaacattactttttgctgcgtatgtcttttgtacccttccaactggagaaaatttagttttgatgcttttgatcacataattttacagcagaaacaataaaattacttctattgtgagaattaaggaagaaaaggtattaatatttgtcagtctagtagtttcttcataaaactgtatttaacgatcatgttctatctgccaggcactattctaacacctggggacacatcagtaaacaagacaggtgaagtccttactcttgcgatgcatagattctaatagaggaagacagacaagaattataaagaggctgggtgcggtggctcatgcgcgcaatcccagcttttgggaggccaaggcgggtggatcacgaggtgaggagttcgagaccagtctggccaacatagtgaaaccccgtctctactaaaaatacaaaaaattagctgggtgtggtggtgtgcacctgtaatcccagctactcaaggaggttgaggcaggagaattgcatgaactcaggaggtggaggctgcagtgagccaagattgcgccattgcactccagccggggcgacggtgtgagactccattccaaaaaaaaaaaaagaattataaagagagatggatgcatagatggataggaaggtagacaaatttatagatggtagataggtacctaatagatagatagatagatgatagatagatagatagatagatagatagaatatgtagtagattagcaagcaaagaggattggaaaatagagaatatgttatagaggttgaagggagtgaagttctttggtttgaaatgtcaacggatgcttctctgaggtagtaagattcaagctgacaacagagtgacaagaaggggccagcaaagggaaatactgggacaagggacaagaaagagcacagggcctagtccctcctgtagacaccagcttactgtattaaaagaaattatcaagaggaggtaggactgagaaacaagagaatggcaaagctaagactggagagttggggtgcgggacatgatatttgaccatgtgaaccacggcaaagttgagatgtataaagaggatacatagagatatttaaatcatagttttctcagattaaaagcctagagtgatacgtgcctttgctccatcccctctgcaatttccccctcccacctttcctctgtgcaaccaaaccacctataactcaaagaaagcatatgatatattaaatgcgcagcctttgcagaggttaccaggtaattctatccactcaacagacatgtcttgacctcacactatgtagtagttgctaagaaaacataataataataacaatatttattggagtagctagcatttaatgaaaattattaggagccaattaccagcactttgctttatgcttatgaaactccatgagtgtctactatcattatacccattttcaaacaagggaattgaatgacacataacaagacataattcctgccctcagtttattagatagacatttcagctcaaatattccaggccaccgtaatagctgtcaccatagaggttgaataggaacatagaagagattgaggtaagaagaaatgagaactctctttgtatttgaaatccagtggccctgtgaggaactctgggcagcgctgtatagtcagaggagtgtcagtgagtgattcaaggtcacacagtaaggaaggtgtggctgtgggcttctgccttctaacttctctgcagggccctagctagccacactccctgcctttccaatgcacactcagctgttaaattaccaaatagtatgttacctctttctcaagtatttgcagaccctctgatgagtacaatggttcttaccaaataatgcatgattatgtgtgacacgtcactgtcagttgtcagcaactctttagtgtatcagtgtgcactgggagaaagaagaagtgacaaagttctggtggtaggaagaagggcatttgggaacattcacatgtccttcataccagtgcatttgttttttaataggatctggaatcaggatctgaaagtggagcagataccatttcagtaaatcagacacgagtaaatttgtcttctgacactgagtccacggacctcccatcttccactccagtagccaattctggaaccaaacccaagactacggtgagttctaaataataacagagagtctctacgtgtaaatgttgatgatcatcaggtaagagttgatattcattcgatatagaagaaatactgttggaatcttagccatagtgacttaatgatatttaatttatttaattaagtacaaccctagaaaaatgttttttgttttataaatgataacacaagtacttcactgaaacaggtcatgaatcaagaattattcgaaacgtgctaattaaatttcattgccggatactcagagctttaaagagccaagaatgcaaaatctggagatgcctttccctacactattatcttgacagtattgcttaccagttagaaaattgttcctctaagatgtgatgaatgatagacgacagatgatgatggatggatggatggatggatggatggacagatagactgattgattgataaggagaaacagatgatagagatagatgtagatggatggatagacagataataattatataaatatatttagattgatatagacagacatagatagataataggtttatatgcagagatatataaaacatccacatcaaacattttctgtgggaattaaatgaaagagcacatataaaaagtgcttagtgaaatgatcagtgcagaataagtaatgcataaatgtaaggtactgtcattattattatgataattagtagactttacaatgctattaaaacttattccacatggaataatacaccacgaaaggaggaaactgctttggtttgaaatgcttcatgtgtagattgtgaataaaagacattttcctttaaggaaagagttgaactgcaacaggaaaatagtatttgactctaaaaggtaacacttatgaaggaagtaattactacttcaaatatctaaaatcccagtagttccaaaataacctttcctagtttagtgaaaatcatagtgttgtattattttttatgcaacacaaagaaacaagtttggattgcttgttcactgcatttaaaataaaagtcaagtctaaaataggactcaaaagataatactctgattttaaaacatgacagatttgctgcaattgcaagaagaatgaaaatatgtcatttaaatgacagatacgcatggcttaaatatttacatggaaattatgttccctgtgttatttatatctaaaacatttttatggaataaatatttattgaacatctactatatgccatgcactaggctacatgaaaaagacttggggaggaataaaacatattccttgtctttaaacagcttacattccagcaaaaggaggtaagtatgtaaacagtgaaacgcaatgaaatgctgtacaagctatgataatactgcatatattgggaataggaggaactagaaagatactgcacaatgatctttcggggtaaactgaaaaatcaacagtaatgtgtgccaacaggtacactgaaatggaatggtgctcttcattttcataatgggtaaggaaagttgagatgcaaaattaagataagaaaatggaagatctcattttaccatattctgattaaagaaaatgtttttcttaaaaaaccttctcaacagttttgacttgaaggttttgaaaatcattgatgcattggctttttcttttttttcaacattggggacaggtgtggggctcactttttaaaggtatttattatttaattcactttgtaaagcacctgttagtatcctgcagggcagttcttttctccctgatataattactggtggtatccactttctctcttggaacatacacatttcagtgactgagtgtctcataattcataacaatgagttgaagaatgtgtgcagttgcttactctttcttcagttacccctgtgtttataaatatggtcaatatagttacacagaagtgcgtatacatttttatggtaaccattttttgtaaaagttttttatgagaaacataaactcatcagttttcacagtgttttaatttgttagagtgatggaatctttcttcaatttttttttgttttgccatcaattgaccaccccacaatcgcaattaagaaatatttaaatcaattattgaacagaaaaatatttgtatgtactccaaatcaaatattttctgaaaatatgttaacttggaagcaaattggatgcgagtagtatccagctgttcaggtgtgacttgtcatctgggaatacaagcagagctttctagtcatgccacaactcatcagccagtgagccatgagaattgtcatgcagttgactcagccttcacaacagtattcctcttcaacaccaccaaacactgcaaaataatcttgaccagcagcacaggtggacttagacaatacacatgcagctctgtccagctactggactataatttagtaaagttctctagcaggccatgaagagtacccagaaagaaatactccaccatcaaagacaatcgacttttacgaaatttcttttctttaaatggccaataataagagtaacttgaaaaacaggctattttttcttttttttttctttttttttttgagacggagtctcgctctgtcgcccaggctggagtgcagtggtgcaatctcagctcactgcgagctctgcctcctgggttcacggcattctgcctcagcctcccgagtagctgggactacaggtgccctccaccacgcctggctaatttttttgtatttttagtagagagacggtttcactgtgttagccaagatggtcttgatctcctaacctcatgatccacccgcctcggcctcccaaagtgctgggattacaggcgtgagccaccacacctggcctgtttttcttaaagttccaggatacatgtgcagaacgtgcaggtttgttacataggtatgcatacgtgtgccatggtggtttgctgcacctatctacctgccatctaggtttaaggtgggaatgaaaattagttcaaccattgtggaagacagtgtgttaattcctcaaggacctagaatcagaaatatgatttgacccagcaatccaattactgagtatatatccaaaggagtataaatcattctagtataaagacacatgtacatgtatgtttattaaagcacttaaagcactgtttacagtagcaaagacatggaaccaacccgaatgcccatcaatgatagactggataaagaaaatgtggtacatatacaccatggaatactatgcagccataaaaaggaatgagaccatgtcctttgcaggggcatgcatgaagctacacttttgttttgaggggaatcattctttcaatttgtgtgtgggcatgttattttttcttgttattggtgttgttattcttttaggtacacccttttcactacagttcaaaagtaattcttgggccatggatcaattttatggttggaatatcagaatgaagaattttgtctatgagagattaaacagatactttctcccacaatttggagcttaaggaataaatgatatgtaataacagtctagatactttatgaagagagagaaaactgtaatatcctacagagctgttctttttaccatgaacaaaagttttaattttaagtagaaatatgaaattctaagaacacctacctaacacatcaaactataatgaactaaccctctgctctgtaatgacacaatcattacagcacgactaccttcattccataattaaggttacctttgatttgctgctatgaaatctatttatagtagtgaccacagtaacaaccacagaaatttggctttccttttgtgtgtaaggtctctgggtttctaagtgcctatttttcagtaagattatttttcttttaaacttattcttagaataggaccgatgagtcatcatcagatttttcattaattctatgtgtagatcatgctgaaaattaagcagtaatatagatttctgaggtatatttcataaaaaaatgaaagttaaaatgtaggttatccactgtcaaaaaacacattagaaaaaagaagaggcttatggtgtcatgttaccaagctcatcaatttctctcctaaattgttttgttcttttgacacaatctcacaatgcctttcgtactagactcttccataaacaacccgcgagcccttgtatcatgttatgtaaagtgctttgattcactgtgcaacagtacactgatatcactctcttcagtggcttgagttgttcctggtattaatataggattgtttcacgaaaggttttaaagctgaacattaaaatctctgaggttttgttgtggttgtttttcctaaagataatttacttataagtgcagatattcattaaatcactattaatcaaatatttatgaagaaaagagccaagccccagaaaacaagaaaaatttcctatttgtaaaataagtaactgaaggaacaaggagagtctagcattctactgtgtagaataatcaagaacatcaagagtacacaggatatggcacccagatcctcaatgctcctgaacgctatactttacagggattcacaggctcagcacctggattcagaattaatataaattggcttgagctgttattatatcagaaacaaaatgtcactaatatttgaatgctcaatgcacaagaagagttttactgaacaataaaaaaaatggctggctcctccaagcatagtgtaggttacaggcttttaacatcattttctaaatcatatatccaccacagattttatagatatgtttacatatatgtatgtgtatgaatgaatgtatatatatgtatacatataaaatagattatatatgcatatatttgtgtccttgtgtgtgtacatatattcacatcagatgttatttttcaaaaataacatgtgatattattttctgaagtgttattttgatgttattttcaaaaagcctgtgttgaataattcttaactatacagtagaatttttaaagggaaccaaattagtaattattaagttcttatgtagtcatacaatctttcagtataaattatatttattaattatgtataaaactttctcaggataaacacagaaaccacaaatgcagatttattgttaccaatgtatagtgtggttttgcttgtgtctgggataggagtttcagctctggaatgatctgagaaatagtttcaaaacagaaaagcttctaaggtagaagaacaaaggttaatgggcaccttttacaaacaataatcaacttgttcattattgccactgaaaaagtaatggtagcactacttaaaaataaaaattataatgccaataaaatactatttcagtggagtgttatttattaaagatgtctaagacagtctgattgggagtacgacattaatccatgatgaattagccacaagggattaggaaaaacaattcttattctggaatttattaatcaactaaattcctgaacctgtaaaattatattttaaattatgtatgcataatttatgtatgcatggttttacatattttatatataattttaaaatgtatacatttacacatttctgggaagactgtcaagaactccatcagtctttcaaagactgtgcaaatccccatgaagaaatgctacatttgagttttcacggttcagtcattcagtgaaggaacccagtgttgaacatgcgaacgtctttgctacaaataataaatatgctgcaggtacattgacatttgggtttatttcctaatggatcattgcacggtattacctttgcaataaattaggctatactttaggtatatgtgaaaactgattcttctatgaaactataaaatgtcatttgcatttgttccaactataccacatataagcaaaaataaaactgatccaaaaacaagagaaaaaccaccaaggttttcccttagtaatttcaatgtaaaccaggttttatatttctaaatccaatcacatatcccatacatatgatcattaaactaaagtcactgtgcttgtgatatattagtgagaggtaatgaaactgaaaaaaaaatcttgaaattctacctttcacatcattttaaagtatcatttaaaattaaatttaaaggcaaatttttagtgatagctttattttgttttaccatgttatcatatactatatgtttgcttaaatggttatcagatgaattttttaagaagactggtgattttccctaatgctgttcaatatttaaaacaaaacagaaggataaagtactgtcttttacaagtagaaactggaaatgtttattttcactgaagtcttggggaaagaattcaaggtaatatataaaattggctagaatttaaatagtattttatgtcacatatgttattattagctttcatatcctgaggaaagaaacagtcaacatactaaaggaaaaaacgatatacatggaatttttaagggaagtttagacaacttcttcagaaacatcaaaaaatttgaattaatacagtttttaattaaaacatttaaacacaaatgtaatagtcttagaaaagaatgtcttttgatgtcttgcttttgaatatggcaatttcattttgccatgtcaaagcaatcacattaaagtatgtggatttttaaagaaagatttgcttctgttggtaagatcctcattgtttattagaaagaaaaataggcaaaatttatagctttttaaggaagaactgagtcaccagagagctggaaaaaatatttctaaaaaggaaattgttcagtgattattataatgtgatatttcctagaattctgtgatttaaaagcacagaggatttcattcacctagtctggattttgaaataataaataagtgtgcaattcattaattttggactttgaaaaacagaaatatttccacggccatttacttttatatttaaaataaattcaaaattctctaatttcttgttgttttcagatactgacgtctgtttccaatccatttacatgttaactcaagacagtcttgtctgtgatgggttattccatcttcacggtcacctcctcatatacatctttccactttgaatcttagaatttcattctgtcgagaataacttgtatcttgatatatataatacttagctctgaacacatgatacttaaataattttgggggctggcaaacttgtttttctcccttgtgtttagtttgtagtaatctggttaattaagtatctggagcagaattcataaaaccaaaagaaatacgggaaaaaatgaacacataagaatgatagattagaattgaatagattaatagcataagaaataatatttaaaaatcattcctgcaacctaagactttagtcatatgaatagtactttgcatgctatcatcattacaatgagaaaaatttagtttttccgtggaccaatgtgacttcttgaattcaactcatattttcgtccaagagaaataacaactgccagttacttctgggcaataaaaaatggcaagccaacagcatgccacatcatagcaaccaagagtataattcatagcactgaggagtaataataactggtaagccattttcacagtcttcactttattcatttcaaacctagttgtctccaagctctaattacatattaaatattttcccatatttttctaccttcttgctaacagattgataattaattctgtcccaggcatttgatggcctctgtgctcatgtcttaaagacagttaaagtcattgaaaggtttaagcaaggatttcatgtgaatatacaaagtttacacagagggccttcttgactatagttttgagctgaatcaatcacataccaaatttcaaaatgaaacaataaaaatataagccaaccatatgagtagtctgaaaatcacatatataaatatttggaatcatgtaacagaaatctgaaagtaaaggaattgtttactctgtatcctcataaagtcctaagatgccaccacttgaaaacctcctttatccttgactgttttggttatttaatgaatactttatgtactcgcttcatttatttttaaatcaatcaactatactccttagatttttgttgtcattgttgggttttagcgtttctctagtctttctactttagccagctggtataatccagatgacctcctgaatcagtagattccttcaaaggaaaatccattgatgttatgaaattgactctaattgtttcctctttactgtagattgctttatctgtgttgttgttgttgttactgttgttgttttctttattcattttgaaggtcctatctttgtatcaggactgtagtaatttactagataagcatttaccaaattagttataatatgaaatgcagagaatgatgcaaacaagcactaataaccaaataaatcagggccgctcccaccatgcactctagggcacccccaaaactgccgtcctctgcctgtcccagccaagctgactgagctttatctcttttatatattggccttctttataagatgttctttgagtaatccatgacacagatttcatttaaattctagactaaacaaattataagaaagaggaaaatgttgacaattttttttttatgtccagcctctaggataagcctgtttcatttccaagagcatccccacgaagttgcccccagtacttccctgtcgctaaggcattgcattcatttctaaggtttcttcatcagtgagttctgaaccctggactggacagacaataagaaacaaaaacaaaatgtaaaagacagcagacaccagattagagcaactcaacctagcccgggtctatggttctgctggcccaaatcattgaggtcttaatgtagaacaaattcaatactttagaacacagggttttaggtagatcattggacattattttttacattttttcttctgtggatgtaagtcagaatattaaatgattttttagaagatgaacgtttagaattgaaaactagtagaatttccatttaaagatatttcccaagcaaatattaaccaaatatttaatttcacatttagcatttcgtggatatatcaaagttgtgagatcattctcccacttgtatttgtagttttctttttgtgttaagtccaatgatacacacacacgcgcacgctcacacacatagttttgtcttgctcaaggtaggtgtctacctgcatcgagggaagattgtggggtgggagtgttctgcttccttttcctttctagcttattctatacatcacttgctagcacctttgtgatggggggcagaggccttgcaagaacaggaaagttctcactggatgaaaatatgcaatctgtaggtccacaagatattaatctcttgcctgctatatcgattatctgttgttgtataataaattataaacttagtggcttaaagtaacaataacgcaacctcatgaaagaccttgcctgaacaaaccactcctgaattcctgatacatgcacaccatggaacataattgatgattagtactgttttaagccattaaattaagagggggttgttatgcagctaatctcacagttccacgcatgtcagaaatttagagcaacttagttgtatgggtctttcgtgaggctgcagtcagttgtctgctggaatgcagttctctaaacgttttaccagggctacaagatctacttcgaaattggcttattcgtgtggctgaaatattggtgttcgaacattggctcttctctatgtcatttttctcaatgggaatgcttgagcattctcatgtggtggcacctgacttccaccgatgcaagtgaaagaaatcaaggaagtcaaactgtcttatcttctgtactgtactgatcacgcagactagccctgttcaatgttggaaaaggtctaaacaagggcatgtttataaaaagaattattgggtggcaacttggaggctggttaccacaatgtgacaatgtgccatgtctctaatgcaagcaaaagcactagcctgctccaaatggcccccaaaagatagcatctgttcaaagttcaagattttgttaaataaatcagatccaggtgcagatgagacgctgcaggtctcaggtgcacttcctcaagcacagcccctccggtatagttcctctttctctgaacatatgcaaactcacccaacatacagtggtatggcagatatggaataacaaccgtagaccctctcattcaataaaaggaggaaacagaaggcacgtaagtgtcactggtctatacaaatcctgaaaaacaacagggcacatatttgaaggtctttggctggaatcattcataccgcttcctggggttgatccaccagttccttcctgtgagatgtgccctttgagtcattcttcctttttctaatgaaatgccccgtgtttgcaagtgagatgatttctcatcttgttttctgactgtgatactttggtggtccaaagatgtcttttaatttttcactatctctgaacttttgagccaagctataggtgtttctgctcatatgatctctttcaactttgtgtatttcttatgtatcttattagggctcactccattacacaaaagtcacagttacaaaattcatcaagatatgtctttctctacctcagacatctattgaggcttctgaaagacattgtcttcataatccttttaagccctactttttaatgtatgggatctgtgaagtatctttcaaaaattctagaggacttagaactgcctgaatagttctctgaagtatcatctcaggtatttctgaggtcttagcaaaggattttattttgagaccatattttcttgagtatgatctacatttgtttttcattgtttctttattgtagtatcatttgctgtctagaaaggctgtgaagaaacaaagttttatttttgaatccaacaaattctggcacctttatattttaatactcctttagcttatctgtctcctctttctttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaacgtgttagccaggatggtctcgatctcctgacctcgtgatccgcccgcctcggcctcccaaagtgctgggattacaggcgtgagccaccgcgcccggcctcctctttcatttcagtatacgtaataagaagtcagaaattacctttaaccaagcctggaaatctccttatctagatcattatattctttaggtacattttttactttctacattaccacacacaacaatattgctaaattttttcctctaaataagaaggattccctttttctaataacactttctttatttttctttaacctttcactgaaagccccctcaaaagctacctggcttatgctaacagtatgtttgatgtcctttcaatactactctgtttccatctgtctagcatccacctgcctcccaatctcaaagtctccatcatattttgtcagtttttagtttttttgttatggtgccctaaaaatccatcccagccatctattgctgcataacaaatcccccttaatttaatggctgaaaacagtactgatcatctattatgtcccatggtttgcaggtattgagaattcagtagtgttttgttcaagcagttttaggacagggtctctcatgaggctgcagttgggggttgactggctcatttccaaaacagtatactcatgtggttacaaactggctcctctccatctggatctctctgtgaagcaaccaaaatgttcttacgtcatagaagctttgttcctccagagtgaaaaatctaagagacaacgacagagactgccacgccttttatgacctagctttcaaagtcacacaccaagatgtctcttgtattctactggtcatatgaacctatcctaatcaatgtgacagtggactctaccagacatatctaccaggacacacagatcactggaggatgtattgcagattagctaccacacctgtgatctccttaacgtggcctttgcacctccttttttgcaggtcagttactttttccacaacctgtagagatacgtgaacactttcatcttctcccggctgaggcttctttatatctctagtcaaccctagggacaggcccttacacgatgccatgtgatacatctctggtctgtgagaaacacaagcactgccagtttccagccaaatttaagaatttagctcatactaatacagccacacctcctctggcttgttaccagctagacaccccaacaagccaggtcaggctcctgtgtctcccacactacagggactcatgtcaagccctccatgtctataaggtccctttgaagtccctttcatcagccttgaaatgagggcaggcatcatattaacccttccctagagggcaaagtgtgttggaggtggatgttttcactgcatacaaaaatcccaaatcactttttcccaaatcgtgcaagaatctcaattcttgatcctattataacctccaagaaggcaggagaattgaggtcttgaatgcattctcctccaaatacttcttgcaagctctgcagcttggtctatctcactacttactttgatatcgaatttgtccccttagggtttgggtcaaaattttaattttaacatccgatcacagggagctgtgtcctgagctgtgattatgaataccaggagcacatttcatctctgctgccatctgagagataagaacacttcgaggaatgtaaaaccacagagtcaaggttatagtggtattttttgtcattcattaatactatatttaaatgggactaaagatgggtacatacaacccaaagtggggtgactaccaccctttggttccttaatttgtcctgataaaagcagagtttatatccacaaaaaggtggaggaaggggaatattaaacaatgggttttctttaaaacattaaattagaacacatgaaatggtcagacgacatgttaaaacactacaaaatagtttgaatattgacttacaatggaaacaaatacaaataaatttgaacacaataaaaaagtgatgatgactctgctttaaaatgggtccaagtagttttccggggagaataacatataagtgtttatcagtttgcctagactctaactcgtttcttatttgtggtctttatgacataattttctattatgcagcttgattccttcctcagttctagcaagtgctaatgaaacttccttccatcccagtcaaacttttatgggagtggtggtgaggaggagatccaatgacaaggaatgaatggtgcctggccagaaaggttttgtaaagttcagtttgctgctgagatctagaaacttcagcagctttctgggattaagaaggatggatttcccctccctgtgtctatgtgttctcattgttcagctcccacatatgagtgagaacatgcggtgtttcgttttctgttcctgtgttagtttgctgagaatgatggtttccagtttcatcgatgtccctgcaaagaccatgaactcaatcttttttgaggctgcatagtattctatggtaagtgttaggacaaatacctaaggcctgaggggcttaaaacctagatgatgggttgatgcgtacagaaaaccaccatggcacatttatacctatgtaacaaacctgcaagttctgcacatgtaccccagaacttgaagtaaaataaaataaaataaggatggatttcagcaataagtaaagagggtccccaatttacaatgatttgacttagaattttttgacatgagcctgatgcaaaagcaatatgttttcaatagagtattcaataaattacacgggatattcgacacttacaaaataggctttgtgttagatctctttgcccaactgtaggttaatgtaagtgttataagcacatttaagacaggctaggctaagctaggatgctcaataggttaggtgtattaagtgcatttttgacttaagattttttttcaacttacaatggattcattggaacataaccccattgtaagtcaaggagcatctgcactgttgtggggtctcaaacggtcagatcaggaatgggtgaaggcaattaggccaggctgactccaggcaagtaaaaagaacaaattctgacttttcagcagcatggacacaggaaacaggccccaaggatacctatttttattcagacttagactaaagaaccgtttttcttgacatttcagaaatactggaacactaaatgcaatttttctaaccaaatacctgtgaaaactttcattaaaatgttatcatcaaaccagaaaacatttattgcatatctgatgccatttaaaagcttgaggcaaaaacttaaaattatttcaatatctttcattactgttaacattatatatttattatttatcctgattcctagcatatctctgagttacaccaagtaaacaacataacccattaattggtttaagaatattgtcagagtggattattcgtaattatatttgctgtatgaattggaagggacattactaggacatgaactatatgctcttttctgcatctctagaactaaattaaatcaaagttttaataagttaggcacataacggaagttctgttcatctttcaggctgatgaaagactctcaatattgttacaaacaaaagaacatgtaacaaaaaaacatgtaataaggtgtctgaatttaaaatagttttaagataaaaatacatggttttgaaaggtttgtaaataagtgaaataattcaataaatatgtatatagtatctgtagaagaatcttttcaggtttttttcattgcatttttataccatgtaatttatagtgcacaagaatgttccttcacccaatacagatattttagggaaaactctaacatacttaatctcttcttggatcacaaatttgattgccatatgtagtcttttcaaacactatatttgaatcctacagagaattaatacatcactaacttaaaattctatcgcatttagataactgtggggcctttcaaaggactttcttctctgatgagaaataggacaggtagacttttacaattactaagatttttttctggaattaggacatcttacaccttgaaaagaactttaagttttagggtacatgtgcacaatgtgcaggtttgttacatatgcatggcacatgtatacatatgtaacaaacctgcacattgtgcacatgtaccctaaaacttaaagtataataataaaataaaatttaaaaaaaaggataatgtccaaaaaaagatcagtgctaattaaaatagtaacatcattaacacttaaaagagtactacttcaaaggtactactacacttaacatatttttattctttgataaaaacatgttaagtgtagtagtaccttgctttttgttttcctgtttttgttttttctttcagaatgctgccatcttctggtcaaattatatcacttcacaaacacaagactcgaaataggaggccaatagatttacacaaatttcccttttatcattaggcgccacctattcaagatttgtgcctccaatgttccaaaacaagagacctttaaagtactgttaaaaaaaatttcagaggttaaatccacagaagacgtttcatgacttgtaatgttatgaaaatatagacgtttcagggcttgtaacgttatgaaaatgtgtatcgcacagtaaatgcacaggaaagtatagataagggaatatttgactttgctctaggtctataaaaattgatgtcttaggataaggaagcagttttgacatatatttgctgttttcatttctacaaactttaattttcaaggttactcaccttgaaagagtatgtttatagtagtttataaaagccgttattgaataactgtcctccttacaacaaagcagacacttgtggctggcaaatttcttcttgtcacagaattgttcatatttgtgaccatctttagattatttatcaaaggatatgtaatttaaagggctagtttttatatacatatgcatgattacttccaaattccacacttctacactcattccttttcattcactcattcattgaacaaacattggaaatcttatgtgtcagtctttatgctaaccactaaattcaaacagaaataagatgctgcccttggacttgagaattcacaactgagtggatacctttagccaagccctagaaatcgtcactgaaacacactgttctcaacttactccaccaaagagattttaatctacccaaaccaagaactagtaaatcacagtgcaaaagtgtgaagcatccaaaagattcattagctactgctttttgtcactggtttctaccagattttttttccttctcctctttatatttacaatctgctgacacatataatctataccatatagccatgaaatcagccacagtaaccaattttgaacaggtgaagaatcctgacccagtgaaacccatagactggagtcactcatcaagagctaggattaaatgttggctcaaaagagccgtctgatcttgcttcagtcacctctaactcctctgtgggtgaaagcaggaatttacttttccaaaactttgaaatgttacctgaagcagaattctacagaaagacacaaactatactgataattctaaatttcaactccccctttgctacttataaatccaaaaaatcaaatcactcttcctgagctacccacctgccttatttcttaacatttctaactctctattcaacaaaatcacacgttctactctaaccatattgcctttcccatatttaaaattgcctgattgaaagggtaggttgcaggcagggagaagaggagggggttctacacctcatagatgggtgggattccgggagtcaaccatgtttcttatagcaccaagtcacgcagaagatttggtcaccagagtgcttacttagaggaatagaggaaggagaatgtttgtcattagcaaatgcttcccgtttggacttatttcacttgcagcaccccgctgtttttcccattattcaaagaaagcaagtaaataactgcatgcattgctgtatggtgtttactggacaatgtgaaaatgttttccattttctctggaagagaaaatgggagccaatacacagacatgaagcataagaaatcatgtgatcagtttctcatggccaaaccattttcttcagctagcggatgccacgaagacgatgtgggaaaaggttttcctctttttggtgctttttcttggaaaagtaattggagcaacatgatttaaactcttttcggttcgtgcatgtgaaaatattaggagaaaatttgaaaatctacaagtcactctcacaggtatcctagatctccttattccttgatattttgtagccgatgttgactatatagagagatatacattttttcctcctgtattcttttaacaaaagcgtaatactctgccaaatattactccataaagtggcatctgtagtttatgttcttctttgaattcaaatgatggccaagctttgacaaatataaatgattcctttctcatctcacagcaaaaaaataaaaataaaataaaataacagtcatcattgaaaatattcaatttagatagaagatacgtatctcaaaataataagagctatttatgacagacccacagccaatatcatactgaatgggcaaaaactggaagcattccctttgaaaaatggcacaagacagggatgacctctctcaccactcctattcaacatagtgttggaagttctagccagggcattcaggcaggagaaagaaataaaggatattcaattaggaaaagaggaagtcaaattgtccctgtttgcagatgacatgattgtatatctagaaaactccaacgtctcaacccaaaatctccttaagctcataagcaacttcagaaaattctcaggatacaaaatcaatgtgcaaaaatcacaagcattcttggccgggcgcggtggctcaagcctgtaatcccagcactttgggaggccgaggtgggtggatcacgaggtcaggagatcgagaccatcctggctaacacagtgaaaccccgtctctactaaaaatacaaaaatttagccgggcatagtggcgggcgcctgtagtccctgctactcaggaggctaaggcaggagaatggcgtgaagccgggaggcggagcttgcagtgagccaagattgtgccactgcactccagcctgggcgacagagccagactccgtctcaaaaaaaaaaaaaaaaaatcacaagcattcttatacaccaataacagacaaacagagagccaaatcatgagtgaactcccattcacaattgcttcaaagagaataaaatacctgggaatcctacttacaagggatgtgaaggacctcttcaaggagaactgcaaaccactgctcaacaaaatagaagagaacacaaacaaatgaatgaacattccatgctcatggataggaagaatcaatatcgtgaaaatggccatactgcccaagacggagtctctctctgtcacccagactggagtgcaatggcactaccttgattcactgcaagcttcactttctgggctcaagtgattctcctgcctcagcctcctaggaccaaggattacaggcgcatactaccactcctgactaatttttgtatttttagcagagatggggtttcaccatgttggccacgcgggtctcaaactcctgacctcatgatccacccgcctcggcctcccacagtgctgggattacaggcatgagccactgtacccggcctggggtgacattcttacaaaagataattttggcccccttccctcactcatatacactctcttgccatgtaatgccttccaccatattataaaatagcaaaaaggccctcaccaggtgcaatgcttgatcttgaactgcttagccttcagaaatgtgacctaagtaaaattctattgtttatcaatacattaaaaaaaaagaatttgagatggatttggcatgacctttgacctcctttgtcagaagataagtcgaagcttggatttggagagctccactgtagcagatctgaatccatagcaaactacacagccactgaccttgcatttttattctgagacctatttcaagaggctcagtttaatcaaaaattatacattaaatacagatacagttcattcacttatagcatttccacacatttcctaagcagaaaatatcacattatgagtccctataatttgtccttcattcacactttttctgctttattaaaggcttttggaaaacaatcaaacttagatgacatctttgcaaatctggaaattatgccaaattttccataaaatgaaataataccggattttaacattatgaatattttataaagtagaacatgctttatatatgaatgcaaagcttataagtttttctcttttttatttgtactaagccagctttaaaatatttacattttaattaaataattgaactagcctcttttaaagacgttcatgaagattcagtgaggttatggaagtaaatctcttagcagaatattcaaggcacagggagccctctcccagtgaccatcatttttatatctcaatttatatagtagatgtactttctgaaagtaatacatacaattatttttggagaattgaataaaattttaaataatgttatttgcatgttgtgtaaatcctatggcaaactgtttattgggctgaatcaaattctgatattttctgtactagggtgtattaaacagacacatatataattgagaaagggaacagatcaggacaactgggtttaactaacaagatgaggagatcatcagcccagaaaggacaactttgtcctgtacatccgagaataagataaacaatgatttataatcaagtatccagaaagcctgaaatattcaacctcagggaaaaccaaaagatgaagaaggcttttatcatcagggaaaagcccacagcacacttttgtattcaaaatgacactaatgaatgtggtcattatctgggaagacaaggattaagaaaaagattcataattcagtcacccgtttgcacccatcttaaaaattctcatttggggccaggctcacccttgtaatccctgcactttgggacatctaggccggaggaatgcttgagcttaggagtttgcagctgtagtgagctgtgatcgcaccacggcactctagtctgagcaacagaatgagaccctgtctcaaaaataaaaaataaaaataaattgtaatttgggtttaggctcagccatgtctgctgcttcctgtagctacttcctagctgctgttctctgagccaacccctggtggatgctgggcatggtgtttgatggcattcaaatctgttgccttattaggaatattccaaagaacatttattataaattataaagatatatatttctggaaaatttgtttccctgcattctaaataacttaccatataggcccttttctatataaataaaactcttgtgctaaagaaaatattaagatgagttaatataactatttctttttaaatgggatgccttgaactttccactatcaatgacgtgttcctttttactcacaaagatgaggaaatagtttagcgcttagttagaatatgacagacagttcatgaactgtatctgataactgtagtaactcagatgtcagcaagtcagccccagtgtttcatcagtgatgaatgcaaacacttaaaggaaggatttctgcactgtgttggcgtctctgaagaactgatgttcttccatgtcaacacagaagaatttgtttggacattttcttggagtgctagtgaactgaccaccaatcctcaaacggttcttctgtttgtgtacaaaatggttgtaaacaggctactcatggaaatgaccctttttattgattgcaattctctctataagtgtttgatccttataagcaattagtaaggaaagcatgattttgaacctttggctcgtgattttctgagacttttagaataacctctatataaaactaaattatatctatttggccccattttttccagacatttagttttctatttcccactatcaaagccacacacacacacacacacttttttttgaagaaataacaagtgaaatgtaaatggtaacgagttgtgactatttcctaataagcaaaatctcaatttgcaagtcacatgcacgatgccccgatctattttaatgtgtttggtgaatgcattttcaagaggatctggctcttgagaaggtaccattatagagccacagtttttattttctccttttatgatatacttcctcagtagtgaacatcctttcaaatgcccaatattaccttctggtctgtacattacatttactcattcaataattattgagtgagtgcctactgtgtgccatgcattgtgctggatagtggagctacaataggcttcctcaaggagctcacagttaaacaggaaacacactaatgcacagccaactctaactcaggaaagcctggagtgggacagcaccattctttctgagggaattagctgaaggtgttacacaatgggtgctcaaaaaatatttattggatatttaaggacagatggatctttcctgatgtagaatgccaaggaaataactctccaagcaaaaaaaaaaaaagtcattgtgagccaaggcgtgaaggtgcaaaagtccaccgcatgtttgaggactagcagttggctccaattgtcaaaggtacatggacttacatgttcagagctgaggagcagaggctggttagaatcagattcaaaagcatctcctacactgtgacaaagaggaacttgaagagagtgagagagacagagacagagagatagaaacagaaagagaaaaacatatgtgcattttggaaaacctcttttgaatggggacagaatacattaaaatgactttagggagggagacaattttgaaggctgttctggaaatccagggacaaaatgatgacgccgaaactgaggtaatagcaaagaggaagaggaggcatacatggattcaagatacacattaaggaaataataaagtaacttattggataaacagagtaaagacaaggaaaaaaacaagaccacagaaagattgagcaactaggaaaatgatggtgcttacctttgtcatccatttttccttgatctgaaaacaacccaaatttccatttgaggatttcccccaataatacttagttcgtatggtgtggcagggctaccctcaagaatagagtacgtcacccacatcagagccattaaacactgcagttcccttggccaggatcatgtgtaagtgtgactgtgtggctgtgttgtggtggggagtagggaaggcagggatccactcgtcctaagctagtccaatgagggtttgaacaccagaaactgcgtgagaggctgtctcccttgcattggatttagagcaacaagaatatgaggcttgggatgctgtacacatcttgccaccccagaaagaaaacctaagaacgtagccaaaagaaaagcagagcttagtgacagaacaaaaaggagcatgttttggtgacattagctgagccctgatttcagccacacctgaagccagccctacaactggacttttcagttatgcacgttaatatgcttaggccctttatgggaggaacagccctcactcacaggaacatcaaggataatgcctgggaagcagtttaaatatctctgtgtggagctccaagaagaagtctgccctggagtgtaacccacagacaggtggttttagacatgagatgagcacacaagtggcaagaataaaacactgagagaaaacaacggggagcaccaacattcagtcagtcagtcactcaacaaatgctcatcaaacacctactgtatgtcaagtagtggatccgtgaacagaatggacattaattatgaaaaataataatttttaaatccctgttttgttagagcttatagtatattgaagaaaaaacaaacaaaatataagtaaaatattcattgcctttactaatgatatgctctaggaagaatgggtgagctgtggcctttagacaaagtgatcaaggtaggctttactaagaaggtgacattaggtttttgagtaaagtttggaaggaagtgagaaaacaaacaatgtacatacctggagaagggcaaactagatgttctgggaaaagccacaggaggtcattcttctggggccaagtgagcgaggaggagtgaccagtcccaaagacctcagaggccttgtagggactttgacttttttttcctttttccattttttttttttttaagttttaaatctgactttgacttctattctgagtgagatgagaagccaggggagggctctgaggagacgatcggagagccgacttggggttcaagtggaccactttggctgtgtgttgagaacagcttatgggcacaagaagggggatccaggagaccaggcaggaggcaagtgtaaccctccaggccagagaggatggtgtctggaccaaggaagtagctagcagcagtgctggtaaaattgttcttattctagatgtatttttaagggagaaaaaaacaggggttctgatgaattgaacattgtccataagagaaagaaagaagccagggatgacttcagggcttctgcccgagctactagaagaatgagagaactcatcaaaggaaactgaattggagtgcccaaaaaattaggagagagtactgttgcagaaaacaatcattcagacgaggagatgagaaccgaaaattgcccatgtgatttaacaacaaaagaaaaagcagcctctcatgactttggtgagaacatttgtaatcttttttttttttttttttcgacccagccaaaaatactggacgtgcgagactatgaaaggaggtatcaataggttaaatagaaagaatgaatctattagaagttcaaccaaattcaacaactccactctatggcatgacaggagagagacagaaggttaagacacagcacatgttctctaggcctgtaggcacttacagactattgaggatgcaggatggacatatgaatggaaataaggtgaaccgtgtaatcatagcactgccctgaatgttcttattctctaaacatcatcaaaggctgaggcaatcagatcatttgaggtcaggagtttgagaccagcctgaccaacatggtgaaaccctgtctctactaaatataaaaattagccaggcatggtggtgagcacctgtaatctcagctacttgggaggctgaggcaggggaattgcttgaaaccaggaggcagaggtggcagtgagccaagatcacaccgctgccctccagcctgggcaacagagtgagactccctcttaaaataaataaataaccatcatcagagatggactgagcaggaagaacatcactaacatccatatcacttatccttacttggaagaaacttgtttattctagaaactggaaaccataaacatccttcccttccgtgagggctctttcacctaacaactcagagtatctgtgtttccaccaggctgccaaggttaacctattaggaatgatgcatgtcaacttggtacaaataactgtggctcaaatggaaaattctctctgacagaacactggcattctgtaagaacttttttttctatgcagaaaaaaaaaaaaaaatttaactgccttggcttgcgttttcccttgggtaatatctcactgtagcaacctcaagtccttcatgatttccttggggcaaatgagaacttgaccttcttgttgtgctgctgcctgaggtgcaaggcaatgctttaatcaacaacagacatctttactatgaagaggatgccaagtttccagaaagaaggatggaaagcgggggaagggaagaaaggaacgtatgaatttgagtttggtaatggaaaatatactgtcctaggagatagaagacatggtgtctgagggccctttatcaagtttgagacattaatctctcaatttaaagtgggggtcaaatctaatctgtttaaaaattcccaattatgtctttcaacagaagagctctaactttcttttccactttacatattactggattaaattcagctgtttggaacacaagggcctcttgaagccagggtcaaagatgtagtcactgctttaaacacagaacttcaccattccagaaaccattcccagctccagaggtatagacactcttccaaaccccacacaattattggtcataattgggatttgaagagagtctatgtttatttctgtgaaattcctgtctaagccgaaaaacttctcaaggctcttgtcctaatcttactatctcatcctcatttgcaaatgtaacttgaagaatctcttgaaacctctcctgtctcacttccttgccctggtgctggcagactggccaaacctgcagaattcatcctgaaattgaccaatttcagatgaaacaaaacacaaaagagaagaataaactgcagagtacttcacttctactacagagtatttcactaaacatcacaaagtgcctgatatgatgacttcaaaggatacaggaaagattcagtgtgctagactatgtaaagaaaacacacccttcacaaaaacaaataagcacgtctttgtcttattttgttttgttgttgttgttgtaatcaagaaacaaggttgtacaaaaaaacaattcatgggaagatctttggtaggtggaggctgctttttgcttttcttctattgggccccctaatgacgattgagatatgcaagctaacatgtaggcagcacctaagaacaggaggctgtctgtactacaggatctttaaggacagtgtagaatcactgccagcagttctctgtgttaggtttcctcacagttcatgatctggatggattgagtgagatgcatttcacgtcctgagttataaaccctgcaggtccccttctccttgtaaaactgatcagatctagccttgcaagacccaaggtatgacagcagccagaacgagtgaccaggactaaagtagaaacccaaaattagaaaagagtaaaggattttaaggagagagacacaaatacactgagtgtcatctggcctctattctcatttttagcattataaaatacagaatacagcctccagggagacatggagaggaaagggaaaggaggcaaagttcgtggttgggagagtgagtagacaggaatgagggttgaaaagtgtgccccatgcacgcaagacaggaaggaaggaagtgatgcaacacatcgaggaatgcaagagcccagcaattccacagagatgagtgtgtgtgggagagcccggccagaagggagaatgactgatgggaaagcttctggaacaaagtacagctgggtggccttcgacccagaggggaaagggagaccttggtctggaaagatctttcctgtgtctgaggatgagcatagagccttcactgagtcctgagagggcatccgaaaggagagaaatggagagaagacctagtcaggggaagtttctggcccaaaatttatatctgctctaaccaagcagatttctaaattttttgttgtttgaacttcttgtctgaacttgggaacaagaacactgaagtataagtcaagacctctgggttctttccccagcttttctgttaatttgctgtggggctttaacttgttgggtttatttatcctcaaaggctagaatatcactcatagtgttaaccatagaacctccccattcacacacctaccatgtgcccacaaagaaccttccatagactgcaagtttcatggggccatggacagtgtccatcttaatcactacgatatcatcatacttaggacagcgccaggcatgtagtggatgctcaacagacattttctcaatgaattaaagtagattacaatccagaaagcagatgaaagcagagttgtcctggcaggaacaataggaagccctactattttcactgccccttcagccctgggctcccaataggaattccaggactaggaggaacccagtgttaaacagctagctggacgagccgtagaggcttctcttcgagtctataattctgtggtctttatgcagcacttgttgagctgaaagcatagaaattaatcttgtttggtccaaattcacctgactgaaggatcacttttcccacttcaccttctaaagtcctagtctttaaaccttctggctggtacattttcccctctctttgcggaagatgaaagcatttttccagacaggcctgctgtgagtgacttcagggaaatgaatatcttgggtcacttaggtgcctctcatatggggaactccttgtatatatttatttttaagaatagggctgagaggttgacatttccattagcagttgagtgattttttttaatttttttaaataacaaccctattcctcggtgagacatgcctcacattccgctctccccactgcaggcagttatgtgctgctaaatatgcagtggaaatgacacatgtctggaaacccagaaggagcaccgtctcaccacggctcgctcagtggtgcacaatgaaagtgctgtaagtgcttcattaagcaaggtggactccaacattctcaaaagagaaattggtaacatctcatgcatctggcatttgtccctccaacgcattcacaggtgtcttctgtttgaactctggtcacatctagagtaggataaaggcacagggtcacctgactttccagaagatcctggaactatcatagtatctgcaagtgaattgaggccagtagttcctccttcaagggaggggagctgtgcagtcacttaccaccaaaggcgtggatcagctccacgtgcaccttagataatagtaagccctgtggacatctgactcactgcattcaatagcctagcatgcttttgttctaaaggatagatataatcagtctaactcaaagtatttttctcctaatttaagtccacaaaggaatccctacagggtattctctcgacctgtgcaaagtccagtaacaggatagaggttgtgacatggaaatttaaaatggaatttgatttctaaggactatactacgggaatacagattggattaaatgtaaatgaagtattagaacagcaagacacgtgtcctagttgaagaaagtgttgcaagtctgtgggcaaagatttaccatgcaatctcaaacataccaagaatttaatccttggcaaaagatgagggtccttttaaggacagaaaacaaacattgcaattatattttaataaactcaaatgagtttcttagttggcaatttatttttattgttttgatggtttgtgggtaaatgagttagaaatatgagacgactttccttaaaatatacatgtttttactaagttaggggaaaagtttggttttgattggtctttgaaaggctgacaaagatgtctatagcatgtgataattttaaaaatcacctattcctagtccaaaaaagggaatccatgtaagcttatgtgcttgcatggttcatgtaccagtatgtagggtcagtaaacaaaaggggagatagaagtatcattatgcaggcctgctgtggtggttcacacctgtaatcccagcactttggaaggccaaggcgggaggatcacctgaggttgggagttcgagaccagcctgagcaacatggagaaatctgtctctgctaaaaatacaaaattagcctggcgtggtggcacatgcctgtaatctcagctactcaggaggctgaggcaggagactggcttgaacctgggagatggagattgtagtgagctaagatcatgccactgcactccaacctgtgcaacagagcaagattccatctaaaaaaaaaaaaaaaaagtttcattacccagagaactggaaacttaaaaatagctttaactacgaagagggagcaaactaggtaagcagatctgaagaggaaggtgatgggctgacattctatgtagagttcagtgtgttactgaagaatctggacaagaaatcttcttcttagttgttctctggctttccttgaactcctttctctctttcattctcctgcctcttttctctaaagctgaagtcacatgcatgcgtgtgcacgtgcgcacacacacacatacacacacacccctacctctccctgctatcactcaagttataacaaacaaagaaaccactgtaggaatttcacatttcaaagagcttcttagagcgtagaaagagttaagggagtgtgtacctttatacctggttttctttagccaagtaaagcaaatggcacacaagcatacagcttttgttcttgatggctccagttatcattttggtaccaaatctaagatccaaatgaaatccagttttgcaatcaccaaatactgagaaatgtttcagcatgcttggcgaccttagattttgctggacctacaatggaaaataaagttgtaggatatttttgcatgctggtgatttttttccttttggttttttttgtttgttttcaattttatgggggagaacatgtaaaaataccttaaccaatgactttaggttctatattattgtaaaacaatttacaataatttgctcttcacctctctcatgccttctgtgtaatagacagaacaataacttttggaaaaagagctaggttcagtttccacttctgtcaccagctttatgacctgagaccaatttgttatctgagcttcaatgttgttaatcaattaaacaggcataatgctaggttctgatggacaccataaagtttaaaaaaaaaaaaaaaacactgcaaatgcttagcattcacgtattcaatgacatatactaagtctccacaatatgcatgctctgagaacacagtgcagaaacagacagaaagcaatgactctgccctcagggagcaaatatacaagtggcagaaagataacaaactacaaagaaatccaaattaaaatacagaaatactttcaggttagttccatgggctctcatgtgtagacattaacagaattagtaatttacaaatatttgtgtgatgtttgtctcattaatgtttacatcccccacaaagtgtaggctctgtgatggcaaagaccaatattgtatgcccatatctagcacacagtagaagggtaatgcacaattactgaataaatgaatgcacgcattgtgataagggaatagaaagatgtaatcgagaaaacagagatgtggggagtaacattggtaggatggtctggaaaggcctctctaggatgctggaacacttaagtgatgagaagaagccagccatgtggttggaaaaaaacaaaacaaaacagaagagaattctaaacaggaaatatccggggcaaaggccctgagacaggaaagacagtagaatgcttagagaacgggaaggggccagtgtggctgatgcagacaccagagacagagattatggtaaatttgagttttattgtaaatataatacaagttccccttccctcttccacaccccccttgtttatagttttgttttagtaacaagattaacatccattgaaaaattaggcaacaatactagataatagaccattaattatgaattgcaagaaacagatgtccacgttcaggagtggaagggatgtgagctaatgaaggcaggaaaggttaaccgacataagagtttcactctaattccaggcactgcctcaaaatcattccactattgggcacttggatccccaccatacagagtgcccgggaatctaactgcaaccagacaaatgtcctaatttcacgctttgctgcctcctcattggcagatgtcaaagaaatttttccaagccagactctatgatgtccccaaaacactgggctctttctccagttttactggtgaacttccagtaagtcatctaagctgtattgctcagcttccacatcctatgaagtgtcatcgaggtcatcttccctgcagatgttgtcttcagcttcccagactcactctgtagaccagtatgtgccaactcctctctgccttgcaaaatggttccaattaagccactgctcccactttcctccttcagagcctgaggctggaaagttctgctgttttctcaagtttagtggttgacatctattgtgtctggctgctctttgactccacttttgaatttatttctttggttttgggaaattctgtccttcctcttcttcctgccttgactatatgggaaatctgtctcagcttggcctagcattcagatcactatttagcccagtgcccagcacctaatgtcatgacttacttatagaagattattgatatatgtactaaataagaagttaggcagcaacgcctactgtcagcccttttcagttcttccttgagcaagaagcttgattctactttttcttaccctaacagaagggacattagattttggtagggaaaacttgtctaaaagttcataaatatcttgtccagacctatctttgaaatataggaaataataatatgtaaaggggactttttaaacacattctacttatttaaaatgatacctaaaatgtccattaagtaacattgaaaatacctacactggagcagggcgtggtggctcacccctgtaatcccagctacttgaaaggctgaagcgggaggatagcttgagaacagcaatgcaagaccagcctgagtaacatagaggaacttgtctcaaaagataaaaaagaaattaaaaaaaaaattagcagagcatgttagcatgcccctgtagtcccagctgctcaggaggttgagtcaggaggattgcttgagcccaggagttcgaggctacagtgagctattaagatgtttgcaccatttcactccagcctgcacgacagggtaaaatcctgtttctttctctctctcgttttgttttgtattgtttttctgagacaaggtctcactccgtcgcccaggctggagtgcagtggtataattaaggctcactgcagcctcaacctccctggctcaggtgatcctcctacctcaacctcctgagcagctggtactacaggcacatgccaacacacccagctactttttgtatgtttttgtagagacagggtttcgccatgttgcccaagctggacttgaactcctgagctcaaacattctgcccgcctcaacctccccaagtattgagatcgcaggcatgagccgctgcagccagccaatattgtctctttaagaaaaggaaaatacttgttttctaatattaaggtgaaaaagaaaaaaaaaaaataatgtgtataaaacatgagcccagccatgcaaaacaattagcattgaaagaaggaaacaaaccaaactgttgacaatgtttgtatgtgggtagtaagattatgaattttattttttatttttttcattgttttctacatttcatattttctaagacatggattacttgtatgatcagaaaattacattatttataaaagaaaaaaaaatcacactatgcaaccaaaaaacacagagtaagtctttccttgctgattctcagtggttctcaacctccagcatattaggattaactggagaatttataacaatcccaatgcccaagcccagcgctgtatcaattaaatcagaaacagaaacccaggcatcagtattttaagtttcccaggtgatgtcaatgtgcagccatggttaagaactactagtagaggaaatgggtagcttagatcaatggtttgcaaccctggctacagtgataatctcgtggggggcttttataataccaatatatgctccctaatacatttctgatttcagttggtttgcagtgaggccctggcagtggtagatattaaatttctccatgtgattctaatgtgcaggctggtctattgagtgttcgttctgtgtagagctctgtactgagtgttttatgtacattaccttatttaattctcaaaatagtacaaccaggcaggtattatcttcattttacagaagaggaaactagaactcagacacatgaaattaatgtctcaaggaaactcagcttgcttgaacccagcttgtctgtctcctgtggggataggcaaagaaagaattctacccagttgtgtggaaagctttataaatactataatgcggaatccaacatactcacttttaaaatgtcgatggagtagctctttataaatcttattaacaagtgtctcatttctgtcaaaccctgtcaagtgtaaatgcatctgcaatatcctgaacatttatgattttcattccataatggcctgaatagcatgagaacttaaataacttccaacctgttcaaagttacaatcacatctcatcgcttaactttatgacaccacccaacttctctggtgaaatcatagtatggttcctattcattttattttatatcattttatgtcattattatatataacaagcaattaagtatactttgaaaattccttaaatgattttgcaagatttcttcagtaactggaagcattcttggatgtcatgaaactacccttatgattgctgttgtagacaaatgtcacatcactggatttgtggagtttcctttccaatgcatcgtttagattgagctgtactttgctaaaccagcttaaagtaaaccccacctcttccaatagtcaagattcccactaacctcaagcagagccgcaggtgcatattattagcagaactggactcttttcacttataatttgagtcccaagtcttttgaagtaagacccatttgcccagatttgtatagcattacctgagcgtaacattacccaacaaagccaaattgatgggttaaggatacaaataaggaattccgaatcagcttatgaggcaggttttgtgagagaggagagagaacactgcttagaaaaaaaagtttgtaggatgggtgcggtggctcacgcctgtaatcccagcaatttgggaggccgaggcactggatcacgaggtcaggagatcgagaccatcctggctaacacggtgaaaccccatctctactaaaaatacgaaaaaattagccgggcgtggtggcgggcacctgtagtctcagctacctgggaggctgaggcaggagaatggcgtgaacccgggacgcggagcttgcagtgagcctagatcgcgccactgcactccagcgtgggcgacagagcaagactccacctcaaagaaaaaaagtttgtaactgtcttgcttttgcagaataaaataggcattacttttcaaatagtgttgcctagggataccttccagcattcacaaacatgctatgtaacatagtctgatttttaataactttgtcactgagtatatacctaaagagaaagtaaagaaaatggccatctctagtgcttgggttcaagtaacaggacaattttttctacacatctcttcttttccatttcctttatctttgttagcatttttttttggctccttccttagcagaaatgttatatttttgagggtactagaaaactttcgtgatggggttatttaagaaagacaaactttaatagataaaatgggaaaatattttaatgtatattttttaaaagaaaaaaaaacttttcttacatttccttcccctactgtagactagaaaaatactaggtggcaaattaataatcgcctatgcagttaagcagcacaaaactgaaaatacttagccagagtaatcaagcactttttttggactaaatgcaagtcaaaggccatcctccactcttctacccagagagcatatacccttggcagtctcactaacctgggggtgacaaaacgagtattttgaaatcaacatccaatttagtgctttcgtggttcttcaggttgcttattcataagtgaaaacattttgtatgtgtatttttatgcgtgtttgtaggatggaaaagaagcttgctctgatataattggttttagttaattaagtaagaatctctgacttacagctattttttttccagaaaaacttacggtgaataggaaaatatttgttataaagcaaaacagaatagcaggattagcctttcaactttttgtctgcaggttttcagaaaattttcatctcttttgaagataataccctaattttatacagttttatctatcaatttaaaatttaaattaagtgaataaagaccatacctaatgtatatacatatatacaggcatttttgaaaatctgtaccataggcagaatttatattttttgtgatcaagaggctctcttctaatttcttccaagaaattttacatgttcagaaaactgcaaaatttctaatatgttagtaattctggatattcacacagcattgaaaaaaataggtgtcttcatccatctggattttcataagagttcaacatatctattgcaaacatatctcaactactgtaattctcaaggaagaaaacctgaagatgaaaagaattgggatttgactcatgaaaagagaattcaccactcttcttgtaatttcttgaaactgtgttcagaatttcacaacccttgctaaaccataaacaaagggtcacatgcagtaaaacagcagaaacccagtaagaatgtgccagagttcagagaacaattaccccaggcttaacttcactgacctttaatctgtttgggtcatcagtgctcttctatataaagcatctcacaacgtgctggggctcaggcctggcagagctctgcaagctggagtcttagcagcagaagtcaaactggggtaaatttgtccaaagacatataaaacagttttctctgacatggtgcatctgaaacacataggtgtcaaacagtgaatttggatgtaatctctggagccagggcaggacttttctttcagtttgacagactctcactctgttgcccaggctggagtgcagtggtacaatcttggctcactgcagcctctacctcccaggttcaagcgattcctgggccttggcctcacgagtagctgagattacaggcacacatcaccatgccccactaatttttttgtatttttagtagaaatggggttttgttatatgggctaggctggtctcaaactcctggcctcaagtgatccgcctgcctcagcccccctaagtgttgggattacaggcgtgaatcacctggccagcagggcaggactttcctaaggcttctctgaactcgtacttgtaaatcctctaccctacaagactttctgcaaccctaacactaacatcttaagggtgaagtaaaaaaataataataaataaataaataataaaaaataaaaaaataataaaaaaaagagtgaagtgtggtccaggaatagaaacagcattgatcaggaagtacggagaccccaattcctgttattgatgtgtaatttattagccacatggctttcagaaatgaaatttggaaatcatttattaaagccctagaccatgggctagcaacagtggaggccaattgctgacttcaagaagctcgtaatttaatgtagaatgtaaattagcacagattattatgatacaatttaagaagtattatgcaatcatttggaaaaattctaaggagacagaaagaaaggaattaccaattctctttgtgggtgtggaagcagaaatgtctacataggcttcaggtgggacctgaaaagataattggcaaggaatttcgtatggtaaaaaatacatggaataggataaaggacaattttgttaaagtatcaattgaggcaaactgtaaacggctttgaatatctttctgaggaatgtggacaacttatgctatttaagactaaatttcctcatctttaaataaaggaattggactggatgacttctgagttcatgaccaggtctaaaagtctaaataaggttacattcaaagttcaagaggaaatatagaagttggccaaatgctatcaattcctgtaaagataatgccaagtcagtggttattattcgaattaaactcccctgcatcatcaaaaaagtacttaactaaaaataaaaaataagatttttttttttttttttttttttttgagatggagtcttgctctgtcactcaggctgcagtgcagtggcgcgatcccggctcactgcaacctccgcctcctgagttcatgccattctcctgcctctgcctcctgagtagctgggactacaggtgcccgccactatgcctggctaatttttttgaattttttttttagtagagacggggtttcaccatgttagccaagatggtctcgatctcctgacctcatgatctgcccaccttagcctcccaaagtgctgggattacaggtgtgagccaccatgctgagccaaaaataagatttttgaaaatgaatcagtacaactttgtgttagagatgccaaaaaatatactttccaggacttcaagttgaattacttcaaatgttgttctacagtgattgtgcaatggaatgaactgggtccttgcaaaattcatatattgaagccctaaccccagatgtaattgtttttgctgtaaggaagtaattcatattaaatgagctgagaaggtggggtcctgatctgataggattcttgtccttataagaagagccaccagagaggggccacctgcaagccaggaggagaaccctcacgagaagcagaaccctgccagaccttgatctgaaacttccagtttccagaactgtgagaaataaatttctgttgttttagtcacgtagtgcttgttattttgtcatggcagcctgagctggtgtgagattacaggcgcacatcaccatgcctggataatttgtttatatttttagtagaaatggggtttcgttatattggctaggctggtctcaaactcctggcctcaagtgagccacctgccttagcccccctaggtgttgggattacaggtgtgaatcccaactgagctgactaatacagataataagttttagtttaagtaacaaagtctattaaaaatttgatcgtaatatttagactatttgaataattaattctttatggtatatattgtgctctaaaaaatgatgtattttttaattgatagtgcagtaagatgattatgactataactctcccaataatgtttcattatttcattagaaatgagaacattcattgatttaaacttttttcttcctttttcttttttttttttttttgagccagtgtctcactctgtcatccaggctggagtgcagtggtattctcggcccgctgcagcctcaatatcagtatcccaggctcaagcaatcctcccatctcagcttccccaacagctgggattacaggcatgtaccaccatgcccagctaatttttttttttattttttgtagagatggggttttaccatgttgctcaggctggtcttgaactcctgtgctcaagcaatccacccacttcggcctcccaaagtgctgggattacagatgtgagccaccacacctgacccgatttaaaattttcatttttgcacatagctgaactttaccaatgagctaagtattagtggcattccgaaaagtgaaatgtgctaatgagcttgatgcgtgaatgcattttaaccaaacaagttcagttatttttttaacttctaaagacattctatttatttccatgcccatactaaaatattttataattattttgtcattcactctacataaatcctctcagcacctagtcgttgccacacacacactgttaggccctggaaataactaaggcgaggaggatagtctcattccctgctttcaccaagctcaaagtcaagcctgtaagacaataaaactagaagtcacagacaataaagtatattacaggccaagacagaagtacaaatttctgcaggagttttggctagttagaaggccatgaaaggcttcctagaaaaagtcattttagcaaagcctggaaaaaggttggcatatgtaagatcttagcaactatgtgaaatgaacaaatattgatcaataggaatgagccaagcaaagacatggggcagggtaaacactaggtttgaaggtctgaagggcaaaaccacagctgattacagaaaagaaaaaaaaaaagttcagtatgtctggatggcagagtccaaaggagtggaaatgtgaagaaagtcagtggacccacagaaggaacccatcagcctctttcactttcaaccatcactgaataaatcaagaactatgccattgactcatagtgtggcacgttacaaagtatttgagaaaaatctttttttttttttttccagacgaagtctcactcttgtcccccaggctggagtgcagtggcacaatctcagctcactgcaacctctgcctcccgggttcaagcaattctcctgcctcagcctcccaaatagctgggtttacaggcacctgccaacaggcctggctaacttttatattttaattagagacagggtttcaccatgttggccaggctggtcttgaattcctgacctcaggtgagccgcccgtctctgcctcccaaagtgctgggattacagacatgagccacccgcgcctggcctgttgttgttttaagaacacaaacagtgaagtcttttacagatattataggttacaaatttctttgattataacattcactgccacagaactaatcatattctatattctcttcaaaaccacactcattcccactctagtcatcattactcaatggggcaaccaaccagaacgcctggcctgttgttgttttaagaacacaaacagtgaagtcttttacagatattataggaattcaaacacattttctccttctgactcagaggaaatgccacatatgtagttgagggaaaaaaaaatctttagatgatctaaaacttttaatcaaaatgtccacctccatttcctctccctgggtgttcgtcttgcaagaaatgggcagggcaggcctcacctgggtttaacttctctaacctgcctcatttgcagacaagaggaaagccacgtatagccacctttcagccacctttcaggttaattatgttactaagaaaaactaaggaagcagagtaacatcatctgggactatatatatatggtattttaaaataaaaagggctaagattcataaaaaattgatttatggtagggctttgcttgttagtgttttactaagatggattttttttagtgtatttccacattgtaatttcagattttgtttatcctctccacagaatgaggttattacttgggtattttaaaatactcgtgttcctggtaggtgtgcattcagtattgtaaatgttttgatcactagtttaatttatattttccttaatcactgttctcacagttgcttaacgattcttcctctccaaaaaaacagtgtattatgcatattaacataataatgactgagttaatctattatttttataccttaaaagtaaattcaggagtctaagtagccccctctgtagtcccagttactaaggaagctgaggtgggaagatcacttgagctaggaatttgaggccagcctgggcaacatagggaggccctgtctctacaaaaaataaaaaatgagtcaggcatggtggtgcatgcctgtagtcccagctacttgcgaggccgaggtgggaggactgcttgagcccaggaggtcaaggctacagtaagctgtgatcaccccactgcagtccagctgagtgacagagcaagaccctgtctcaagagaaagaaagaccccatctcgtaaaaaaatacaaaataaaataatacatttaaatttaaaaaataaaagcaaatgcacttatgaagctgaatggatcaaaggctctccctttacttcctgttgcttttgctgactttctatgcatgtgcatgtgacggtgaggccgagagggccgtgcgtgtgttcggaacaagcgcatccacgtgcaccatgtggctgccaacaaggatcacaatgactgatgctttcattgaacagtgtcttgtaaacagttgtcttaactcagaagctacccccaaaagctacattttaaaaataaatgaatgtaaacaagacataaatgttattttaaatagagacatatggctgggcaccgtggctcatgcctgtaatcccagcactttgggaggccaaggcgggcagatcacctgaggtcagcagttcgagaccagcctggccaacatggtgaaacaccgtctctatgttactgcattaatggatatgttattatattcatgacaattaatttcatttaaaaaaatcaaattgttgtgatagaaaccattgaaattggtttcctttggaatttcttttgagaagtgtgtcagaacatagacatccagggaattattatttttcttaatcaggacttggcagactttttctataaaggatcagatagtgaatattttaagtctgtgggctctccagtctctgtcccacgtattcaattctgctgttgtagtgcagacgtcacataaacaatacataaacaaaccaatgtacatggatgtgttccagtggacactatgtgttcttgtggacactatgatttctattttctgtgatttttatgggtcacaatatattctgtcactttttttttccaaacatccaaaaaatgtagttcacaagatatatcaaaactggggaaatggcagatttggctgaaggcatatttgcaatccttttctaagtaattatataggaaaactaacattgcaatgacagtgtagcatatcaccagtgtgaagtccatgaacttcggactgaatcccaactgtttcctagtttgtgacattagttacttaaattctttgtgcttcagtgtcttcatctataacatgaggataataatccttttccccttggtctattgtagggataaatgaatcaattcatataaagcacttaggactgtgcttgtatagaacagatactatacacatgtttgctgaataaatagcctcgttatttgaaaatatttagaaagaattttgaagccaatttacaaaccatggaagaaaaccttattacatgagagtcctctaccttattcatgaaaactgtccctaaattaggctatttcaaaaatccaaatcaaaaccaagcatctgtatcaaaagtctacttcagaaagtctacttcatgaatttcatcagagatttgagtgtttaaaaatataaatatattcaaaaggacaaatatttcaaaacaagatctcaaaagaatgagtattatacttgaaaacaattttcaagagcggcttctatgcaaggtgtgagcaatagaatcactaaaggctaccaccttccaagctgactattctaatatgaacaatttccatttagaaacaaaccttctggtgtttctctttatatttatttatttatttattttttaagatcgagtcttgctccatggcccaggctggagtgcagtggtgccatctaggctcactgcaacctccgcctccctggttcaagcgattttcctgcctcaaccacccaagtacctgtcattacaggtggccaccaccacgcccggctaatttttgtatttttagtagagacaggatttggccatgttggcctggctggtttcaaactcctgacctcaagcgatccacctgcctcggctttccaaagtgctgagattacagacgtgagccaccacgcctggcctggtgtttttctttatacttagcacttcatactttcacataaggagcttatagtcttggaaaagagatagagcaaatacacaagaaaaacttcaaccacatgcagtaaatgacaaagaacaaaaaaaaaaatgataaacctgaggtgttatggaagaacgctaaatgatatcgagataagggagttataaaaatctatcgttagggtatgtttaaaagtgggccttaaaagaaggaaatatattttgtaagaagaaggaatagctgtggcatgtattatttttgtcctctaagcacttcaggtaatagatccagcctctggccacagaggcgtcatttgatctggccaggatcatcttaatgtcactaaaattcttcagactcatcaagaaagactattttagtttctgatcacagactaaaggacttaattcccaatatgtctccagccatatcccccattgtatggaaaagctggtctcagagactgaagtcggaggaaaaagagagagtccatatgcagctggatccagtcatcctgtggctacattcacctccaaacccataatatctaaagtgcaactcactttctttttcctcctcatgtctccccacaagatacttgccccttttctagattctccttcctgttgcctaatctagcaattcacttggattgatcacttatactagaatttgttcagctttcgtttaccctccttacctcacccaacaccatcagcaacaaatcctttcgtgttagggactttccttatatacctggtgagctctggctatatgtttctatgtaaagataagtcactgaaaattgactaatgcttgtgttgaagtggggctggaagggaacactctaaaacgtgtttcctggtggctggtgatctggttgagacccagctctgtttgagaagtttctcaaatgctctgtgaaagagcaagtgaaaggtttgtgttacttctgtgtcttcctgttacctttgcttccattttttactttatgtattccgtttttttctttctttcttccattttcgctataatgtgttttgagagggctctaagataggtgaatctgcttattctgtgatttctaaccagaaggacctaaacactttttacatctaaagccataccctccattcctattaacatataacgatggtcttcaaaaggtcttcatcatctttcctagggactcgtgcaacaaccttcttaatggtattgcactgatatttcccccattgcacctcatcctgccctcagctctgcccaacatccttgggtccacaacctatctgattagtgtctccagagagtaaacttcctgtctcctgttgaattggcggacaggaaatcgactgtgcagcctggggttggagatctacgaatcttagtgctacatataaagtcacttctcttttcatctccctatgcctgtcaccaccttccagagcggctgctgcctccaatttctgagcactttccgttttccagctcaaagaatatgcttccctcttactgacttcccatccccactgccctcctcaagaaggttgagaatacagctctctgcagcctttagcatagctgccaacagtccacctactttccagagaaataatgctattgatatggtttgcattacatctgtgtcttcctgttaccttcgcttccatttttttctcatgtattcattttctttctttcttccttcttcactataatgtgttttgagagggctttaagataggtgaatctgcttcttctgtgattttctaaccagaaggacctaaacactttacatttaaaaccatgccctccattcctattaatattctaaagatggtcgtcaaaaagtgttcatcatctttcttatggactctagcaacaaccttctaactggtatcctttccagtttgtcatccctaaatctacttccaacacatttcccaaatcatccatccaaaatgcaaatctctcaatgtcacatgtttaaatttcagtaggaccctatcctctaaagaataatatttaccttgtgtgtggctcatggccctgaatgagctggcaccgcctatatcactagtttagttttttaccgcttgccccataatatatctgaaactccagcaacatggaacttctcatgcccaaccttcaaccacacacatattactcacacggaagccaggctgtatcccacctcctggcacaaataccctttttctctccctccacatatacacaagatgataaaatcccctgcaagtggtatctggtatcttctccaggaagtttgtttgtttatttgtttgtttgtttgtttttgagatggagtcttgctctgtcgcccaggctggagtgcagtggcgtgatctcggctgactgcaagctatgtctcccgggttcacgccattctcctgcctccacctcccaagtagctgggactacaggtgcctgccaccatgcccggctaattttttatatttttagtagagatggggtttcactgtgttagccaggatggtctcgatatcctgaccttgtgatccacctgccttggactcacaaagccaggaagcatgttttaatgccctttccctggaagattaagggcctctactctgtattcttataaaaagcaccttacctatacttacttcatatgttgaaatgagttattcatgcttctgtgcccatataggagagagactgtgacctgtccatctttcccaatttgtttatggcccaggcatcctggaagtgaccagaaaaaaactacagccacttttctttatctttcaactccatcttctggtgcctaggactatcctctaaccctcaaactaattcaagtcttaaatatacacaggaagaatgatcattatatggaatgggctgtatgtggcagaggagaggttaaattcccaagcctgcccctctctcatgccccatccccgacaccactactcaaggagtgtccagccctgctgctcccgtcctccagcacctgcacatccttgagctctagcgatgatatgtttagggctctctgtgtcaggtggccctcagaaatgtagataaaactttattcatcaccattattactgaatgtggttttgtttttcaaaaagcaagatagagatatggactagaaagattgatttcatagccacatacttgtttctctctgttttccaaaatgattagaaaatacccaaaacagtatacattagtcccccattttccaaaggggaacatattccgtgacccacagtgggtgcctgaaactacggatagtaccaaaccctgtgtatactatgtttcctcctatacatacatcatatgataaagtttagtttataattaggcacagcaagagattaacaatagtaactaataataaaacaattataacaagatgctgtaataaaagttataggaatgtggactctctctcagaatatcttgactgtactcactattttcagaccacggttgaccacaggtaactgaaaccggagaaagtgaaaccatggataaatggggactgctgttgtctgggttttcatatatatcctcctgttttggatccaagaggagatagaaccttgtcagaaatatctgctacagtgggaaaagggaagcaagagagccaataacaggggcttgaaataaaaaggagactgacaaaggggggttttcattggcaagcccactccagccctctgtcactttctctggacacatccccggcctggacaatgagatgtgttcctttacattcgaggaactatgcttgctttgccatcaagttcttgtggcacctgccgctcaagttacaaagaactagaacaattaaactttacatatgtgatggtttaaaatagactttgtgaacagacttggcaatctagctaccatggtagtttttgccgtctgtgagaaaatgatttcagagttccaaagagcagatttgaaagtgaacattcggacgacaacttgtttgcaaattcagactagcctacgtttcgttcctggtgctaactggaaaatattagactacaattatgaacaaatgtttttccctccaaattagcagacttgaaatatggttaataaccttagctgaatggagaaagcctcttctgacacgactgtgaatccctttacatcaaaaaattgtgtatactcaaactttaaccaagttgtagagacaggtgacataatattaaccaaggttaaggctatctaatcccaaagtgcaaaactcaagtaagtaataatttctgaagagcttttctcatatctgaaattcttataaagtcatttcctaatgtattgacaagtatctagcttatgaaacctgaaacgacaaatgcacagtgcaaaacttacaaatcacaaagtagcttacaaaacttccagtaacaaagttttctaatttttctatgaacaatgccttaaacacaactaccaaaggtttatgagcctccctaagataaaataaaaactaccttttttatgcttaattgttcttgcattcaaaagcgtgaatggccagatgcagcggctgatgcctgtaatctcagcactttcagaggccacagagagtggatcacttcaggtcaggagtttgagaccagcctggccaacatggtgaaaccccatctctaccaaaaacataaaaaatgagccaggcgtggtggcaggtgcctgtaatcccagctactcgggaggctgaggcaggaggaccgcttgaagccgggaggcagacagaggttgcagtgaactgagatggtaccactgcactccaatctgggtgatacagcaagactccatctccaaaaaaaaaaaaaaaaaaaaaaagtgtgagtgaaaaatttcagataatcgtcgattaaccacatatgctcagtatctcttccaagagatccctgggactccctcagccccaaatgaactggctcctggctccttccctccctcattgccactcccaggtaacctttatctattgattcaaggagaatcattttctttacgctcactgcaatggtgactctctgttttcactataggggaattgaatcgactctcttcttcattctcaagttgcttgttattacaataactcctgacattttaggtggaatacatgacagttggggaaggagaaacagttttacaagtcccatccctaaagcttcctctatattcctcatatagaattcaattctatatgaatttcttccaccagccaaccatatcacacgtggacaaatgagtctccacccaaagtattacaatcctcgtctgcaaaataagtatgtgtgtggcggggccagggaagggactcaccctaaaattcattttctacttcactatcctggaattatatgattctatgcacctcttcagtcttccagaataacttgtttttatcgttcccctttatcccctcattatccaatttgattaaataatcaaacaattagaagttgactaaacttattaggttaaaagtgtgcacacaattagtttttgttttcctttcacactacatgcaaattatacttaattacaaagtgaaacccactgtcgttattgctctctttcctttcattctgagccacaaggaaaaaaatctaaatattgttacacacacgtgctttcctaatcgttcagtctatcttgtgttataatcactgtcatcatcataatagtgatagagacctcgtggctagccttatgcaccacttcatcagtaaccattcctaccagcctttttagagaactcatttgcgggtgctgctttgtggcaaaacaccaaaagccacttgtcactccgtactctgtattctacttatttagtagaactttccctgtagattgaaagtattttgttttgttttgtttttttgagatggagtttcactcttgttgcccaggctagagtgcaacggcgtgatctcggctcactgcaacctccacctcccgggttcaagctattctcctgcctcagcctcccaagtagctgggattacaggcatgtgccaccatgcccggctaattttgtatttttagtagggacaaagtttcaccatgttggtcaggctggtctcaaactcctgatcttaggtgatccctctgcctcagcctcccaaagtgctgggattacaggtatgaaccaccacggccaggctgattgaaagtattttaaaggtaggaactatagctaattcatctttgtactttcttcagctcaagatacagaattttggtgtaagtactgaatatgtattgaatgaaagaaaaaggagcaaataaatgaatagtttgtaggacagtaacataggttcagagaatatcaagtcagaagaaatcccaagattctgagaaatctttgccagtttctcagagcaaatgatactaatctagtatcttgatggcttggaccactgatgccttgattctggaaacttaagcaactaagtatttcaaatttgggtccctaaagatgtaaaaatgataagaaatgttagattcacctactgtagccttattttcagaccaatggccagaaaaggtgccaactgtgaaaaatcaggatcacatttccatcaattgaaccaaaggccttaaaactatgtttaggcttttagagtgctgactttaaccaagaggcgatccagtgtaggaaaagaggacaggctttggaataaaatatgacttaaatccacattcctccatttactcacagcttgactttggcaggtcacttaatatcctagaccctctttttcttatggacaaaatggggataacaacaatatctgctgtacaaacatgtttaaaaatcatataagattatataaccaaattacctagcatagtacattcttgtgcagagtagacaatcaatacatttcttccccatcttgtaacttttatttcagcacattagctcccagtgtaaagagacatgtaattttaaagcttttttccattcagttatcataactgattgaggacaccacactgcacaatctcaggagttatgcagaatgacagcccctgtacatgctgttcctgtctcaggactatgagccatcactttctgctcagaataattacttggtgtatctacacttaaggctgcaaacaacatgaactaactggaggaagccgggtattcatggatgacccaatctctgactcaaacaaatcaaatcactgaagaatcataaattcacctttctttgtagcttccaagccaaagaaattatagaagtcacaagtgcgcctgtttcacaaaaatatcagcagtatatagcaaataagtatctctgcttttcaataagtaaagggtggagatgattaacgttaacgggaaaattaaattactctcaagcagtcagaaattactgtttggttcaccaagtcacacaaaagacagtctgaagtcaaacaactgcagctaattcgtcttgtcattgatgtatgttgtattaggattctccagagaaacaaaacaaatggatatgttggacgcaaagagagagagagagagagagagaagcacaactgatggatatgttggaggcaaagcgagagagagagaaacagaaccgatggatatgttggaggcaaacagagagacaggaagagagagattttaatttggcttacataattgtggggctggcaagtccaaaatccataaagcaagcagtcagcctggaagttctgctaagagttgatcttgcagtctttagtcccaattccttgaatttccaagcaggatttctatgttgcggtcttagggcagaattccttcctcttcaggaaacctcagtctttcctcttaaggccttcaactgattggatgagtttcacctgcattacaaagcctactctgccttacacagaacctactgattcaaatactaatcacatctgaaaaatactttcacagcaatatctagactggtcaaacaactgtgcaccatagccttgccaagttgacacataaaattaaccatcatatatctcttgcttgtccaaatggtttgcttttcttgctattctaatcatatagataattttttcagagctttctccaaattttctgcatgtttgaaacactttttcctgaaataggaggtgactgtttttcagtgtaagcattgaatagtttgtaaataaagtagttcctattacctgtcatgtagttcatatttattacacagaggaaaatgtagaactttaatttcatgatacctcattggtcatggttagattcttcaagatcagaaatagtttttgttttggaattcacagaatgaatgcatataaactcttttaattcacactggccaaatgtatcctctcgatctgatgcattttcatttaaagagcatctttattactaaaataaataccacttagcttgtagaatagaaagcagtttaggcattttattatttttacttactgaaagactcttcagctgatttgccttatttcatgttcaccggtgattagagaatctgatggatgacattttatcgcctacactttggccacagatgtaatcaatctgctcttggctagccttgatggggcctgtccttccctggggcaccaatctaagagctgcacaatgtttaaaaagcaccttgcatctcagtagctgcataccaggaggatgaacctgcctgttttgcctaccagagtcacaacctggccactttgctttcaaggctttctgcgacgtgtccttacaacattctaactgctgggacatcctctgaagcccagcagcgattctcccatctgggccacctgggaattctcaaaggcaccctatctcaaaacggactccagcagcagcagcgtattcgaggaactgtcagaaattaaaaattcccaggccctgccccaaacctagtgaatcagaaaccatgtgtgggggccagtaacttgcattttaacaggccctccttgtgattctgacgcacgctggagttcaagaactgctcgaagctgaaggcatagcacatgtccgttcccaaagctccaagtgacactcatagctgcattcctgcatcatgattttcatttctagactagacaattcccagtggttcttttatatatggtaggatcatcaagctttgcagtttcgtgaggtctttcttttctcttctttttgtctttgttatgcatttgttattggtgttttttgctcagtgttgtggttataagctaaagaaattagttcaatgtgaaaaacagtacttttgctgaaaactgatcctcagcacattattttaaatccttccttcaaatcctactgaacacacgtttctccccaccatgagtctcaatattgaccctgaatatccccatagctcgatgtgaatatgcctttgtcagcaccatgacatgggtgccagccgagttagacgctggtaaaactaccctaagaaataggaataattcccttgcaattgggcgcagccatagaggatggctgaactttccaagaattatatatctgttagatttttaagttcttccaaagccagggcatatattttactcttttgtgaaaatttgttggatgaattagggaatttatggcataggccagattgttactgagtttgggagagctttgaaacctgtgaagtttataacaacaataaaacaatagccactacacatgttaacgttttgaagaatcagctagtcaaacatccttgtttaggggaaaggaaattaggagcagaaatttacatccattaggcctgtgaaagaaaaatagtttgtttttgtttttttaagtagcaacaaaaagtaagcaagaccatatgcaagagaaaagtcagcattaaaaaattaaagatgaggccaggtgcagtggctcacgcctgtaatcccagcactttgggaggctgaagcaggtggatcacttgaggtcaggagttcaagaccagcctggccaacatggtgaaaccccatctctactaaaaatacaaaacttagtggggcatggtggcaggcacctgtaatcccagcaactcaggaggctcaggcaggagaattgcttgaatccgggaggcagaggttgcattgagccaagatggttcccctgcactccagcctgggcaacagagtgagattccatctcaaaaaaaataaaaataaaaaatgaaaccaagcctcaaatagtgcctgcaatgcccttcacccagatatgagagtggctttctcctggacttcattccggcctcctccccaggacctccttccctgatctcctgtctgaagccctaacgcccaagcccaccccactcagaatgctccactccacttctgcttcatatcccttcctcacttttactgctacctgattttctacttcagtcagttgcttatttgcctgtctcccgaggattatggcaggaattttatgttttatttattgctggattttccctgcttttagcacatagcggacattcaatcaatatttgctaagtgagtggatgaaagaaagaagaaagaaatgaatacaagtccttgagccatgagtgaaaaactttgtaaactatctaattgctataggctttctatacaagtaattttaatttggagagaatcacaatctctttgtgtattttatgaaagctagggattattttcttaacaaaaaaatacatatgcacaaataaacttggcatgcaattttagaggttctgattgttaagcaaattttctgaagatgaaagccacctactctccttatttcaaaacaggcgacataatgacagggcatctctgccctgtgtcctaccagagaccaaatgtgattttaaaacagcacacaagtatcaacaaaatatctaaaatactcacctgtaatctgttgcctggtgtgatgattcctagagatgtagtctctaaaaggaaaatatggtaacttaaagctagataattgaaagatgatgctgtatttattgagcacttgctatttgcctggcaccctgctaattgcttcacaagcctcctcttgttattacaaataccctagaaggttgtcgctggcagccagaaaaatcacatattgtgccttgtcctccgtgagttggaagccaattattctatcacttgcatagttgtttttaactttgaaattttttcttacgtgcatcatttcaatgtcttttaatctcatggcaactgatgacaaaagtagtttggtttgcataattcctatttgacaaggaagggaatgattcagttaattaattcattaccaatcattctgcaaacatttactgagcccgtattcatagaaattacctttccttattaccagatatacgcattgttacatatgaagtgcttctggtataaaaattcaaatcagtatgtgtgttttatttaattgcttggttaacctacacatattttgtgtgcaaaataattaaagggtacaaaagtaaaattatcgatgtttctgacaattactgatttctgtgaaattctttgatttccacctgcaaaagacaaaggctatttattgttactcaattatttcaataattgagtaagctgaagattccatgtcgctagttgggcaggtagctcacctcctgtgatctgggtgtggaaccactggtttttgggatgaggtgagcccttcaagaccatctggcttatcttcacgtacagatgaggtgtggggacatgggaaatagacttctcagaactgaacttctcagagtcagggatcagagcttgttcatctttgtgtcttcacaaaaagagtcattggtaaaggataaatgctcactaaatatttatttgcttaattggtatctaaacttggtttttataatatgtaatatgttccactacagtaaggagagtttctctttttgtagcagtaaattgcagaatgatttattcttttctaataaaaatcaagcaagggcccaatgcagcaactcttaacttcaggatttgagctcagctagggtgccagctacagcctcaaccacaattatttccagttaaactaaaatagtatttttttcgaaccatggctttgtgactctaatttatttttaaccacctgtaacgtaaattgtctcacttgattttcccacaaacctgtgactggttgagattatcatcccagtccccaagaggtggattctaagggaaagaacaaccaagtgtcccatctaaggtcaaaagcaagtggggacaaaattgcagccagtccaggttctttcaattgcacagaactatttgcaaagcaatgttatggcaacttagaggaaaactctccatttaactaccatattaagttcctctagctatactatctggctaggaacactgaagtatactactcaacgtatgataggggatcagtattgatagaaagaataaatgaatgaagtgtaataaattgcatatacaattcctatatggggatttttttcatggagtttatatcactagcagtacaaagagtggaactactcacttctttacactcttgtttaattcaattatttagttaatatggtattatacttttctttgttgctcagaatctatccctgttaaacaacagtaatggtacattttccagctttattgtaccaaaacggatgggaaagatgctctgtaggtaaaattacatatgtacatattcttacatatacattatcttggaaatttagatttcttataagttgtctttcctacaattttgtcttatcctcctaaattctctgatattcacacagaaaattgagcagtgtggataggcatcagaatctgtgccctaatttttccatctatttacaattcatgatgttaatgtgattgtcaaatcaaatcagggcattaaaaataaccacaaaatacaaatttcctagaatatgttgtcattctgcaacatgacctttgaaaatattggactaattatttttttgtagcaattagtaaattcatccttaattacaaattaggtaatccattattctgaaatcggacagataattagtaatttcatttaaaagtaattgtaattgaatcagaaatatctttactaactcagaaaacacactgccaaatctaatgtgtgttatggaaatgatatccacattctacatttttcatataggccaccttttgtgtgctgcatgatcaagattttaatagagcaaaactgtagagaaattaaatgctcttgtaaccatctggaatttacgtctatgctaaaggcattgtcaagcaggtatttgaacacatcttccttctgtttctattttcaccccaggaaggaagttatacttttccttttgcctttgaccagaaacaattgattttgttttacttggtttatatttttcatttcatctgctttagctaactattagtaagtcatttacttcttaattatttctatatcttaatattaggaaaaaaatgacaaatttgacatcagtcttaatgtgttaattttgtttccctgggttaccatcaatgtcacatagcaataatatccatttatatttgggtggcatacattatactattaatatattatgtacattattaattgattaattaacactattttgtattaatcattacaacaaccctacatgtactgttcttatactcattttatagataaagaaggggaggttgaaggcaggagcatgtagctagtacatgacagagcttgtattcaaaccccatcttctgatctttccagttttttctaccacacaatagatgccatgataaaacacatggctgagctgtgtgggccaccacagttgttcaaccatgatggctttatcttggtttagtctcagtagctacaaacctaacaataaaaaacaagctaatctcatgctttgagaaaaataatacttctttgttttgagagtttaaaaactttctcctggaattgtgacttttcgtagtctgaaaaattaatatagtgtaacaaatattattttattacatatattgatactttagaatttctaccactgtaattctacctttgatttcaataatcaaccacagtgtcttggggtcaagcactttcaccttaggactgggtttatgttagaaaaaaaaactttattaagggttctactttcctagacttgagcaaataatggaatatgcttcaaagacttagatgaatgaacttcagctcatattggaagatttacaaggaaaataattaattcaattatattttcaaaagaaagatgagcctttagaaatatgccttctgcccagtttttgtaaagattctgaatatcaaatcttttcccagttaaaattccagtacaatatataataaatagtaccttcataagtgaaaatattacataatttaatgttttataatttgtaaaaacaatttttatgaaagaaaacttattccttgcaaaaaaatcatattttgaaattaacaagtcatgattacacatgacttagtgtgggtacaataaataatagttgattaattttgctttttaaattgtcaagcagagaatcatcgcagactttatatacccatgctatataaagtctgccatgattctatggaacaatagatccaggtttggcttgagcattttgtttgttatcaatattttctataaggcataatatgtaatatacattatcctacacttcttggagatctactcttatgaaggacaggggtttccatcagcttgcccacaggatgactttaccatgaggaaaatgaggatgttagtttcatatatgctttgagaaacttcaatcgaggtttagagaaccctcccttaattgtcttccactctgcatcaggaagtctcgtgccttgacgataaatatgagctgatctagaaaagactttttgtgtgctcacattgatttctctacaaatattagtattccgtagagaaaagtgttgatcagcatgtccttggtttctataccctctgaatataagtccctttcttaaaatttaaaaaagtagtttatagttgaactctactgtactttagtcaagttctctacccatttgcctgatttccttcaatcctgctagctgctatttctcacactcctttgctcttcctcctccaagaggcttctaaattgtggcagaccccaaggcattttctccagccatcctttcttcctgtctcttttctctttggaagatctcatcctgcccccatagtcttaaaaacaccttggaggctgatgattctaaaatgtatacctgcagcttggacctctctcctgagtccagacttgtctctccctccttggcttagcacagtgacaaccagctagagcccctgagccagattttctgtgggctaattcagactctgccatttattacagccttaacagtcacaatagcagtccctatttccagataaagttaagaggcataaatgagctattgcccctaaaagggcttagagcagcgcctgccacataataggcattgataaataatagctatgattatgacttaaatctctactttggacatctaacaagcatctcatttttaacatgacaaaaccaggacaactggtgttttccctctgtaccttctgatacaccagattttcagccaagatcaaacacccagaaggaatttttgattcttctcttttcttcaaatgactcatccagtccatgcgttagtaagtcctgcccactttatctacaaaataactcctgatgttttcctcttgccttgtccttgcccagagacaattgatgtctgtctcccacaaacctggtttggtccccattgtttcctagctggtctcctgccttctcccctgcctgcgcagtctaccccatgtgcacagtgatctttctgcttattaatccacttatgatactcttcttgcttagaacttccagctgctccccatttctgccaacataaaactcctccaggggggctcacagatctggcctgtccctgctccctgacctcttgtccctctcttctcccccatcttccactgtgctagcagtgacactagccttgtctctgtcctttgagcacaccaagctcctttccctcccaaggtctccgcatctgcaactcccccctgcttctctcctctgtgtcactgcttgcaatgctatctcctggttattcatggtgcaactcaaatgtcaccaccatgagagctgacgtccctggtaaccttgactaaagccacttctcaccccctctccaagcatccctcgctctccaccatatggccttattttctcttcttcctaacagttatctaaatatgacattgacttatttgttttccatgtcgttaggcaatcttccccactggaaggtcagcctcatgagcaaaggggcttttcaaattctgttcatcactgttttcccagtatgtataaggtgtctggcacacagagaagacacttgaaaattttctgtgtctgaataactctgtgtttgctaagatcttttaaagctgtctactctattgtgaagcctcataaaataaacatgtttgtagatatctaacaaagtgatgttaggtaaagaaggagaatgtgtcatttgaaaccatttagggaacccatttagtttgagttactataaattttgttgtacacattgtaaataaagctatattttaaataagggggcgggtgagaacacatgaagggtagttctgttacaagcaggagagccatttcccactgcatcttgaaatgccctcgttaagcagtttcagtcttagaaaatgtttatttttgccagccatgatcgtttacacctgttgatccccacatattgggagtctaaaacaggaagatcacttcagtgcaggagttcaaggccaaccaggacaaaacaatgagaccctcatcactaaaacaaaaaaaacaaaaaacaaacaaacaaacaaaaatcagccaggcacggtggtgctcaggtgtagtctcagctactcgggaggctgaggtgggaggatggcttgagcccaggtgttccaagctgcagtgagctatgattgtgccactgcactccagcctgggcaataaaggaagaccctgtctctaagaaaagaaaaaagaaaggatgacaatttttattctgtatctcaaagaaaatcttgtataacattgataggtagggaatattttacaaaaatgtattcatgcatgcaataaggacaaagaaaaaataatttaaacaatttatataagtagtaagtgcaatatgaaaaaactgtaatatatttttaaattaaattcagttagtttttctagaatcatagtgttgccacaattctagagaggtaatttagtccatttctctgcctttagggaggataaacataaattttattttctttaaacctttgggcaggagattttggcatccgagaaccactcttaagaatctatttcagcagtgactcagtcaaatacacaaaaaaatcacattttaatatattgttccaaataaactatattaattctgtaaaataacaattaacctaggttaattaatgggttaatcaagtaactcataatttacttgttaaagaaaaagcaaactcaagaaaatccatgaatagtgggccagacatggtggctcacgtctctgggaggccaagtcgggcgtttcacttgaggtcaggagttcgagatcagccaagccaggccaacatggaacccaatctctactaaacatacaaaaattagcggggcgtggtggtggacatctgtaatcccaactactcaggaggctgcggcaggagaatcgcttgaaccccagaggtggaggttgcaatgagccgagatcgtgccactgcactccagtctgggcaaaacagcgagaccccatcttaaaaaaaaaaaaaagacaaaagaaaatcagtcaatagtgaacattcagtgtttccagcagctaccaaggtatgctatgtgtgctctggtcattctctgactctcaggtatacttcttgaaaccagggaatgaacagtgtagctcagataatttggagctggaggcactgcaggaaccaatctttataaaaagattgcattgtgttcattacgctttattcgctaaggcaggaaaatatgctaatgcactttacaatgattttcaaaaatggttgaaataaggtgttttgtgttttgtttttaatttaaaggggcattaagaaaaataagcaattacattccatgtccaatcaaggttttactgtatgtgacttagaggtcattaaaaatgctgaagctaatttatcagtttaaaaataatagttcgtcattttgtggaagctgacatcaacctaacatggtttgagtctttgtgtgtagaagttacatacattgtcccctggtcacattctcaacatgttatgtcaagaaagcgtctaggaaaaagaaagaaggcacagaaaggatcatattaaagccacttaaaacaaggagtgaggactgactcagtgccaatatcaatattttattccttttggtaggcaaaaatttttgtgcttctgaaattttagaaacttcaaaaaataggttgtacttttaaacagaaagtagaaaatattgagtttcaggttttatgaaaagtttcttggatttggtggggatttttttttttattttttggttttgggttagttgggggtttcttctgatgtttctgtctccatcatttctgaattagaacatagacattttaaatttgagagcattatatggtgcacagaattcagctatgtgacaaaattacacatactgattctttcccttttttgatcctctgtagcaatagctattttaacaaaacactatttatcctcataataaccagtcctcaacttggaagttctttactcaatcttctttggagtgttgcctttattgagccagacttattaaaatactattcagcttagaacttgttctctatacttttaagccatggattcatagcctcagatctctgagcaaaaaagaatcctaccaattggaattgccacccaaacgaataccaggtttactcctatcaatcattattttccagagtagccaatgtggtgcttacaaaataacaaaaattaaaaattgaattaaaagtttgggcttgtttacaaaccaccaatctgtatagtgtcccagtaaaaccactgtgaccatttatttactagaaggctgcaataagagaccaggaatccacccaaaggaaccagaggaacctggctctgggcgaatcataaagaaggtagtgagcttttctcctcctggtttggatacccttggtgctcattgtgagctttctggatttattctttgctttattttttttcctcttcatgtctatccattatgtttattttaacctaatttcaagtgtgtaaacattttgcagagggtggaacacctacctataaggctaacctgtttccacgctcatgaaaatgagccttgtaaggaaaggtattttgagtcatgttcagtttgtagaggcacagagagtctgaagaaaagtttaacaagtaaacaagattaaaaaattcaaaaggaaggtagtgaggaaagacagatgtagtaatcctaacccctggtcacctcatcccctctcactgtgtgttttttgtctatacctgtgacctgggccttgaaacatgatgcagagaccacagcttcatgataggaaggcccttgattagcaaagaagacgtagaggaaggtagctagtgactggtttgaatgtgctggcctatataattatctagaattaatatttgctcagagctcacagaatacacaacattctgctaaaggagggtggcatggaaaaagaggcagagatcaacagacctgtaacctagctcagcaaggtagacctttgtgttcagtcaaaagttcatgaggattccattgaatatgtaaaaatcaaaacatgtgtgtacatagtttgctaacgttccacctctgccaggttgtgctgggttattttgatatcagatgagtcaaccagccaaaggcaaaaaatcggtcttatttttaaacactggataataggctgggtgcggtggtttattcctgcaatcccagcattttgggaggccgagaaagggggatcagttgaagaccatcctgggcaacatagcaagattctgtctctacaaaaaaatttaaaattatccagacattgtggtgtgcacctgtagtcccagctactgaggaagttgaggtgggagggtcacttaagcctaggagttagaggctgcagtgagctacgatcatgccactgcactccagcctgggtaacagagcaaaattctgtctctaaatgtaaaaataaaaataaaaaataaacactggataatgaagcaatgttcttttctcaaactctacaacaaataaaacctaagtattaaacatggactttgtacacttgtgtatatatcaatcaataaccattacttactacatgaaagttaccacactggtatagagaggacaaaaagaaagaaaatacatacacagctcctgttcttaaggatcctaagagttttgctggagaaacagggcatgacattctaatgtatatataagaatatgcagaaagattttaaatcataatgtatatcagaaaaattctgcattagtggtgaaaatatttcctaatcatagaacagatgaggagtttaaaatagccctaaaccaagtcaccccaaaatttagtagaaaaaagtcaatatttctagaagtcatttctttcttctagcttccctgaactgtagttgtgatgggaaggaggtagctattgatagaatttaccatatatagattaggtgatgactggggttaaaccagtctggggatgactagattccatttatcccacaggccagaatcaacaacagggatatatcctagtaaattctaggatacaactccaaccttgaccccccttctatgcatcccaatgatctggaccaatattatcattttctatgaatgtatgtcttgacgtgaaaaaattggaaagctctataggaccagcagatagtcataaatccagaaagtaatacttgttttcagaatcaatttgggagaggggatgaggaaaaggtatttactcatttggtctccccatctagactgtgatgagccactccaaggcaggactcgattcttcatctttttcccagagctgagttgatgctcctgtgatatttgttcaaataatgaattggatgaatcaatgtctggatcagtgattcaatgaataaatgtctttgcttcctaccctccagcttcctcttcaactcactctgatccagcttcccatccccttcacatttccatatctacgcttgctgattttcttcagtgacttccacattgcaggatgaaatgatcacatttgcattctcatctcacctagtcccagatcactccagcctattgactgtccagctcattttggaagagtctgttccttccgcttctgtgacatcacacttttctggtcttcccctttcacctctggctggtgctcatcacatcactctgcgggctcctcctgaattgggcccttgagtacctgcatccagtctcaagcccactcccttcccatgtcaaagtctcaaaatataaggtcctcatctccccagcttcagataccctcaaacttatatttcagccaagacctctattctcacctccagactcctaaaaccagtggtttaaaagtttcacaactctctctagttgagcttctccaaaaacaaattcagctcctgtgatgacctagtccacttcagctgcagtcttctctacctatatagatggtactttcatcttctcagcttcacagggcaagaatctgagaggcttcttcgactgtgacgtcttctacactcccgcaatcaacccagaaccaaaatacacctctctctccaaaatataactgaggcatgaatacttctccccatattcatcactagcagcccagccaaatcagcagtcagttctttcttgagctgttaccacttacctgtcaatgccatctctactctcatccccttcttccagatatatcctcctcataggagccacagagatcttttgaaaccacaaatcacatcatttatctacttaaaacccacgtataggtgctcagtgcttattagcatcaactacaagggcttgcatgatctagtgaccgcctcagcagcatcatcttgtgctcccttttccatcactcaccagattccagctagtcttttctattttaagatcctagcttggaactcttgccaagattcttacctagaacttttgcacatgtagttcccagtctgaggagtgctcttccacctatactttgccttgttcatatttaggtgtcaaatgaaatgttagttcctcagaatagctaaatgaagttaccctctctgaacttttctttgtaacactctccacagtgtttaattaatggccattcatttaattatttgtttaacattgacatcccccactatgctgtgagcttcataaggccagagacaatgtctacctttgttcactgctaatatcgctagtgcttggcacagtgcctgatacagagtagaggctcagtacatttttgtcaagtggatggatggatactatgcagtggatataggaaacagaaaataggtttcagctggggacagtggcttaagcctataatcctaacaatgagaacctgagacaggaggattgcttgaacccaggagttcaagaccagccagggcaacataatgagaaacccccacccccaccgcccactctacaaagaaaaaaaaatgccagaaataaaaaattaaaaaataaaatatgttttatgctttaataagtatgggcacaaaacactagcaaaatgtaattgcattatttgtaaatccagcaatttctatctgaattctagaaatagtctttcttggtcagatcccatttggggcatcactctttgatgcctactccacactacctaaaactgcaagtggggccgggcgcagtggctcacgcctgtaatcccagcactttgggaggccaaggcgggcggatcatgaggtcaggagatcgagaccatcctgactaacatggggaaaccccgtctctgctaaaaatacaaaaaaaaaaaaaaaaaaaaaaaaaatagccgggtgtggtggcgggcgcctatagtcccagctactcaggaggctgaggcgggagagtggcatgaacctgggaggcggagcttgcagtgagccaagatcgtgccactgcactccagcctgggcaacagagcgagattctgtctcaaaaaacaaaacaaaacaacaacaacaacaaaaactgcaagtggtctctgtttctactgatcacaaattcaccttgggtgcagccatatgcacaacagttcattcaatcacaccagcatgttctcctagctcggtacttctcaaaatatgattcctagagccggagcagtgctgcctgagaacctgaagaaaatataacttcttcagccccacccttgatctaatgacctacagaatcagaaaactttgagagcaggcccggtagatgattccaatgcacgctgaagtttgagaaccactgggctagctaacctggaaagggaatacctaggagtcccaggtttaccgttttacaacttagacatacctgatttgtcaggctcttttggcaaacttggtggagacaagataatttggagccaatgttggtgtccaacttaataagctggctccagttggggtagggaaagtagtaggcagcttttgggttatgagtggcaagactatatgcacaattatatgtcctcttctttaaaaaattataaatacgtaatgttgtatatgtattctttttggtcagcctttggatgttctactataacatgtccccaactcttaagtagaggtcagctgaggtatataggtctatgctataaatgcaacccttccataagtaaaaagctagatcctcttatggccaaatgtttctctcttgaatatttagtgaaatttgcatgtggattagttttctgtctcttagatctcatttttcataatttttaatatcctcatcattgccttgcagtatagtcatgcatcacttgacagcggggatgctgtctgagaattgcatcattaggcaatgcacatccttgtgcagacatcatagagtgaacttacacaaacctatatggtatttatttatttattttttttataagaaaaaccaaatagcgcagcaccattactgaatgtcaatcatttcctctactatgcaatgccaatatcaagtgtcatacatccggtttctatatatgctccattataatcatatgggaccaacatcatgtatagaaaatcatcgttacagtgcatgactgtactaagtctttattacatattggatgactgattaaaagctattttcttactttaattggaaataaacataaagcgctacatgttttaacctgtgatgcaagaagacaatcttttcttttaatgcccatttttcccagagaatattctctcctgaacttaatcagtgataatgccgaacgttctttattctgtaagttcctaaatcgttatagcattttccacatgttttcagaggttggtctttacatgaaagacccatggttgactgagacttgttcttggacagcatgctttgtttatgtctctgccttaggatcaggcttcagaaactacccactcatcaaccagcttttatattttacaccagcatacatgactctgtgagattttctgtgtgtgtgtgtgtgtgtgtgtgtgtgtgtatacagaactattgtcccagaacatgtttacctgtttggaaagtgttgtagtgttgtgcaatttagtaggaatatgggaagcaagaaaaaaatttcttgtacgtatcacattatccctttttgccgtccgtgaaataatcgaacagtttcctcaagggactggctctgttctgaaaaccaaaagcccattagtctcactcctacttcctttccaggcctccagagctctgaataaaccatactagcaaacagcctacactgaccaacttctgagatttctcttttcctctttttgtttttacctagttgttttataaattgccaaaagttacagaaggctaaaaagaaacctctctgttgtgagctttacctccagtacctttgttatatctgttttctatgtgatgcatttcagaaagtgtgtaattttaagaaacttgggacgtattttagcattcagtgttttaaaacacaaacaaactaaccatttggattattttatgatacatgatttttgcacagtatcaccaaagtgttgtcaaaagtctatttaatctccaatagtcaccctagaaatacagacagacacacacacacacacgaaacaccttcaagattcaaaggaaaatacaattgcattttggttggcttaaatccaaaattttcaagtttagtaaagactctgcaactgcttggtatgcaacaagactctaatcttaaaaagtaacttaaattttatatttcataagtaaaagtacatggtttatattgaatttggaagctgagcttatgaaggttagcacaaagaagaaaaagtaaaataaaactatatcatgttgataaagttagatcttaaaatctttttttttttttttttgagacggagtctagctcttttgcccaggctggatggagtgtgcagtggcgcgatctgggctcactgcaagctccactcccaggttcacgccattctcctgcctcagcctcccgagtagctgggactacaggcgcccgccaccacgcccagctaagtttttgtatttttagtagagacagggtttcaccgtattaaccaggatggtctcgatctcctgacctcgtgatccatccgcctcggcctcccaaagtgctgggattagaggcgtgagccaccacgcctggccgattttaaagaattacactagagacatgtctactacatatgcctcaataatataaactactaaaaaccttgagtttgctttttaatggtatttctggaaattcttctgttagcacatttgaaaaaaatctgcagcaacaacaacaaaaaaattaaaaacaccttcagatctctttctgatgcaagactcaaaaaaaatcagtcggatttgtcagacactgtattaactattcttaagtaacagatctgtccccaacaggctcagtggcacctcctggaaggctgtaattcagccagggcattaaggacatggggacacattaactgtctcacgtaattcgtaaaccactttgctgaattgatttacactaactccttgctggagcatctttccaaattctcactctttaaaatgcttttattttagaatcagaaaaatatttattttcaaaagaaataataccaccagttaacaaaatgcctcctttatgtctcataggactgctgtgaggattaaatatgtaaatattccaaacaataaggtattcattttgctgcattcccttatctctatgtatatataaaaagggcacgaataccatatgcctgactatgcatgctcaccttaatatttattgtaaaatctaagttccttaatgttagaaatcaatttttattattctgtatatagttcctactttcacttaaaatatacaagagagctcaacaaatataaattaataaaggatgaccatcaacccaagcaaaatacttaactgcaaagaatgatgcaagaaaataataataaagaatagaggcccactttctgcctatttccattttgtctactatgaaagaaactgtaatgtaactgtagcaggagaaatttttaatttttatattgtctttgaacacaaaaccatcttctaaaggagctttaagaaaacctaattccctagggaataagatgcacttttagttgagtcatagttttacagatgtatataaaatatagtcataagttcctcatttaaatatataggcaaatgcatttgttattttttgctgcatagcaaatttccccataatttagcaacttgaaaccatcatgaacgtatataatctcacacagttgccgtgtgccagaaattcaggaacagagcttagttgagtggatctagctgagcctatgtcatagggttttccacagacttgactaggcctggagtgtctgtcttcagtatggctcactcacctggttgttggaggccttgcttccttgccatgtgacccacagggagctgcttgagtatcctcatgacatggctgctagctttccccagcacaaaccttccaaaagacagtgcaagagggaatctgcagtgccttatggaatagagtcagaagtcgcataccatcacttctgccagtctattaaagaagggaactaggcttcactttttaaaagggggagtgttaaagaatttgtggacacatttaaaactcatcatagcaagctctatgagaattgccatccccatgcagtaaagaaatattacttcttagaactgattctagtttgactcagctttttactgacacacttttccaaaagaaacatagcatatttcagcacagattaaaaattatttaaaatttggaactttaaagataagctaaaactttataactaagaaaactgtgatctaaagtgtttaaccttcttaaggttataggactagatctgaggtctctagatacccagtttaaatcctcagctgagttgaattatgttataatgtcagatgtatatgaaatccaaggttataagtaaaattcaatgtaataatttgtgtccaacaaaataaaaaagggtttatgggggtacaaacaaatataaatactatcatacttgcccctaacatacttgtactttaaatagagttagaagctttcaaacaagtaactaaaacaattaagatgatattatttgtttattttagcaactgatatattgttctttcaaagctaaaatgatcaaaggtattcaacagcagtgggtactcatcaaaataaccagtagataatattataaatgttttaagaaattaacacatttaataaaagcaattttgaagtattttctattctaaatttttcttgttatgaaggaaaatttattacagttcttaaaagtacatgtaaaacaccaatgtaaataatgcatttgaagagaaatatttttcaggtctacttcaataaatctttaattttctattatttagggttctccaaatagaggatctatgaaaatgcagcatttgttaatggaatttttacccagatactaaaaaaaatatttgcaggaattaaaaatagacaacacagaatgtagcacatttactgaattccaataacagacacgtagaaaataggtcagctctctcatctggcctatgtcaatttggtgtgaattattatcaagacagcctgcaaataacagccaattttacaagtatatttggatctcattttacaaaatgatagaaaattgagaaaaccagttttccttagaactggatgaattatcctcctgattcaaggtatgtatgatggtgacttcctgcagaaaagaatgctgctaactggaaagaggacaaggcttcattacattggggacattctctttaccactaaaatgctctaaactgtttaggtttctttttttttttttttttttttttcttttttgagactgagtctctctctgtcgctaggctggagtgcagtggtgcgatctcagctcactgcaacttctgcctcctgggttcaagcgattctcctgcctcagcctcccaagtagctgagactacaggcacgcaccaccacacatggctaatttttgcatttttagtagagatggggtttcaccatgttgaccaggatggtctccatctcctgaccttgtgacctgcccactacagccttgcaaagtgctgagattacaggcatgagccattgcgccgggccagtatttcatttttgaatcacttaatactctccagtttttctatagactacttccctgtttagcacataggtgaatagacgtaagtatttttttaaaagttctttcctggtagtagattttgtattttaagtaattgggatcggcttagtccatttgtgtcgctataaagaatacctgagggcgagtaatttatacagaaaattggtttatttggctcatggttctgcgggctgtacaagaagcatggtgctggcatctgcatctggtaagggcctcaggctcttccactggtggcagaagggaaggggagctggtgtgtgcagcaatcacatggcttgagaggaagcaaaagacagctggggagaaaggttccaggctctttttcaaaaattgattaatttgtttgtagagatggtgtctgtctctgttactcaggctggtctagaactcttggcctcaagcaatcctcctgccttggactcctgaagttctggaattataggcctgtgtcaccatgaccagcctaagttcttttcaacaacccgttctcacaggaactaatagaaccagacctcaccccacccacccccaaggagagccttaatctattcatgagagatcaccccatgacccaaacacctcccatgagaccccacctccaacatcggggatcaaatttccacatgagatttggaggggacaacatccaaaccatagcaggagtatagcagttgtgtggctttgagaccctgctctattataatccttgaaaaagaaaaaaagacattgttttcatgtttttatttttaaatatgctacaaacgctttcttttgttaattccaaaagatagataattagatgaagtggtacccagtacaaaggttagagttatgcaaagaggagctgaacttctcttaacgaagagttaacaggcaagtttttaacccatttcatagagagcagaaatcataagaccaaatatcccaaatggatattagcaagaaatttaagataataaagcagcattttattctagtgttcatatttgaaattagaattcatttgacatagtgccaatttaataacttagaacccaaaccagccttttgtcagccctaataataaggttatagaattaaataatgggccaggcatggtggcccacacctataatcccagcactttgggaggccaaggcgggcggatcaagaggtcaggaggctggccagcatggtgaaaccccatttctattaaaaatgcaaaaaattagctgggcgtggtggcgtgcacctgtaaccccagctacttgggaggctgagacaggacatttgcttgaatctgggaggtggagggtgcagtgaaccaagattacaccagtgcactgcagcctgggcgaaagagcgagactccatctcaaaaaaaaaaaaaaaaaaagagagagagagaattaaacaatggttggagaaggatactgaaaaaagttggtgtattaatccgctcttgcactgttataaagaactacccgatactgggtaatttataaagaaaagaggtttaattggctgacgattccacacactgaacaggaagcatggctggcgaggtctcaagaaactgacaatcatgtcggaaggcaaaggggaaacaggcgcatcctacatggctggcgctggaggaagagggcgaggggaaaggtgctacacacttttaaacaaccagattttgtaagaactcactcactatcaggagaacagcaagggggaaatccaccccccccccccgccccgccagcaggcccctcctccagcactggggattacaattcgagatgaaatttgggtggggacacacatccaaaccatatcacttgggtgggaagaaacagatgataatggaaaagttgtggagagaatgatgtttgcaagcgttctttgccagtggagggcggggcagggaacggaggcgaaaatgggatcttaattataatgcaaaatttctgtttaagaccaggtgtcttttacatgcttacaataagttactttcacttttctgagtattttttattttgttgatgtgcttctaatcagaaacagttttataaactacacagctactgaaccaattacgtttgagtctgatgaaaggtatccccattataggtataaatagacccgttagcatcactgctgattgatgaagaattccaggtctgcaaaagccagctctattttaagtgctccttgtcagcacccagctttggagttaacctcactcaattgtgtttctttgcaggagagagattacatgaggctaaaccacagagcattcaatctgtctggtgaaagtgtataaacactttctagtgtggtcataaaaactatgatttctccctttactctgttaagtgcactcttagctagcaaaggtattcagaaagaagagagggaaggttcagccggccaaggactgacatgtagaaagggaaaatgtgtccatggcttacctttgtgttaatgtttcctgctcccttaagattaatcattaggcatctcaaggatgatcagtgttcaattacttctttaagcccatgttccaactaggtgttttgtttgtttgttactagcaattaaaatccataccaatatctttagtttctaacttccttttttcctgctgttatctatggtaaaggatatgtgcagaaaagagaaaatttgagtcctaaagaggctggatagaagagaaggggagaacatgaacttaactaagttaaaaccctaggttcaaaacttgacatggacacttactaatggtgagatcttggtcaattaaatgaccttgtctctatttgacttcatttcctcatacatagaataatatagtaacactatccctttggtagttattaagattatattagttggccaagcacaatggctcatgccagtaatcccagaactttgggaagccaaggcaagaggatcacttgaggccagcagtttcagaccagcctggaaaatatagcaagactccttctctgaaaaaaaaaaaaaaaaaattttaattagctgagtgtagtggtgcatgctagtcctagctactcaggagactgaggcaagaggatcacttgggctcaggaggttgaggttacagtgagctatgatcataccactgcactccatcctgggtaacacaaaaagaccctgtctctaaaaataaataaacctaatttaatttaaaaaggttattaataagttaataagtgccaagtacttagaaaactgcctggcatagaacaagtacagagttacagtgaccactaagtaagtgttgcctattcccccatgtcacagaagcaacttaccatcacttttcctagttattcacaaaatactggccactttgaggactataactggactcttgactacaacttatttctctgactttgctttctcaatcctctttccactcttctcaacttctgcctgcccttgaaaatgcaatcctcttaagggtcctaatttgaacttctccctttccttctatactttctccctgtttatcacctcccagtgcctttaattcaggccctccctacccctcattcccctcaccacacaccagacacagcccaatacagatgcgatctttatgcctcagtgatattggtcaaaaaaatactgaccatagccatttcgtctctatcttttctcctagaattcgaatttatttccttctctcttcatctcctatcttctacccagcttttgataaataattttgaagatatgttttgtaaaatgtttagttagcaaagcaatctcatctaacttctaaagttatatgtaaatttcagttaaccatgctatgtctataaagtctatgcttttatgttgaatgttcaaattatttaatgggttttctagaaaaaattagtattgaagcaattcagtctggacactaacgttttcatacttcctagttaattatcctcccatctatgtttacaaacaaaaatgtggcttattgctaatgttactacttaaccttccttatacttgatttgaatcttttcagcattagtctacattgaaaatatgtcagtgctacaaactgcatctcacagaaagctcagaattcattgacccattctgaaatatagttttctggaaccaaggtagactttaatcgtacataaatgatttgtaagactttcttcacttattacagtccatgtctcacataactctccacataggaagagactggggagagaaaggaaatttcaatgctcattcatagaagaaaaaaaaaggaatagattcaattaagaatccaatagaaaatacaagaaacccttaacataagattatttgagaagggattagttatacagggactatttgcaaagttgtatgataggagaaacacaagggatactgcagtcagttgggggttagtagtggctgagctgatcacccaaggcccaaatgaccagagaaggaagcaagtaaagaacccagagaggagaaaatctgcaaactcagctgccctaagaaaaccaatgaccttaggtgcaaaagtcacaaccagttccaagcaatcgtgccgagtgggatccagaggattagataatccaacctcactctcctccccttctgtctccttctacggcttgccatgggcccaacctacctggaagccaagaggaataaggaccctgttgatggaatccatataaagcgttctcatataaattatcatccagactgggacacttttgagggttaagaaagttgttaaagttaattaccattattgcaaaaaaaaagaaacatgctactcaacaattatctaactatataattgtagctttatacaatacaattgtattgtataaaactcacctatgactctgtatatactaggacaaaactgctgtacctgtttgtcctgcatatctcacatccacctaacccacattgcccttccaccttgtcagactctgtgagtcctacaggctgctgcaggcaccagaccacactagctagtagatcaagtggctggtagggaggcatcgttggacacttccatcaccagcagaaatcagaaagggttagctgtccctaaccacttgtgtctgagtgtactttgttaagccagtgcgcaacctgcgtgctgttcttgaaagggaggtgttggttagattacatccgaaaggggtcagggaaggagaggctgtttatcacttagtagtctttcagatttaaccctatattaaagcaagaacttcgttctctgcacatgcatctcatataatactagacaatactatagaagctggaaatacaaacccactctgaataattttaatgtaactattaataactttgtcaccaaaaatgaacattttgaggcaaatgttaaactgatcaagagatctgtgaaatcaagattatcccaggcaaacctgagcatatgactccctgtctccatccaggtcaccattcctgcacagaggatgggatagaaaggaaagctgggtgagggggatgggcagcaaatggaaattaacaaacaaaatacggggacttaggtcatcaatggaatagaagaaattgagttgggctcctgtgatttaaggagagaggtcacagaatagttaccatgttatcaaacgcaggcaattgaaaggccccaacatcaagttcatctctaaattaacctgtctttctgacaccacagagcagactcctcttacattttatagatagattcagacatgtacctcagaggtgccaacaaggacatctcttctgcccaagcatttgtcctcaaagagcagaatgtttatagacatctcaatgttaacacaatttaccactttgaaagcaccaaatgtttggctattatttgattatcatcctgattccaaaaacctcttgtgaaatttttgatcagtttctttttattattaacatgtatgtatatatgtatgtatgtggagacagggtctcaccatcttgttcatgctggtctcgaacgcctgggctcaagggatccttctgcctcagcctcccaaagcgctgggattccaagcatgagctactgcaccaggccattcatcaggttctgttagtcttcagtgtcataaacttcttccttagttcccaatcacttacagtagatttctgcacaccctcaggcctgaagtgatgagtttcattagagttgcagaacattagaatacctttactttcagccaaaataaaacctatattttactgatcctggtatcatggtgtacattttaggttagaccacgcataatatatatcaaatttgtgggtggttaccactacaatgaatatctccctgtaataaaagtgtttctgggctccagccaagagcccactttatgaagtcacatttgataaggataaattccagttcagtgaacaagattacggtttgtcataaagagatttatgtatatcatttaagtagttttaatctgtattctttttgtggttctgatctaatggtttatgttttgagcttctaccagaagcctggatctaccaaaagtttttaagttggatgttatgaaatggtgagaatatcagcaaatgtttggtaatacagatgaacatgcaggcattgaattattaaaatgaaactaagcttatatttgaatataattggtagtaattaacctgaccaagatggatatgagtaaatgctttatctctcagctttctaagagactaagtgaaaatacacaaaacaaatagattgacaatatatgttgttttgtttcttagctagatattatatgctattctgttaaactgtaaaccaatatgttacctctatttttatccaagtctattgaacaatattacatgtatattacacatatatttataatatatatgtatattatatatatacatattatattctgattaaatgtgaatatacatatataatatgtatacacatgtatattataaatatatgtgtaatatatgtatgtctatatattatatgtataattatatgaatatatttcaataatttatgaaatttcagtaagtgataaatcttgtgaagagttctgattaaatgcaaatggtggtcccagggatctcctacaattcagaagtcacccaaaggtcacatgagtgcagaatataaatgttctacattttctggtacagggatcacttccacttatgccctcaggtcctgctgctccaagacgtacagaaatgggagtctgctcctctgtttggagacccaagtagaatatcatcactggcttacctaaaaggacaaagaataggcccacctagtaatagctagtttggggtgacaaacctcaaattaaaggtgaggaagaaggattatatcctccacactgagctttataaaacttagggaaaataagaaaaaaaacaaaaatgtttttcaaaatctcacagaaaataatttaaaattgttcaaaataaataaaggagaaataaacatgtggaaacaagttaattggactggaggaagaggaggactcagagacagacaacctatatttgttttgcattatttccgaataaatacatacagtagttgctttttaatctcatattaacaaataccacagtaggaatagttcacaatcatggagctgtgtgataatcccttcccatgcagcaatttcctttgaccctcacaaatagccccaggatgtagatactatatctacccctatctcactgagctcagagagttctagaaaagtgccaaaaatcatcatgccaattagtggcagtaagaaaccttgtacgtgttcatattcacctctaattttttgtttcagtcttcagcgtggattcacaattagattacttcttttcacagcatgccttcaatttcttttctgcaattactgcacttagcaaaagactgtgtaggtagtgagtacttggcttgagtcttgattaactagacctaggcacacgaggatgaggttcatcctcgtgttcagagcacattagtacagaatgagcatactaggaagaagaaagagaatcactaaagcattttaaggaaaacagtgctgtaagtaaaaatcttcagcagggacgttgccttagtaatgcccaggaaatcctgtgagaaggagcatttcacaccagcaaaaagctactattcagacttcatggacaaaatgaatcattatgaggagtgtaacatcgaaggggagataaattgctagttgacatcatccaacaaaaagaaggataaacagccattttgagtcaattggtctctgaataagttaattatcttgagtatcatcctcactggaaatcagcctacatgtctacattactccttaattgtgaactttcatagatcagacttaaaaaacaaaaactgttatgaatagtcagtatttctaagtggctaccacaggcaaatcatcatacagaacaataaaataataattctgaagaatttgcaaatttaaggagatatatataatatagacacaatgaatatattaatatgcagtacttaaatatattcattaattttaataggcattttttctattagcaatgttcaattggaataaactttaatagtaacatagagaaagacatgatttattaaattctgaaaaggatttataagatgaaaatatatctgaaggatatgtcatgactaagtcatcaattgtaaatttcttagagatacagaatattatcattaaaaattcaataaagacagagaagagttaagttaatgtggcccagtcatggggctctttctgtttatctagcttgctaaagaaattattttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctaaagaaattatttttaaaaaaacttagaataatgattagaatttattttagaccatatttccaaatgaaagtggcctcaaccagagctttgtcaaactgaaattcaacatttaggtatctcaagacagcatggagtaaaatattctgcaggatttgttgaagacagagtcaccagctttaaatacattaaatgtcagtgttttgaggaggaaaagaaaaaattttcaaggtcagaatcccaactttcattcttacttaggggagggtcatctcatttctgctaaagataaactacagacatacctgtgagcagcaccaaaatatctcttaagaattaactttgcctttgttcaaatgttcaaacaatttaagctgagaccccaaatttctgcaccatatagtataaataaagctataatttcagtctacaaaaactgaaagacagttgttaaagtcagtgatttaagggggggaataaatctcaatattgctgataacttttattaaataagatgtgtccttttttggagataaggatacacagcatcaatgacgtttctcagataattgtgtgtgcatttattaatatttcactttagttatagatatttgttccttgaaggcaatccttacaccagcacatcatctctttttttctgaaactgaatttccattgtcttctctgatctggttgagaaactaagttaagttggaatcgtgaacactaggagggatgaagccatgatgacctttggcttcatcagtcttatgaagaatggtatagtacacagggttataaagccacattctggtctagtttccatctggccacaaaaagccctgtagtaatgggcaagtcacttaacctgtctgggtctcaacgtcctcataggcaaaatgacagagaaagagctaaatgagtattttgcaaaatatactacatacagtactaatggtatatcagctgatactggggcaaacattctgaatttttataattatgtatcctagtgtgtattatgagtaatacaacccacaaatcaaacccataaatgtatgcatgtctattatttagaacaagtaaaaaacagaaaatgtatttaaatttgattttattaaattattaagtaaataatttatagatgatacatggatatagtaaaaattctgaaggtggtatttgaagaactgaagattgggaaacacaaatgaatgatctctaaatccctctccatcaagaagagactatatttttaatgaaagaatgatgactgtcaaagctagagaattactttgtaaaccaaaatagatgatatcagattgccaatcagacacagcttttcaataaaatcctttgttcaaatgaaagcagactgaaatcattgactggctaacaatattgcagaatggcgtgatttcaaaagactctttaaatgaagaagagatgaaaacaaactcattttcccatgtaccttctttcctttcatgctgtctttcatgtcttcccaaaaaatgtgaatcccaaaacgcttcctgttgcccatgtgcccacaatgggctcttgtgctctcatctgagacagaggctgttccatcactgaaggatattttcttgcaatttctaaggacagaattacttattttggaatttatctgcaatttttttttgtggaacaaatttttgtgggaagaaaagtgaatgttttaaagggaaaggagtaaattactctgtcactgatttttctctgaattaagccactttttaaaaggcaaataaagaaaatttctatacacttaaacagtactccaaacacttctgtgtgaacatcttgaatatttgaaatcatgtaaaagaaagctctgactataaaaagagaaagcacaaaatagatagtgctctgtttgtgtactgcaggacaaaaaaataaatttgcttcatggaacataggagaacttacatagtatcatagctgccagttgtttgaagagattggcctataaggtccttcttaatgttagtattctatgttcctgattctaaagaactaagaggaaaatatttcatacaagtgaggaaaatggcataataaaaataacacattaaagaaaattaatagaaatatttcatttcatttctaaaatagaaaaacatattcctaaaatcagagaaagtagaaaaaaagcatattcctaagtcatcaggaagaaattggttcaattagaatgtttcaattgacaagacattcagattgtcaattgtcatggattcagatatgatgtctattatttatgatgctatttacgttagcagcttctgtgcggttggtgtgagttcctaaaaggtgtccatctgaggttctcctggaagtgcagaaagccatttctgcagcagaccaaaagaatcaacatatgtttagaacatttccatgtggcatgtcaaaatcagcatttccccaaccatctttcacatccaaaaacacaaacaggcatgcacacagtctaagctcccacatatagctttaaaagctctcattagaagaaagcaaattgtttacttctcttttgctaaaaaagctttcttaaatagctttttaaaaattcgattgtattaataaaacaccttaattggccaacttcaatgaaaatctttacatgtggagaactattaaagggtctcaacatagagggttggagtggttgggagccatagaaaaggttcctatcttattatttaaatatcctagagaagaaaaacaaaagactatggatgatttttctcccctttcatttggaagtcatttgtagactttcctttgttccattgagaaataagagaaaaaaatatataagttacagcgaacccatatggccagcaggaaaatcctatttaattgctttattgcaagaaatgttaaatcacttcctgaggatgcagttcaaatgaaacatatggcaactattagcaaaagcccctaatggattcaaaaatatgccttttattggagctttctcataagcatcaattatacatgttatttaaattgtatattcaaataggcattcggtgttttagttccaaaaatgttgatgaacacctactctgtaccatactatacagtcagcttgtgtgaaatgttatttctgagcccagaaatagatatgacatgatgggacctcaggacatggacccaaatctatccaggtcccttctcagaaaccaaggatgagaagaatcccccaatcaatgcctcctgcccaagggtttcacgcccaagaaaaccattccatttctacttggatagttctaatgatctatattcttcgcactctttttaatgacacaccagtgatgtgactaatcattcgtgttcagcatccattctttgccttttttggaacttctttgattacattgtgaattccacaaagaagaaaactttgctaagagtttttttatctaggataatgtgaggcatgtaattaagaattaacaatccgctttaactaacggtagagcaagtgtcagcatttttcaattgtttctaatgccattcatctctggaaaatttcagaaatttaacaatgtaatatatttattcataaacaactttctagagagacagttctccctcaaattcaaagataaatcattggaggaatatccacctgttatcactatgtggttttactcttaaaaagaagttataaaattctaggaatactacactttgactatcctttctctacattgtaatatggtctttgaagttatgtaatggaagtgagttttggtagcttaaaagtcatgcagagtgtggtgacattctaacgtaattggcattggctacatgaaatatggacattggccataaggaggctaaaatgtatttttgcttgataccccaactcactgattatcatttttattaaatatttaattacacatgcatggttatatacttttgaaatcaaataaaatatagaaaaggcttgtttttgtcactggtcaacttgtgatttggggcaaagctttcaacttgacttaaatgtgtttgccatgaaaagagagggcttctttagacaatgcctaaatgtctcatacaaaatattcctatagaggtattttgtgttctaagtaaatgtcttatcataagaccaatccaaacttttttcctccttcatttcaaaataagtctgtttagtgtggctcacaggccagcatgcctgtattgtgccttgcttccgttagtgacagcatgacctcacaaaagttactttaccttccaggattttacagggtgttctaaagatgtggtgaatttctgcagtcaaaagcttaaaactgggtcatacacaaactaagcacccagtaagcactagctatttttatcctgaggaactttctccaggaacattctttaattacctgtcaccaacttttccagtcttgttgaaaaaagaaaggtttctgttttatttttctgttcgttcacttttcacaaaagagcgaatgtattttaaaacccccaatcaggggtaaatttaggggctagacttaacatttaatacatagtttggatttaattctatttttaaatatgttttaagggacacatagaaagtaaacaaacattaccaaaactgtaggatcacttgtaaaagaaggaaattgctttcctctagtattgaatcagagaagttcttgaagaagaagaaaagtcagatgacttcttaacaaatgaaagaatgcccaggaaatgctggcagcctatgccatttgttggaagccctgatctctgggcctgatcccccaagctgccatttaatctatacgtctgcatctttggaagcatgcggagaaacggttcacacccagagaacagtgctgaacaacgaaatgtagattgagattgagtcaaaatatgctttcagtacaaattaatcttgccaaagtaactccccccatctctacctttttttttttttttttttttttttgacagagtctctctctgtcaccctggatggagtgcaatggtgtggtctcggctcactgcaacttctatctcccgggttcaagaggttctcctgcctcagcctcctgagtagctgggattacgggcacctgccactatgcccggctaatttttgtatttttagtagaggcggggtttcaccatgctagtcaggctggtctcgatctcctgacctcaggtgatccacccgcctcggcctcccaaagtgctgggattacaggggtgagccacggtgcccagcctctactttttatccataaggaaatctttaccttagctgaattattgcatcaatcacaaaatcccctaaatcccaaaggtgaagatctcagcagtaaccaatatttcacaaggatatagacgtcttgatatttgctatttctcgaaatgaagattgatgctcttttcttgggctgatccacaacagagctgcacttgggcctctctctctctctctctcacacacacacacacacacacacacaaacacacacacacacaaatacccatttgagtgtgcttttcttacttcaactctgaggatgttgtccctgaagaaatgaagaaatatcacctttggatctatcctgtggtcagtgattatggggtggaaggcatcaaatcccaatgggtcagttaatacatcctcaactatattttatacgtgagtaactgagatgaatgagaaccagaaagtcaacttgcttcatttgtttagtggtatccacaaacagtagaactagacagttaagctttaagttcttggaaagatctcattctgaaccctatttttaaaaatcataacagtgataaatgctggggattgagcttctaaatctttcacatcagtcaactaacccactggaccaaggcccattttaataaatagtaagagtggcttttccctgaagatctggtacgctttatagaggctgcttcctttagttctttcagcaatcctctgaagtagatgtgattatctagatgcgattaataaagaaggaacctgagccttgagaggtaagatacctcacttgtgtgcacagaaaaaataagcaacagggaagagatttgaaatgcccagaaactaacgaatttgcttctctctcccaaaaataggaccagaaaatgttaactacaaaaattctaccccaattcaaagtgtttttagattcatttattgccaatgttgttagtttgtttgtttgcgatggggtctgactgtgttgcccaggctggagtctgtagcacgatcatagctcactgcagctttgatctccctgggctcaggtgattctcctacctcagccttccaagtagctgggactaccggtgcatgccaccatgcccagccaatttttgtattttttgtagagatggggtttcaccatgttgtcctggctggtctcaaactcctgggctcaacgatccgcctgtctctgcctcccaaagttctgggattacaggtgtgaaccaccacacccagcctattgccagtgttaaagataatatggatgtgcattcatttgagtctgtcttcagaaaagaaaagaattagaagatgatttacagttatcaaagacagctctagtgattttactgatagttccaaaatgctaatttttctattggcattctctatttaatttttgcgtcattaattacacttcgttttatttctaatgatgctttctgatgtttcttcctaataataccacaatttttgtgtcttttttttcaggctattcaaggtatttcagagaaggaaaaggctggtaagttgacattttggttctgttttctcgccaatctattttagaataaatttcaccttaaaataggcattttattaaatatataaaatgtatacatctcatgaatatatgggaaaatgttgtttaaattctgtaaaagaaatttgttttgctcaatatgtaagaaaaatatacgtggttttctgacataatgacattgtgttagaataagatatgtgtttcttggggtcttccttgtaactgcaaccacaatttttttttcttaagcaaaagaattaaatgttgatcaaggttctggggaatgaatttggaaattagttattaataattaccaaggtttatttttactcttaatgacttagtagccacagaaaaagatgtaattgatgcttaaagctgatgccatactatcaaaaatatagtgatgaagcaatgtgaataattgtattgaagaaaaaaattatagtatttttctgtgttctgtgctttaattataattatttaacagtattatgggaaatggacaaggactgatgagaaatgaaaatatgaaaaattagacatggattggtagatctatgtgtttttaaaaaatcatactatcttatgtgttctgtgtaataaaaacgaaaacagattaaaggtatattatctaacttgaagtacatcacttagtttgtagacatttgtgatttttaagagctatattaaaagtttatagtctcaccttagagaaaatattaaaatttcaagtgcctttacactaaagcagtagagtttgtctggcgggggtgtttgctgtctatgtcagtgaccttatttttgctgctagatagtttttacacagaattttcctagtttgtgtccttctgtgagctaaacttttctctcatgtttaggctgtatctcgtttcttcactttaataatgttgaaaagtatctcttcagaatagaaggaaaatattgaactggcatcatatgtcagctcaagagaaaaatcacacaacataacaatgtactaatatcataagcattaatatcaggttggtgcaaaagtaattgtggttttggccattactttcaatggccaaactgcaattatttttgcatcaatatatttaccatatattgaatggatttaaagttttaaatctccagtatcttacatagctgtccccataattcactgcaatttaaacaaagtatataacagaacaaagttgtcatcctattccagaatgtcagcaagttttttcacaccccaagaagaaaatgaggatgtgagttgttggctggtcaggaggggaaagaaggaatggaaatgccatggctggcggagacaggaaggcagagagttctctttctcctcttccagttaaatggcttaagtttggcagggagaaacacttcattctgtcaagcttctcaaatattttgaaaatatttttatttttaatatttttttttgagatggagtctcactctgttgcccaggctggagcacagtggtgtgatcttggctcactgcaacctccacctcccagattcaagccattctcctgcctcagcctcctgagtagctgggattacatgcctgcgccaccacaccaggctaactttcgtatttttagtagagatggggtttcgccatgttggccaggctagtctcaaactcctgagctcaggtgatccgcccgcctcggcctcccaaagtgctgggattacaggtgtgagcacctggcatgaaaatatttttaaaacaaagaactaattagagaacataaatataatgtaaccactacctttttgtcataatcctggaaattttcctccttaagaacaacaatttttttaatgaaatcaactgtccctccttacataatctttctgagtcatttctatatggctgaggcacacataaaagaatcgagagattaaattttcagaggttccataagatgacatatgtgatctccacaggccccaggatgccccatctcagatacctagcaactcaggatggactgatttgagcaaaatctgacttctgctctttatgaaaatattagaatgattggaatttactccagaatgaatttctatttagatttctggaggatatgctgatatatttaggagaaaatgtaatttcatttgatcatttaagaaataaaggattttttttcaaggcagtgaatttacctgtcaagacaaatgttcgtgtctgaatattttatgaatcacggtaacaaatatgacaattcaaaagagaatgtgatttatttcaaaagttttaagtaccataacagtctaagcaatctaattcttgtatttctaaactttattatttgaaacattaaaaatattttgagtgttctatatacaaatataaatcttgtttctttcatgtctttatgaatctctgtaagcttccgctagacagaggaatggccatgaaggcaggagacccactcaatcttctcggggttaattgagctcttaaataggattaagcttcatacccgcccctaaggcctgtcattttttttttttttttgtatctttctaaatcaatgtagcctattgttctttattaagaaagtctatttttaatctgtgtgacctctcatccaagctaactggaaccaactctaccaggctttgtgaagctctaaatgaaatcatttggggcacattccattaatcatccttcaattacagttgtgtgattgctctgtgtgtgctgtaagtagctatcttctattctgatccacgttgctatgataatacagctcagtgggatcatttctgctgcttgtctcctgccctgtgatgacagaaatcttcaaagggaggcaagtttgaaacagcctttgaaacagccttttatggattcagtcatttcacaaatacttactgaacagcagcatgttctaggcattctattaggttctactgaggaagcagttatgaacaaggcatggcctctgccccataggaactcaaactctagttggaggatatcccatcaggcaggcatccctccttctcctcttctcaattgagaatttcttaactctgcttattcaaaaagcttcccaggcaaggaatcaaatcaaagtactgtcttcaggaaactctggatgagaatgtgccttcttaggatctgagacagaatccaaccaacttcttttttaaataatcagaactgatcacacaagtatcgatatgtataattgtatccaataaatatcattttcatataacttccatcatgtcgctggagtctgtatgcctcaacctttttggcaccaggaaccagtttcatggaaaacaatttttccacggagttgggtaggggagggtttcaggatgaaattgttccacctcagacctcagatcatcataaggagtgcactgcctagaaccctcacatgtgcagttcacaacagggttcatgcttctctgagaatctaatgctgccgctgatctcacaagagccagagctcagacggtaatgttcgcttgcccaccgcccatctcctgctgtgcagcctggttcctaacagatcacagaccggtactggtccagggcttgggggttggggatccctgctctaaagagtgaacccgtcccattggaataccctcaagcacatctgcttcctatctgtatggccttgagcaagtcacttaacttcctcatctccctcatttccagaacacaaatcaagaatctgccatgttgttgatgtaaggcaacaatgcttggtacaaactaagtcccaaaaaatggtagctgtcttttatgataattggttggtgcttacaggacaaatggacactcgctgcatcactgatgtccttgtgtgttccacaagtcctaaaatgcttcctcgtggtactaacagctgaacagctgtccatgtggaagaagaaagatcactttctccatgattcttctcaatgaattaattcaaagattgtcacaatatagacagaggtgatcacattttaacctccctttagagatttttttttttttgtctattagactgaaattctctcttggaaacaggtaacatttgattttcaaaaaaatattagtttcagagaaatgtttatgctgtgtcccattttcccgtgattccattatcctcctgtatccacagtccctgaggtcatcagatcctatctaccaagcaagccagctaggcgcctgggttctcctgccgctcccaggctcctccaccttctacacaccgtgctgtcagcaccgccctctcatcacccttgtccattcctctggccactgcttccatgcaggccttcactttccactggactttcacaaaagcatccagaactggtttccctgacttaaccaatcattacaccagtctattatctgcactgtcaccagagttatctttgaaaatatataacctgatcatgtcagttcctgtgccaacattttatctgactctctattagccacagagtaaaattaaactgtcctggctggccatttgtccattcaggagtgacctgtccatacatggccatttgttattcagacgcagtatcattcactggaccggatacatgtctgtgttgcccctcagatccaccctctgccctacttctccctgcctctgtgccctgggaggccgaccaatgtgaactaaatcaaaggacttccctcctttctgtcttcctcattcagccacgaagaggacgagaagctctagcaggagactgggggagggggatggtgggacaatgaggttggagagtttgtttttaagttcaatgtagatttactttattttatgatgttctgcgatacatgtgcaggatgtgcaaatttgttacgtaggtaaacgtgtgtcatggtggtttgctgcacctatcaacccatcacctaagtattaagcctagcatccattatctcttttctctaatgttctccccacaccatcctccccaaaaaaggcccagtgactgttgttccctccctgtgtccatgtgttctcattgttcagctcctacttataagtgagaatatgaggggtttggttttctgttcctgctttagtttgctgaagatgatggctttcagcttcatccatgtccctgcaaagaacgtgatctccttcctttttttggctgcgttgtattccatggtgtatatgtaccacattttctttatccagcctatcactgatgggcatttgggttgattccatgtctttgctattgtgaatagtgctgcaatgaacatatgtgtgcatgtatctttataatagaatgatttatactcctttgaatatatacccagtaatgcgattgctgactcagtggcatttctggttcaaaatctctgaggaatcgccactgtgtcttctccagcttctgggagtcactgttgacttctcttacttaggctgccatttgcactaagcttccaaattgtgacagcaattctctcctctggccctggggtttcccattataaatggtcctgttattaaactcccctcaatgtgcctaacgtgcatttgtttcccgcaaggagcctcactgatatacttctgatattttctattttttctatttcttcattttgtttgttggttgctcaaactttaactaccatagaatccctcgtagctctctgctttcatcttctgcctaggtctgtggcatgcaactggcaccagatgataggcggagatagagagaggcaaagtgaaagatggcttaaccagaaaaaaaaaaaaaaaaaaagatgaggagcttttttttttttctttttttgggaaggagttttgctcttattgcccaggctggagtgcaatgacacggtctcgactcactgcaacctccaactcctgggttcatgcaattctcctgcctcagcctcccaagtagctgggattacaggcacccaccaccacacctggctaattttttttttatatttttagtagagatggggtttcactatgttggctgggctggtcttgaacacctggcctcaagggatccacccgccttggcctcccaaagtgctgggattacaggcatgagccaccccacccatccacattttttttttttcaaagtaaatgaaaatagtttcatttaatcccatggagaagaaatatactagccttatgacttataatgtgttctctcttggaaaagtaacactgcattttagtcactaaaatatcactttgagaatatttgagaactattaatatggagtaacatgaaatccgtcattctaaaattaaatcaaagaacacttcacaaattttgtcaggctacatagcagcccatgcaaaacaaagcattatcattagccaaaaatggcttaaaaaaatagtttcaactttttttttattcagggggtacaagtgcagatttgttgcatgggtatattgcttgatgcagatgtttggggtccagctttccccgtcactcaagtagtgagcatagtgcctaacaggttatttttatcccctgtcttgaaaatcctacttgcttcattggatccaacaataatatcacttctttaatgacttatttcccaggcagaactaatcttagagcttattctgtgctcctaaaaagctacgtcttttctgttacagttttattatcttgcttagctgtgtgtcttctctagatcatgaacttttctaggttaagaatattgtctttgtgtgtcctgcaattaaaatagctattaaaatatagatgttctgtaaaacaggtgttaatcaagaaattgtaattataaaaatgctctggctataatcttactgacttagagttaacacgattctaaagctttttatttaaccttctccattactcctactactcaacccaacggccaaatatgtcagccaggtcatgaattaatggtactatttggggatctgtgccacagaaacgtgtaaagggggccattgaagaagatgacttagagcctgactttggttgctttccttggtcatttttctcagaatgtttattctcctgcctggagcttatttggttggccataaaatgttaaaaatcaagataatgaataattatagcctgaaattcttgtgaaggatagctttcagaagcatataccagagtcacggtctctccaaactttgtgttgtggtcataagacagaaaatagaaatgaaacacttctttgtgacaaatgcgtaagggaaaaatcagaattttcataattttattccaagctccttgtaaacatactaaataacaaagcccagacttgatgcattttggtattaattttcttggctgcttttcatccctgagaaaggaaatgcaaatgaataacaacaacaacaacaacaaaaaaaaactaaaatggaaagacacttccactgttcccagtctgatcatcattgcttggatccagagaatgattaatgtgatatatccactctgagccacgctccaagatatgcaaatccaaagagatttgctgaaaaaattaaaacaggactgctctatttcagacttctctttggaaagactctgctctgttttgtgtcttcattttagtatggatctgattggttttattgctgtctctcccactaggctgtgaacaccttaaaaacataattttgtttcattcagcgcagtactcccaatgcctggtattattgtaaaaatcagcaaatgttttgctctatttgcatgacattcccaaagccaaatgtagagtcttatctttctattctaaaggaagctcttcttgtaacagcaaagacccccagctgttttatggggtttagcaagacgtgaaaattttctttatctagccagcctgggccttgaccaacattccaaattatttattctctttcattctcagaaagtgaatttcattatttttacactaatggcttataaatacttgcttcagttttttttttttttaatgtatgaaggcctctgcttgcctgcttctttatgaggaaagaatttagggtatgcccacacataacttctcagtgtttctaaaacttaatgtaaactaatccgtgaaaagttggctgtggttgactgggctgttgaaagaaaacacattagctttcaggtatcaaggaattcatgaaaaatataagtaatctattcttcaatgccaaagatcttgaactcacaggatttttaaaatacagataattttccaaatatttcttcattttctgttggtatttttgctattgctaattaggtgagacaaatctactgtattaccagaaccaatagaacatagtttcttttcctctcaattatattttaagcaacacacgtagatgacaatttctcttttaatatgttctgattcaaatgtttcctcccacatttgaagtggtcttcccaggtctctgcagctgaaagtggcactttgttggtatatttattatggcatttcatgttttctgtgatgtatttctgttcttgaattttatgctatatcaggctaagagctccttgaaagcagaaacctcccatttcgttttttgtcaccccgcatgccatgtgatatcttgcacagagtaggtgctcaagaaatagttttgaatcaatctgtttatttggtagatgaaacaactcatacagacattcagctaatctcaggtctatccatgtccaggacttttcataatatttgatggacttttatttctccttctaaaatgacttatgcacattttgctcctcccattatttcttggaaagaatggctatcagcagcatgaagaggtggctgtgaactgccagtatgggccaataagacagctttgcatttcagtgcttgcaatgccattgacctcttatcagtagaaaaattaatatgttattttcaatcttctcagaagaaagacaatttatgaaagggcccttttgtatccattttatcaagaaagccactaaagatcttccatttagttcaaaatctggctgggcatggtggctcacgactgtaattacagcactttgggaggccgaggtgagcgaatcacttgaggccaagagctcgagaccagcctggccaacatggtgtaactctgtctctactaaaaatacaaaaattagctgggcgtggtggtgcatgcctatgatcccagctactcgggaggctgaggcatgagaattgcttgaacctgggaggtgatggagggtgcagtgagccaagatcgccctactgcactccagcctgggcaatagaatgagactctgtctccaaaaaaaaaaaaaaaaaaaaaaaaaaacaaagaatcttatctgatcatctcttagatgtcttcaaatttttacctcttttgagtttccagtgcacagtttgcagtttaattttattaataatgtgaatatatacacaaatacgtacccacaagaaaagtgttgattgatcctagtttctttggagaggtatgtttactttggaaagttacatgtaacaagctattactttgacctcactgagtataaaacgacttataattctgctggcatgactatacttctcgtattgaccctccattggcttgaagcactttgatttgttttctgcagggaagttcaaaatctctttcaatggattccatagacatttctattatagaattaagacataattttttagatgtgttttatcaaagtaggaaaccttaaagagttattaacaaccataacaaattcaccagtgcccaataaatggctggtgcccatcttcttgtctgcaggctgtgcagaaatctaatctaatgcaggagaagtgtggatcatggatttaagaaactattttgtcctgactactgtaatgaggtagaaaagttctcacagagttcttaaatttctacttaactaaaatactcactaaagagtgctgatgcacacatagtagggtattatatttgtttttaaaatttcccaaccacgtttctgtgactcacacctgctaatgttataaacttcttgttaatgtaaacgttaaatcagttcttttctatggatttaaggaaatagataagtggggaaaataacagcacagttcatcactttttaaaattccccctttctctttaagtctgtgatcctcttggatatatttatctcaaaattttccccactgagctgtggtttcctaaaaggcagacatcttccccgcaccttggtaatgccagcctcttaacagatgtttcggttgaagtttgtggaatgaataactgaattggtaataataacaagaatttactctgtgcctgcacttttccaagcactttatagacataaactcaattaatcccctagcgaccctatgaggtaggtgctattgttatctacattatacagttgaagaacctgagactcagagaggctccctaagatacccaaagtcacactgtggccaaatcaggattcaaagccagcaatgcagacaacggtgcatgctcttagccgctatgctatatgtagtggttaaatgccaagacttctcaggctgatgaataaattttttccgtaatctggccttacccttccttttcaccctaattttccatcctcttctagcacgcaccttcctctgtagtcatggtaacaacctcacttttctcctgaagttgcttctgcataacttgacctttgctcctcctgtttcccttccagaaattatctaccctaacccccaatgactcatttgtgtcctggcttcccggtgaaggtgaagtcttctatgataactcctgctcacattaatttcatgctttccgaaatgatataactatagcacatcaagtctgaactggtcgtttttgtacttgatcattgatggactgtcattgtcttctgagcgttccatttatctcagcaatgctttccaacagcttttaacaatcttttaaaacatgatgtagcacagtacggtgcacctaaaagatgcttatttcatgaataattaggcttcagttttagagcaattttaagttcacagcaaaactaaccagaaagtatagttcaaactgtatgatattctgatgaagccaaactatggaaacagtcaaaagatcattggtggtcagtggtttgcggagacagaggaatgaatgggcagagcacagggggttttccgcatagtgaaactattcagtatgacactataatattaatagtacagtattggttctactccacaaaaccttgctagaactaggtatatcctgagtgttcgataaaattataatttttcacaacattaccctttttggctacagaactatattattttctaattccgttggtatttttactattgctaattagatgagacaaatctactgtattaccagaaccaatagaacatagttcttttcctctcaattatattttaagcaacacacgtagatgacaatttctcttttaatatgttctgattcaaatgtttcctcccacatttgaagtggtcttcccaggtctctgcagctgaaagtggcactttgttggtatatttattatggcatttcatgttttctgtgatgtatttctgttcttgaattttatgctatatcaggctaagagctccttgaaagcagaaacctcccgtttcgttttttgtcaccccgcatgccatgtgatatcttgcacagaggaggtgctcaagaaatagttttgaatcaatctgtttatttggcagatgaaacaactcatacaggcattcagctaatctcaggtctatccatgtccaggacttttcacaatatttgatgaacttttaatttctccttcttccaccagagaacatcttccaccccgtctctttcagcctcactcttataaatcagtgccatcgtagcttacatctttaagattcatgggttttctttttcctcttgactaaataaattatctctttttataaccatttaatttatcctgaacatgccatttggctattaattcatttttaattaatttattgttttagagacaggttcacgctctgttgcccaagctggaatgcagtagtgcaatcatgtctcatggcagcctggaactcctgggcttaagcaatcttcccgcctcagcctccccagtaagtgggactacacgcatgcaccaccatgaccaactaatttttaaaaatgttttttaacatagaggcaggatctcaccatgttgcccaggctggtctcaaactcctggctccaagagatcctcccacctcagcctctcaaagtgctggggttacaggtgtaagacaccatgactggcctgcaatttggtttttaatttgcattataatttgtttggatcacatgctgctgctcctaactatttgatattttcaatagactatattcacatcccctcatgtttaaataaacatttatttaaaaaagcatataaaaacaaaaaaatgagtgacacaattgatgcattttttaaaaatgaagactcttaaagagaaaaaaatgtcagaattctgttagacttaacttgaattctatcacttagcatttttctatttaaaaaaatacacttgtacgtaggacgtggggagcatgtctgtgtttttttttaaagtattatttctaaggcctctgatggctgcaccccaactgcaatgatgaacacaatagcgtccatctatacaaaacaaagatcagccaggttacccaaagggggacattaaggccttcttcttttatgactttaggaaagtggagagctggcttattatatccagaaaacattattttgtaatattttcgaacaccaaaatttggggccttaaaaaagagtgacctgggtctaacttgtgaccttgactctgagatggtactcatcgttccacagctaatcaggagccgttctcccagatggtccatgacaatagaatataaacagagcagtgaccgctcatccccacatgtagggagtggcctggactttctacgatgtggacaagaggactgtggggtggagacacattcaaaatgtctttccaaaaggagatactccaacactcatacaaactccttcaggcattccaacagcattcccatttataatggaagccaactttttaaaaaaagaaaacaaaacaaaacaaaaaaactgcagatcacaaatatcaagacattttcctgaagaaaagaaaatgtaaaatttcagcaaagtcagtttcgttagattacagacagaagatagaaaaaaaaaaaaaagaaaacattgcattttttgtttgtctgtttcctggtagaatctgagcgaggcaaaataacagcactaatgtgtagaaagaattccacatctggaaaacctttgcttcgtctatggtagcttttcagcctcttgctctgtctctattatttcccatgacttcagcttaccttgcttttgttttctttagtgaaattatttaacccttaggggtttcaggcttggtctggtttggttggtttggtttctagggaaagagaatactacataatatttttgtgattttctagaatttaccttatttatatttattactgtctatgtcacttacatttactttatttatatttattactgtccatgtcactatagtatgtacttactatactatataagtgacatggacataatgcatataaatatctgatcacttctatgaatttatattttagaaatactttaagtggacagggtttgattttcattttaatagctctgatattggtctttctcttcccattcaagagttttattttgttcatctcaaataatagaagttaatatcatggagcagacagaaataaatttacatattagtatcacagtactcactgaaatcatatataattaacaaaaaatatttactatccaaacatgatttcactgaattctctattataagccttaagtaagttacatggcattgatatttcagttttcttttcctctgtctttacaccttctcttgggaatctcacccaactaaagatatgtctgcacatggccaggcgcagtggctcatgcctgtaatcccagcactttgggaggctgaggcgggcagatcacttgaggccaggagttcaagaccagcctggcccacatggtgaaaccctgtctctactaaaaatacaaaaaattagccaggcgtggtggcacatacttgtaatcgcagctaattgggaggctgaggctggagaatccttgaacccgggaggcagaggttgcagggagccaagatcgcgccattgcactccagcctgggcagtgagaatgaaactccatctcaaagaaaaacaagatatgtctgcacagtctccagctctggccactctaccaagctacgcatctcattccagttgccccctagtgccatcacaggaatgctcacattctccacaacccgcactttcctcctcagtgtttctgctaatattgttaccttttcctgaaatttccttttatatcatctccagatgtccatatttactttgtctttgaagatttccaggatatccactattcagcaattggcacttttcccccaaacactccagtactctatccgaacttcttataaggctggcatccttttatactctttattattattattaagacatttttcccctactatataataaaaaccacatgtgaattatctttgcatttcttgaacataaaggacactcaataatttttttcaaaaattaagaaattgaaagaaagggaaatggcatttttaattaagaaaaaaggcatatcctttaatgcactgtttgctaaagtgtgccccataattttctagaatacttgttcaaaaattcagattcctggatgcctccaggcctgctgaaccaaaatctcctaggcttagtaaccataaatattaacatactctccagggacttgttatgaacactaagtttgaagaccactggttaatatcagtggaaatttcacatctattattcttcctctacatgcatttcatttcatttggtacttcaaagtgtgtacggcaaaacaacatcttaaggcttaagacagattatcatggcactcgatgactaccaaaaagtcacattttattataaatataaccaaaactatttttgaatatgtattattgccataaaatgcactaagctcataaaactattgaagacactacctgtacagaacttagagtcaaggtaaaagaaaagacacaaaaatataaagtgtattgaacaagcaaaatactaaaagataccctaagtgtcatatggttgcacatatttgccattagccaacctactcattatcctgtctcccaaggacaacaaccttttaaggtaattaaaataattccatatgcagacatggcagggagacaaaaagagaatggggctgtacaatgagaagctgggtgtcacgccactcacattcaataagtagatgtttattggaacaaggttcttattttatttacaaaattctctagcgttgtatacccccttctcctccccagggctaaattttattcacatcttggaatagcctagcaggtgttaccaagcacccacataaaaggaatttttgtctggtcacagtggcttatgcctgtaatcccaacaatttggaaggccaaggcaggaggattgcttgaggccaggagttcaaagccagcctgggcaacatagtgagagcttgcctctacaaaaaaaaatttgaacaattagctgggcatggtgacacctgtctataatcccagctactcaggtggctgaggtaggaggatcacttgaggccatgagttttatacctgcctgggcaaaatagagagactccaactctatgaaaaaaaaattaatttaaccaggtgcaaaggcacacccctgtagtcctagctactctggaggctgaggcaggaagatagcttgaactcaggagttggagctatgatcacaccactgcatgccagcctgggtgacagaacaaaacaatgtctctaaataataataataataataaaaggaattctaactctatgagatggagggtatttgggggtgaaggaattatagagcactgtggagtggtagccctgggaagccagatggcatgagcaccgaatgccttaggaaaaaggaacaggtcacaggagtgaagttggtcacagaatgaaagtggagaatggtgtcacacacagagcacctaatatgcgattttgtaattcctaaaaatggcccaagtaacactgcaaaaatcactgccatataaaaggccatatataaattgccacataaaaactgatataaactttggttaagtccacaacctttagcttcccctaagtggaacctatgatccctaagctgggttgatgcaagtcctcccaaatgtcagcccacacaagtctcttccctacccacttcttacttcttctttcctcccctagaaagttgcaggccagcaataaagggggaaaggggcaggaactagtgacgttgataggggccgcctctcctgttgagttgtctcaggatctccttattctagaccttgatggcacatcctttgaggatgctgatagcctgctgagcaagataagcagtaacagctaagtggtaagatactcaagagtttctggacatttagctgaggagggaaagaaagcattgaaatactggaaaggaagatctgaggcatttctaggcaaggaaaatactgttggcaaaattagaagactgggaaatgcatgaggcacagtgatgcaattgagcagcccagccagctggaggctagagtttgagtttagaaggagagaagagtggaaaaatggtatgggtccagactccaacagccctcaaagagtgattataatttttacaaggaatactaattcttattaatccgttacattgccccatctgcagagatctagacatccttattcttagttctgtattaaaggaaaacaaaaacaattatttttaaatgatacactataataccagaaactctttagataacaactgtgatcactattgacaacaaacttttaataagtatacatttcatgggatttagtggctaggttagaaaaaaagtcaaaatattttgaagtaggcttttggttttgctgatacacttctaaaaactgagctctgatttattataattcaaccattgctcatgataatacataacaagtgacacaatctttataaagataacgtatgaatttaaagaactaagaaaatagctgtttctaaagatctccaattttccaactgatttctgagcaaatattctcctaagaaattctatttcctaaaaaaaaaaagctagataaaaggaaaatctaccttataataattatattttacacttaattggcaaaattgcctgttttatttcctttctccatgtatcctttctttatctttgaatatttcacttttcgacattcttgcatcatcggcgatctagtcttggtgccagatgtgaaccactcaatgtgcacaaaattccaaaggcaaaaatacctctgttcccttgggaggtttattttacaatttccaattgaaatgttaacgatgtttactactgctgcttttccatgtatataacaaataatgagagatgtacaaataccaacaagggtttaattcagaggctgatttttaaacttcacaaaacagtagccttttctctccatctagagctactcttatactttatacttatacttcagagcagggttttccaaactatttatggtgattgatttctttaacccgtactgttttaaaatataatgaaaataaagtattagaaaaataaaattggaaaagaaaacaaaatagaagccaaagatttttttatcgttagattcaacaaacataaaattaagaattttctgattgcttactttccatttctgtcctcatctctgaccatctgtctagaccctgacgagccatacattgaattggccacactttgattagtttcagaggccagaaagcccaagccagtaagaagtgggagggaaagttagagtcagagtttcccagctgtttagttgaagagattaggaaatcaatgaaggcctcaggtttctttgattcccaccacatttcttaaatttattaacgagagtctcccaacacatatacacacaaaagaatctgtacaaaagaagcatttgctaaaaatctccatggcctttcaccatccgcatttgtgcttcagtctctagagtgctcaaccttcacctcagatcccctctttcccttgaagtttgcagactgtcatctcctgtacagtttcaagtcatgcaaacacatcatgaggttccatctcctacaattctatttttccttttatcaaaggctttctttttttccttcttctcctcacttgtctttctttagcatttttatgccaatcaaaagagtaagagtttcacttttttcatgtgtttttttttttttctattttttttcctatttcaaaatagttaagaaaaggtttttggctatcagagagactgtgaaaatttacattcttttgctgctaatattagcaaaatgcctgttcactttaataagtattttttcaggttgcattctgtgccttgaaaaggaatatatatccatacaaacagcatattctcatataataatgtgatacaatagaaacatcattattgagttgacatgtttttatacttttataatgaatgaactgatactaataatgattccatataaagtgaccctttcatgaaaccattaaaatacattttatcattgacatttaaacctatttattgtaataaaatttaatccacttaacacaacactgggtatgtcatttcgatatacatattctccaagccagtgatcattccttaaacagcaatttttttctctggtggtagaaaaaccacctcctctccacctccctgtgaagtcatacatctaattttcagagattgaggattctgatggtttgctttggttagagaatttttcctgatatcagattttgaacactgagcttctttgacccaattctatcacttctatatgttctgtgaaatcttattcataaatccattgatttttcaattggattgtttctattttgctctttgatttacagaagtgctttatttattacagataataacactgtattgcatatttattgtgcaaatatttccccggtttatcactttgcttttcatcatcacatctaaaaattctctcatgtaccaagtagttaatctcatcccacattcaccccattcccagcctctggcaagcactgagctgatctctgccactacagctttgacttttgtagaattatctctaagtggaaaaaggcgtttgtacaaagatatatttttatatatctttagtaattcctaggagtggaattcattggtagggtacgtttaactttataagaaacttccaaactgtttccaaatggcttaaaccattttacattcccaccagcaatatgtaagtatcccagttgctccacattctctccaacacttagtatggtcagtctttttaattttagtatgtgatggtatctccatatgtctttaatttgcatttccctaatgacttatgacgttgggcatcttttcatgtacttattggccattcatatatcttcttttgtgatgtatcagtttaaactttttgcccatttgttaaaatgtggtcagaagaagatgattagaaaacttctacaagtcttacagttttactcctacatttaggtctgtggtctatgttccatttagagttaatgtttgttttaggtgtgaggtaaagctcaaggtttcttttttccatatggttatccaactgccccagcaccccagttgttgataacctatttcaggtagattatctcccctccattagctaactttagcaccattataaaaaaaatcaactgaccatatagtatggatctacttctggaatcttggttctgttccattagtctaatttctatagttaaatcaataccaccctgtcttgattactgtcgcttttacagtaaatcttggaatcaggcagtgtaaatcctccaacatcactcttcactttcaaaattgttttggctcctttaggtcttttgtatttccatatacattagaatcaacttgtcagttaaacaaacagacaaacaaaaaaacctgctggaatttttaatggtcttgtgttgaatctatagtttggaagaattaacaacctagcaatattgtcttcaaatgcataaatggtacatctccatttatttagatcttcttcaatttctcttagcaatattttgtagtttttcagtgtacaaatttttgtacaaatattttattaaatgtatctctaagtatttcatatttttaatcatgcatggtattttcttgttttaactgtgaactgttcatttctagtatgtgaaaatacaattgattttgtatattaatcttcaatcctgtgatcttgctaaactcactttttacttgtagttgatctgactagagattaagcaattgtattgatctcttcaaagaaccaggttttgttcttctaaactgtttgttggtttttaatttcagggctttctattgttatctttatttttattttttattcacttttttttcagacggaatcttgctctgtcacccaggctggagtgcaatggcgcgatctcagcgcactgcaacttctgcctcccgggtttaagcaattctcctacctcagccttctgagtagctgggattacaggcgcccgccaccacgcccagctaatttttctatttttagtagagacggggtttcaccatgttggtcaggctggtctcgaactcctgacgttaggtgatccactcgccttggcctcccaaagtgttgggattacaggcatgagccaccgcgccaggccgttatcttaactatttttttctttcttctgctaataggtccaaagcagtctttattctaggactaatttagccccactactgagatttgactcttctggggattatatctaatgctccgtatttcctgaggtctcttcatactcactggtaagaacacaaactaatgccagccttgtgtgcactccaggaagtgactgcacttccactggactggaagtgactctagtccactgatttccagggtttcttccctagccttcgagagttctttcgcatgctggtggcaatccgtgttcagccaaaggcttgggaagacccctctgcagatctcactctttgttctgctccatcttctttgatactctgtcctacaaattctagctgcctccattcccctaaactctgatctctgtcacctcaacactgctacgccacgctgagtggctcatatctgcaatcccaacactttgggaggcagaggcgggagaatcgtttgagcccatgagtttgaggccatcctgggcaatatagggatatctgatctctacaaaacattaaaaaataagccaggcatagtggtgtgcgcctgtagtccaggctactcaggaggctgcagtgagaggattgcttgagctcaggagcagaagttgcagtgagccaagatcgcaccactacactcctgcctgggcaacagagtgagatcttgtctcaaaaaagaaagaaagaaaaagaaaaagaactgccaggttatatttggttttcctctctctattctgtggccccaaaattgcccatatgcagagttggtatcagaacaatggtcacgcttatctatttttttaaaaccttctctcagagattacagtacttcacaatgtatcgtatattttctggaaaaaaaaagttgatttcttttctgtgtgtgtgtgtgtgtgtgtgtgtgtgtgtgtttcagtaggatcccttggtacacagaagtcgacctgcaaatagctttttacggaaacattcaagctagttgacactgcaatcttttgagtcctaccatcatatataacatttattaatactatggtcaaaaaagtataatcaacaagttatgttaacatagagaaatatttgggttcctgtttggtctgacttttaaatcatcactgaatgtatatgcctgagtatattatgcagccattatctaaaactgcttttcattttattattagtgtaggtatgttttttgagatggttgataattgttataatccaaaagtaacaatgtctgtcattctttatggacatttgtggcaatgactgtatatgaacataaaacaatatgtgagttttttgggtttttcctcagaaggaagtcttctaatttagaaacagcaaggggttagtatttttatttcagtctcatcaaaaagacacataaaacagctagtatgaattgcaataaccacaattttaaagcagttcaagtaatcataatatactttaaatctgagtgagcagagaaattgtaactctggttctatgctgtaatgctgagcttctttactaacacactgtaattttacatggtgaaaaatgaaaggataaaagaaagaattaaaatataataggaataaaataaaatgaagaacaaaataaaggaaattatttccccctgaagttttaactgtatctaaaattattttactattagatattctgttcttgctaaggtaatataagttatagattttttacattatttttggtgtaccattattgttgatttttctatagaaattgcaaatgtttaaccttttgaaattacaacataaaagaaaacctgaaatcatgacatagaaaaaagttcctgagggcatctctacatcctctttcctttttccagtatgttttatttcctacctctctgctaaatattttcacctcaaaaactgtagtcaactgcagagagtggaaaagaaatgatcgagaggattaaacccaaacaaacagctccagagagagatgttcaaagcaacttgaaaatagcttgacgaaagcattaaaatggccaattatatatactaatagctagaattctggtgaggtatttttctgaagtggaatgagaccatctagcccagtagagttgttgaaacttttctgtccactctaacaggagggacgagtccccaccctatgtaattctgatatccacttctcccaccctcgaatctcaaccagaataaatgatctagtctatatcctcattagcaaatgagaaaacaaaatgctgtcccaagatcacaaagctgtctggcaaggcgcagaattgaaattaagtcttctttttcacaggcaaggtgactttttgtagctcaggtagagatcttagcttcagaaagcataaatagttactgaaattcagcagtcaaaaggaaataagataatgttacatgactcaagaagaaaaggaagtccttctctcttccctaacattcacttcttgttttattgcagcctcttcccatatagatatattcaacactatgccctccaacaagttgattttactctgaaagatagtgtgattttggtatatatcagaagttgtagagcaagtctctgaaccttgatcaccaggcctgtcagtaaagctttctaagcatagaaccccagtgtatatatttatttatgtataaattatatctataaatcatggtacttatgtgctttgtacattatacaaaaatggaaatatttaaagaactatatgcgtagatacagatatagattccaagattttctccctgccttccaagaataattttgtttgtccccaggtcagagctaatcaatttgaagaaaatcatcattgtagttttttggtctatcaaacatcaatatacacctaatagtgcaagccaccttgatttgaccctttggtcaagaacatttcatagagtttatcacaaagaagattctcacccaaattcagtggatccttagggttccaaatgtagaagcagattaacaagtaaaattgccagttgccagagcaaatgcactaaagatgattatattaactaaacatttcaaaacaaaaacagtcctccatggcatataacatacacgctagatgccagttatcacaatgaacagaaaccatttagacatccttcagagttacagagtcttcattctacgaatactccttgtcatggactattggatacctacacagtggagaagatcttctgtggagttacagcattttagggagatatattatgctgggataggcactgccatgcactaagcctgccatcccgtttcaggggctggatcactcataggacttaaccaatggggttataatcattttctttctatgccaaagacccagatccaaacacggtattaactcttaataagcttttcatttcccatcattattcacattcttttgaaaggatcttccagcactttaggtagtcctaaatgttctcattggtccaaagaagtcttaaatgattttcatcagcaacagtggccataagaccaaagtggatttatgttacacaggcttggaaaagaagaggtctctaacattaaatcagagaagatggaacctagaaacactataaaattaaaaattttgtttgcagtaagataaaatgtataaatcagacaaaattacattaaatcaataatacattaccaaagcaggatgattttcttatatggaaaatattagggacttacttaaaccagaatctctagcttaggatacagactagaacctctgttctccagggatctggaagagtttacacagcttccctggtcaaacagcacctccaccaatggctgaaactaaccctttatcacagaaataagaaactgcaaacctatcaaagcataatgtcattattctcatttttctttttttttttttttttttttttgagatggagtctctctccgttgcccaggctggagtgcagtggtgcgatctcggctcactgtaaactccgcctcctgggttcatgccattctcctgcctcagcctcctgagtagctgggactataggtacctgccaccacgcccggctaattttttttttttttgtatttttagtagagacgggggtttcactgtgttagccaggatggtctcgatctcccgacctcatgatccatgcacctcggcctcccaaagtgctgggattacaggtgtgagccaccgcacccagcctattctcacttttcttgtgattcccagtgggatcttgaaaaaccaatgaactcatatttccacttgttctacctgctaagctgagacaacactaattatcacaaactattctcacctctcagagtcatagaaaactgggatagtttgaagtttgtggaaatacaacttgagaaattattgtctaagtggcagattctaagcagcaccttttctgtgtctatcatttctagtggcctacaaagaaagcaaaatgtaagaataatttaaaactggttgtgtattagaatggtctttacactatacccataaaatgtagctgagatttatccataaggggttgaaataccctcacagtgaaatttggacttaatgagttgtcagaaatgagaggccaaattgtcagctctacgttggcctatggtaaaacctataattaaagtttgccttgctcaaaaatgcttagctgcacttcccctcctgaaatactctgccaagaaaatttacatttatgccatgaggtttcctttgaaaaagacaaacaaaacataaagtcctcttaagtaggtgaagtctgtgggtcattctacctaatgcaacctgcactaggaataggcaggtgtttctaacacctactgaaatgagcttcactgaagaactgttaagtattgtcctagagaaagtgtgttgctaagaggaggagggttgttttataacactttggtgattagacctgagtgctctactgttaaacagtgtgtgttgaaccagaccttggttctcttggctcattgcctttaatttccatagtcgggatcacctcaaatctatctgcagactcaggattctgccacaccctaggtcctgttcgttattttattttggctaagattaaagagcattagctcatagcttagtatcgactgagcctagataacactaatgggtcactgtcgttactatggtcattaatttaagaccaaccaagttgattaggaagctaatgagtttttgaggcagacggctccgagtatgaatcctggatctgccacttactatgtaagcttttcgaattttttctttctaagcttcaagtttcctcatctctaaaaaagtgataataatacctatacatgatctctgatgacttgctagtctatatacaacactagacgactttatcatacattatagggacttaatgaatgcttatttccctttactgctccccttcctttctgtgtttaggtgtagaaaagcttcctaccattatagtcagtcactttgcacgactcagacaatcagctgttgatattcatgctgggagtgactgtgtgtccctaactttatcatagatctagactggaaactcaggtgagatcagtgcctaggaggagttaggaatccaggctgcattttcctttgtgttcctgtaacattggaacatgcttctaccttgaaacttatcacattattttggaatcacttttggtcgatgtgatatttcctcctcgaagacagagttgaggtcttattcatcctaaagttccgcaggcctaaaacagcatctggtgaagggcactacccatgccatgggtacttcatgccattcctctgcaaaacaggtccagatgacatgattcaacacgcttcaaggtgcccagacctctttgaaggagaaacacacacaaactctggggacattgttttagaatggaaccaggcattaggcaatcatattttctgaaaatctttaatagaggattttcatttggaattggcccgtgcaggcacggaggtctgtctacatcagcagttagcatgcattctctcctaatctgtgtccagtccaatgataaggcaaagacgtggatatctaccatgaagtacatgctcaatgggggacattcatgagctttaacagtttgggaacaatacagtttaggacatacgggttattaataagcattggtactaatgttagttataattcatgagcacaatctcactattttcataatcatcctttgtataattaagttgttaaagatatatgtgaaaataatgcgtgttgtagaaattagaagactcaggagatcagtgtgggttgaaaatgactttgtgtgtaaaaataattatggtaataattagcatttgcatggcttcttgaaatttacaaagtgtttttacaacattatctcatcttgcaaaggttatgaactggcctttagatgtcttatgccaatattaagcttccctgccaaaccttgtgcattataaggtaagatttgctagacagaaaaaaaaagaggattaataatgcatttaaaaggcaaaaaatctgccaaatttattggcgtagaaatagatttatttggcattttagaaactaaggcgcatatcttgtaaaagaagcagttggctcatattttgatttcatagtgcttggaactttttttacattttgggggatgagtttttgatgtgcaattgtaatgaggaagttcacttacttggaactagaagattcataaaatcaggggatatttgaaactttttaaggggcaaaacctagagtgacttgattaaaccactgtaagtagaagtatggttagagagaaaatgtgaggagctgatcagtattttgtttaaaactcaggtgtccatttccttattttatttattttagagacagggtcttgctctgtcccccaggctggagagcagtgggggtgaccacaggtcactgcagcctggaactcctgggctcaagcgatttttccctctcagcctcccaagcagctgggaccacaggtgcatgccaccacacccgcctaatttcttgtaggggtggggtcttgtttgttgcccaagctgttctcaagctcctggcctcaagtgatcctccagcctcagcctttccaggtgctgggaacaggcgtgagccacagtgctggcctctcaggtctccatttcttagagggaatccagattgatctgtaaagtgctccttccagccatatcttccttcccacaaccacaactaaaggttgaacttcctatctcatcaaccgcctaatctaaaaccatgagttaatgagataaaaatgagtcactaaaatgcaaacgttcttgagaatcaaccttgaaagttaaagacaaggccacctgccagccccaccctcccacctcccctgcgtgcttgcctgcggcgctgcgtttccctttgaaaacgcgaggtcacctggactgcccctgaagggaagacctgctatgtgacccaggagcagcccggcgcggacccaggtgagtcattgggttgcacaggaagcgagacgcctccggatagctgtgctgcagctcgcgcgccccgcgagggtgtcgccggcgcagggtaagtctttccagatgtggccgccgcgcgcgcttggccgcgggccaggaggccgcctgcagttggcgcttcccggggccgcagtgccagccgcaatgccggcctcctgaaggcaggcgacagcctgcggccgggagcacagcgcggggcggagtaccgaggcatggtcgcggcgcccgggctgcgctgaaggcgtctgcgagcggatgggggaccccaaggcccacgtgatggcgcgccccctgcgagcccctctccggaggtcctttagcgatcacatcagggactccacggccagagccctggatgtcatttggaaaaacactagagacagacggctggcaggtgagaggcagagggggattggagaccgggggtgaggggtattaaaaagaaaacaatttactgcgaagacgcagtgataagcttggttcatgaatgatctcatcagctggttgaagtttcattcttgtcatggcagtgtgttcggtctccctttctctagtatttaaccttgatggagtgttgagatttttgtgtgtttgttttgtgtaacgccgctctggttactggtctgattatttctagataaggaattatgagagttgtggggttttttaaccttcaaaagagaagcaaggtccttgtgactgtcaggaaatcggtagtgatgaacaactgctgcaaaagccctgagatcctcggggctgtctcgggtcagctttggagctgaagctgatcaggtgtgaggtgccctggcgtgtgtgcaggagaggggcctggcaggtctgtgtgtcagtggagtgatgggcgctgcccagtgaaagcctgctggtatttcctctggcagcctggagctactctcggttccaagacggtgtcatgtatgccagaggcaggcgtttgaaatataataaagcaaatacagtggtgcaattcaagtgctctagggctcatgtgacagccaccaaatggtagactgtgtttgcaggggtccagtgaggagatagggacttctgtccgatttttgcgttgggataaaatagcatctcactacgatatgaaaaaactctccgaattagggtagggtttcccaatagcgtttatggtgccttcttgtttgctctctaagtctgtgttcctatgccgtctacatggatgggtcaaagactatgttttcttaacctctttggtcaatccagttgttttccgtatactgaaggaaggtctgaatttacaaatattagaggtggcctctaagagtcaatacagagttctgtgctgtgttcttaataaaaggtcttttgattttcacataattgtcctgatatgacttgaagaggggaaatttaaagtgtgcgattgtgataaagcagattgtgaagataacatggtagtttcatgccctcataaactctaatttgttctgaatgcacatgaaaatctttctgtctgttgcactaaacaatattccccaggactgacggagaaagtaaacaatgtcaagtcgaaccattaggtagggaagggagcaaaatattttaaatttaaccattttattattgtttagaggaaaatgtggcaccctaaagaaatacgactttccaatatgattttttatttaactctttaaggtgtatgatctcatttgcaattaaccagaagaagtttaagatgtaagatttgggagtaaaaaattcaaaactataattggttgacaatttaaaagaaaaggtactttcttcatatttgtcttgtttaataaacaatgccgcaaatgaaaagattctataaataatatcttactaaagataatgcaaaaatatcttgttgtggtttaatgttttaatttgaaagtaagactaattcaaacatttatgcttctgagatttcctcttacattttcatacatagcctttgacagctgatgagaataataatatcctctaagaataagaatgttatccctggaaagttgttctctttcttcttatttgtctgttatatattaatactatgtttggagtcaaaacataacagcaagtgtaaattaatgaaaacacttagagaaaaacagttaatttttatgtgtgatgaaaaatcaaatgttttcacaactctagcagcaaataggatttttactgctctaggtccattgcgggaaataattctttatgttgcccagggtttctaagagcagtatggacctctgaagtaactcacacagtagagaatccagataccatgcttgaaaggaaaagactttggctatgacaactgactttgattttgggggacctggacacttttggtgtcctcctcactcttggctcatggctggaagctcagttagtcaaatgaagattgacttggtgcacagccaaacctcaagagcacttgcttccatccctttccctcaagcttctcctctgcactcaacccttccactcaccaaacatgaactaatggctgctaatgatccacaaaaagtcacttctctgaacaccagagaaaatctttgttatatgtcctaccaccttgccttcgtgtgcagaatggagggcagtagaaagtccaaacccttttctttatgttgtgaaattaatgaggtaacaggtaaaaagtgttttttaagtctctggaagagaatacttctgttaatagtagctagaatgttatttcggtgatgattattgccttcctgactttcatcaggtttctcaaaaactaatctgagattttagtttctttcacctaatcaaagggtttggtcgtgggataacattttaagtttccttgttaggtatattcttattcattctctctctctctcttgctccctccctccctgtctccctccctccccccttcccccttacacacacacacacacacacacacacacacacacacacacacaggcacagttctgctatcccaaatgatatcatgtacaaaaagcatcatttacatctccttgtcttaaactcccttctacacgaaacagggagcctgtctgttatttttaagcatctgcagccttttataaacaatatacagaattgttgccaggaaaaggccttcagtttgtgaggaaggacagatcagattgtcttacttgcattcccctttatatatgatcccctttttctgcccagttacatcccacaggagtttctgttaatcctatcttctacaaccattattcccaaccccaaggtactctgtcttctttgctaaaagcagaggatggtattgagttttcagtgaactagaactttgaggatgacagtggttgagtgatgcaggggacagctttgtgctggatgaagtgtgcttccttcttaaagctcctctgtgctctcaccccctcccctttgattcatggacatctggtcagcagagcacatcacattcctgaagggcagttgcctcttaatccttccatagagggccttgtagcctgcttttgtgcccacggatctctttatcattcctgtgaaacctatggatcacttctcagaataatctttttaaatgcataaataaaatatatagaattatagaggaaaccaatgatagtgaaatacagttatcaaagtattcaaaacataaaattatgatgtactagtataccgtgaatgaattacataaaaggataatgcctttaaaatatggagaagtgagtataagttaaaagctatttttgtttgtttgttttgttttttgttttgagacggagtctcgctctgtcacccaggttggaatgcagtggcgcgatctcggctcactttaagctctgcctcctgggttgacgccattctcttgcctcagcctcccgagcagctgggactacaggcgcccaccaccacgcccagctaattttttttttctattttttgtatttttagtagagacggggtttcaccgtgttagccaggatggtctcgatctcttgacctcgtgatccgactgcctcggcctcccaaagtgctgggattacaggcatgagccaccgcacccagccagttaaaagctatttttaaaggtattgtgtgcacactgttgtaatttaactcaactaaaaacgttaagttgtgctgaaagaaataagctgaaagaaattaaatactagtcttttttgtttgtttgtttgtttgtttgctgagacagagtttcactctgtcgcccaggctggagtgcagtggcatgatctccgctcactgcaacctccacctccctggttcaagagattcccagcctctcgagtagctgggattacaggcaaccaccacctcgcctggctaatttttgtatttttagtagaggcagggtttcaccatgttggccaggctggtcttgaactcctaacttcaaatgatccacccactttggcctcgcaaattgccgagattacaggcatgagccactgggcctggccaatactagtctttatttaacaacatcttataaagtaagacctactaaatagtatcaatgacattgactttttaaaagaagggatttcttctctcaatttggagaacatgacatataagggaaaaagtctaaatgcctccacctgattgagatatgtgacgtcacattattcccatagctaaacatttaagagcctgggtacagtggctcacgcctgtaatcccaacaatttggaagcccagcaggaggactgcttgaggcctggaacccaagaccagcctgggtaacagagcaagaccttgtctctccaaaaaatttaaaaatttagccaggcgtggtggtgaccatctgtagtcccaggagctgagtcaggagaatcacttgagcccaggagttcaaagttacagtgagctatgatcatgccactgcactccagcttgaatgacatagcaagacctcatcttctaaaaaggaaagtaaaaacaaacaaaaatatttaagagaaagaagaaaaaactgaattgcctatgaagagggcaagaaaatttaggcaaacctctatgcaagtgagagtcaacagacataaaataaattcttcaagtaactacattaagttgaaatcccctgaggtattttgcggagtgttcaggatcatatgtcttttgcaaaatagatttttacattgcagctgatgagtcctccaattcactagcaaaatgagtgctggacacactctgtggtacattggctctcacttcagtggggcattgggaattctggcccacttccaaggaagggcaaccaaaaacattgactcctgtgaactgttctctgctcctttggttcacagtgaaaagcaagtaagggcatatgtaatgccttttaaccatgagtgatgtaggcctcaaaatatgcagcctcctctagtaaacaaacacttttccaatcataggcaacaccagaggagatttttaaagacagacaaccgttagggaagcttcgtgagatattgcaatgtgaacatgtatctagattaagttaaatgatactgttttgataaaaagaggaacatgttgatgtcaagggtggctttgatgagagaatatattatatagtggcttagagagttgacctgcaacctcaggctgcctgtggctgagtcctggttcttgcactgggtaatattaggcaagtcagcattccttgccaatacaaagaggataacagcacctacgtcatgaaatggttttaaggattaaatgagctactctgcaaagtgcttagagagtcattgacatatactaagcattccttcagtttcagttcttgataccctacttcctgagggccttcaccttgttagcatgacacctctataattggctttgggcttttgggcaaaagtggttcaaccagtccaaaaaaaaagaaaagaaaaggtaaaatgtcaatggcaaatggaatagatttctgtatctctggagagaaacaaagaaggatctactggaggtgacttttgtgctgatctttgtgaactccaaaaggaaatgactggagaataactgattccacacattgatgagggaatcggttcttgcatatgagcttgtcaagctagatatacgatatctgaaagttttcctaagcacgttgggacctgctttgaaaattgctgtatagatggagccaaacatggaaaagagcagcagcaccagcaggcctgggctttcaagcacgtggctcagctgtggtatgggaaaaaatatgctaaatgtcaaggctgccacttgaaagggatgtttcgcacacctccctttctgcaacaagacttctgtgactttctttatttaaagtagtgtgcatgcacagtctgcacattttaccaaaggccactgtaattacaatacctagatatgtccaaaatcgaaggcctggtaggagggtcatattaatttgtcacacatctacttaaggatctgaggctatctcataaagcaaagactggatttaaaagaacattcctctggaagttctctatttcaaatgaattatttaggtatagttggcagttaaacttgaaagttttttaatttcttttttttttttttttgagacggagtctctctctgtcgcccaggctggagtgcagtggcacgatcttagctcactgcaagctccacctcccgggttcacaccattctcctcctgagtagctgggactacaggcgcccgccaccatgcccacctaattttttttttttttttgtatttttagtagagacggggtttcaccgtgttagccaggatggtcttgatctcccgacctcgtgatccgcctgcttcagcctcccaaaatgctgggattacaggcacgggccactgcgcctggccatgtttttaaatttcttattctaattacttagttttaattataatgtgtcttttttttttttttttttttttttgacagagttttgctttgtttcccaggttggagtgcagtagtatcatcatagctcaatgcagccttgaactcctgaactcagcaatcttcctgcctcagcctcccctcagcagccaggactatagggttgtggctaattttttgatttttgtagaggtagggtcttgctctgtcacccagggtggtctcaaactgctgtcctcaagtgatcctcccagctgggactacaggcacaagccactgtgcccagcttgtcactcttgaagaaagaggaaatgccattcagttggcatgtgctggagttgtttgtgtgtgatgatgatggatttccattgatccctctgtgctcttccctgtagctcaaggacaaccactaacatttctgaagctgtagttattgatgaagacctagccatggaaaacaacagttattcagccccataattgtcaaactcacgactatagtactgcttttactcttcttaggcacagccaaagacaaggcatgtgctttcttagaatatgaatgaggccgggagcggtggctcacacctgtaatcccagcactttggaaggctgaggcgggcagatcacgaggtcaggagattgagaccattctggctaacacagtgaaaccccgtctctactaaaaatacaaaaaattagccaggcgtggtggcgggtgcctttagtcccagctactcggaggctgaggcaggagaatggcgtgaacccgggaggcggagcttgcagtgagccgagatcacgccactgcactctagcctgggccacagagtgagactccatctcaaaaaaaaaaaaaaaaaaaaggaaggaagcacagatgggaggggtagaacatgagtacaaaggttgagaaacacgggtttaaatttacctgaagatacttataggccccacttcccctcatggagccaagagtatcctataaacacacaaaaagaagtcagaatttctggatgcccccatagagccaagggaaattctctctgcaaacaaggctgggccaggtggcttatacctgtaatcccagcacttttggagaccaaggtggaaggatcacttgaagccatgagttcaagacacctgggcaacatagcaagactccgtcattacaaataatttaaaaattaggcagctacggtggcatgcacctgtagccccaaatactcgggaagctgaggtgggagggttacttgagcccaggtgtttgaggctgcgcgcctgtagtcccagctactcgggagactgaggcaggagaatggcgtgaacctgggaggcggagcttgcagtgagccgagatcgcgccactgcactccaacctggacaacagtatgagcctctctctaaaacaaacagagtcaggcaagttagtgcatcatccttaatgaactggccattctcctctttataagacaaaaagacttgtcattccaaagtgctataaggttgtatttttaatcatattttttaaaatgacatactgacttgttttcaaagtttaaaagtactaaagcctaaaatatgccactatttaagatagagtgatctcaactgatttagaaatcagaatgaactaaaattggaagttatactttaaatatttcaatttacacatagattaccctcagagtttagcacatatgggctgtagaactgaaacacattgtcctaagtcattgttgattccacagaatttcagccaacaacagaaacactcttaataaaaacaaattatcaacttctagacaatcaaaatcaccaagacatagtgaaaagacatggcatattattgcttggtgaaatcctggttggtgatttttgaaagccctgataccataatgtaacccttctctcttggttctttctttctttatgtgctcaggtaatgagcacatctaggcaattgcacacacacacacacacacacacacacacacacacacacacactcctcaggaatcacatgacttcaaagaacttttctttataaaagattgaagattcctgagttataggttgctggtgtaaaagtcataatataacatctgattgttgacactatgcagtggggggaacagtacattttatggtgtctagactttgttttatctggttgatttttggtgacatatttagctttttgtagacaattctcaaattactgactcagcattcagtgtggttcagtttatcatgatccatcatctctaatctagttttgaatagcaggatgttgtaggtccagattgaagtgtgacctctgaatgtttttcattcatggttgattactatatcctagaggtctagacagtgttattggtttctcaccaacataaacatctggcagaaaaaaaaaaaagctaaactagatgagtaagaacattcctaatctacctttagaatatgctatatttaaaatataacttttttgcaaaatgaagcccatttcaggtctaaaagtatgccatcaagcatattgtttttcagctctgataagaccgtctttggacactaatgtttcactgacgaaaacaagtttgaacatgtaatttcaggctgcactggaaacatctttcttttgtgctgttacaagaagctagaatttcatttagtgaattccagccaaatgaaattagcacgtgcatgtcaactcatgtgtagctcgtggctggacaaatgagttggtaaaccaatgaagatgaggaagaccaactcatgtgcagctcatggctggacaaatgggttggtaaaccaatgaagatgaggaagactggcgatgaagccaaacccaaagcacacgggcattagttatcaggccttctaatgttattatcaggccttctaaattttatttcagtttctaacagttttttgttgtattagaaccatgcaaagggctttctctttttttgttttgttttgttttgtttttttaatactaagtctttctctattgcccaggctggagtgcagtggcaggatctcagctcacagcaacttctgccttccagattcaagtgattcttgtgcctcagcctcccgagtagctgggactacaggcacctgccaccatatccagcttatttttgtatttttagtagagatggggtttcaccatgttggccaggctggtctcgaactcctgacctcaaatgatcctcctgcctcagcctcccaaagtgctggaattacaggtgtgaaccaccacgcccaacccaaagagctttcttaacagccagaacttcccaggatagagtaatgtgctcctgagacaaagggagaaactaggcctttttctttatgttggggctaccaagcccctccaaccaaacaacatacaaaacatgcccagagccatgagtaccaggtaagagaatgtggatgataacatcacaacccagaatgcttcccttgtagatggaacacacatctatgtcatggcactaacactggaaattttataattagaatatcataagtttataaaatatgcattcagcaattaattccaatttatgtacaagagttactgcttagtattttttttcttcctttttttgtttgctaaagaaagaaaggaagacagagaaaagtttcctttagtccttcagtgattatgtgtataaattgatgacttagaacttaagactatgtttccagcaaagctctttggctccgcataatcattgcacaactgaagataaacatagagggtaaacagcagaataattatgtcaaagcagtgcctgaaaatccattgtaaatgccctttgcactattttagacaataacaacattctgtgaccaaccaccctgtgcatacccgaaggattagcatatcatagccaagtgttaataaactggaagatggaaaaattaatttaaattaaaacatttaacaaggaaggaaggaatgagggagggaggaaaggaaaggagggaaggggaggggaggagaggggagagaagaggagaggagaggaaggaaggaagaagagaaggaagaagggaaggaaaaaaaacccacagcctatgaaggacatttgcaggaagatgatggtaaacggcctcatgctgtcttggagactatgacaaatggatcaaaactggacacccactttctcagccactaccacacacattccgagctctcattcttgtgaggccagttcacagaaaatgtttttatttctgtgaccctgagcatgactcccactttgctgcataaagtattttctgagtgaaccttcgcggccttccatgctcattaatctctaccacctacccacacatactcccactctcaaacttcttttgtgattgcctactatttttctttaccattttttatttaaagtaagatattgagtgtagtcagctcataatgtataatttgtccttgtgtgtaaatgctttcttcgccctgttccatatttctctccctattcaaacttaaaaatatttcagtgaattaataaaagaccataatttaagctatccccttgtctcaaaataaagtctatgtttttaaaccacattaagtaatgtctctgtgtttaaatggagcttaggaaaatagcatttgacaacttttattactataggaaaaagctgacccatacccttgtacaaattgagctctgaaggtcagaagccaagtgcttttaataacttttgaagagtaggtaatctctgttcactttgaagactgaagtatgtactaattgcttttgtaaagtgaaggtgatgttgctgtagttaatgggccatgcagttgtatcccgggacatgtaatcccagtgtctcatgtggcttaagttgctgttttcataacatactcattgttttttgtttcaatatcatttggttaacacttggaattgttatctttgcttcccaaaaatcttttctcaaaaaatatctttagatggtttatcaattaactaataccaagattattttactaaatattttaaacatccaagattctcatgtatctaccactaacttaagtaataaaacattgcagttgctgttacagccccgtgtgtgcccctcctgggtcatatttccctccttccctcctctcccgctccccctgaagttctccagtcctgaacttagagtttaatcactctcatactggctttatactcgttacacatttaagtgtccccaaacaatattattttgcacatttaaaagttttaagtggcaccatactgcaaatatctttctgcagctgtctttgctcagaattatatttttgatattattcgtgtttgaacataaagttccttattctgggctgggcacagtagctgacacccgtaatcccagcactgtgggaggccgaggtaggtggatgacctgaggtcaggagttcgacaccagcctgggcaacatggtgaaaccctgtctctactaaaaatacaaaaaaaaattagccaggtatggtgactgctgcctgtaatcccatctactcgggaggctgaggtagcagaatcgcttgaacccgggagggagaggttgcagtgagccaagatggtgctactgcactccagcctgggtgacagagcaagactctgtctcaataaataaataaataaataaataaataaataaaaagcttcttattcttattgctgtcatacaaatatgccctaatttacttattcattatcctgttgaaaggcatctatgttgtttccaactatgtgcttacataagtatttgctgttatgaatattattgtcaatgtctctgtgcgcacatgggtagaaatttttctgtggtagagtaactcatctaaagatggaatttcatagtctaagatatgtacatcttatatggccaaagttcaacatatattacacatccaccaatggtatattagaatgctaatcattatagaaaaaataatttttcaaatgctgtaaaagtggtagaacattttctttaaaaaaacataaaaataaaaatggtatgaataagatattaacaaagtcaagtttacatatttttatctattatatatacatataaatttatatatacatgcacatatatatttataaacacatatgtacagatataaatttgtattatatatcatatataaatatatgacgaatagtttttgaattactaactgaattcagcaaagactgatgaataaagtttgaaatgaaacacaagtaagtaataagtaatatttctcttatcttactgtggtttcttatacagatcaagctaaaatgtaactaagtgtctatttaaagatgataataacataaagttcattacttgggtataaacacagctgaggtaggtgctgaggataggaaatggaaagagcgaccatctgagaattagaaaaagaaaaaaatgtaattcagagataaccacttcacagtaacttatattaagtaacactgataataatacctaacacaatatttcctccctcccaaaaaactcttgcaggcttccacggagaccaaagattcccttgaacaagtggacaaacctgctgtagggacccactacttgaatgtcattgaaaaagcaatcctttccccaaatattggataaattatcaagtggaggaagcattaatttgccaaaatcaacatagaatatatatttttattctactctattaaatgcactagtaacacttcatttttaaaatgtcttctataagcaaaccatcatgtcttagaatgatatgcatgttaaaatccagtgtctctatctcagcatctactaagagagattcataactagtgatggttattctgttttgaagttcaaactactgcctgtggagatgatgacctctgtacttgcattcgtcatccatcaagtagtctttcttctgatcatattggtaagttaggagcaatacacttcattatgtttgaatgttatcttaaaaatggtggttcatgatccaggcgcagtggctcatgcctgtaatcccagcaccttgggaggccgaggcaggaagatcacttgagcccaggagctcaaggctgcaagtgagttatgattgtgccactgcactcctgcctgagtgccaggacaaggcctcatctctaaataaaaataaacaaaagataaaaatatggttcaatcaactccacatagtttcctggcaatattggtgaatttgagattttcttagttaaatgacctcttttcattttactaagttgtccatgtatcattgctttagaatgtcaagtccagaaggacacaagtcaaacttcgtaaaaaaaaaaaaattgagagttttccttaggatcacgtgattatcaattttcctcctaattttaatggcttttatcatttcttatgaaatatgttccccttgagcaagtctttaaaattgttctcttcttcaaaatataaacccctatcttttttttaagtctcctaagttcagttagaacttctctctaataattaccccatttgtgtccttcatttacatattcagtcacaaccaatacagaaattattttatttttagcacacaccataatgtgacatttagaactcacactgtcccttactacacagtagcactcttaccccaagagaggggtcaaagaagaaaatataacaagggtttttaagctgatttttttgagactcagaaagaaggtgagattgacattttgcctcaacttcttcatatctaagctaaacacctattagacacattcaatgcttagagcttttcctgaattattatttaatgcttaataactctgtgaagtagattctgttatcatccttgttttacaaatgctgaaacatgtcctgaaagtttaagtatcttgctccaaatcacataacatgtcaaaaattgagctttttgtctttccaacaaaacttgtctttttcatctccattcacagcagttagttttgtctcctctcttctttcataccctacatttcttccatcagccaatcctatcatctgtacctgcaaatgcatctagacgctgaccacttggcaccaccctcactgccaccaccctgggccaagacacggttgcctcgcacctgtgttcttacagtcactcctcaactggcctccccacctccacccttgccccacctcctgtaattcattccaaacatgacgaccagagtgatatttataaacataaactatatcctgtcactcctcaactcaaaaccctccaatatctttccctcacacaataaaatcccttctatggccaagaagtctctgcctgacctggggcctacctactcttcccacttcaccttcttctatcctttcccattctatacactctggcctctttgctgttcatgacaattgctgttccctcatcttgaaaaattcttttcccagacagtcacatggctctctcccttactttgtccaggtctctgctgaaatgttacctctactgagaggccagtcaggaccactctattaaaatggcattctcctctgaaccaattgcgatccacttctggcatgttacatgtgtttgtttagtgtctctctgtcctttcagaatgtaagttcccctgtgaggccaggaacttagtaattgtgcatcttcatattcctagtgcttagaaacgtgcctgacacattagtctttgttgaatgacttaatcaacggacatgtatataaaccaaaaggcatacacacagattgccaaatgcaagaatacatatattaacattatatggtaaattatgcaagcacaccttctagagaaccaactaaaagataaaatagatattgggaatttgaggcaaagcatctatctcacattttttctgaatcaatcaaaatacccagaagctatttgaatcagttacccctcccttatgtatcacatacatttttttcttaagctatctctaaattatgttctttcttctatgttgctaattgctgaaactcaaagtaccatatatataaatgatataatagttacacttttatccttccagcatcagttggatatttcttccttcctttctttttctttcctcctatcttgtcctatcctcacctttaaactctatttctatatttccaactgtctattggacattttccagtagatgggtatcatgcaacttcacattaaaatggaattaacttcattatctccacaattaacttcattatctattctttcctatccattcatcttctacaggtggccttacctctccttcatgcctcatgtgaagttaatcacaaaatcctgtcctgtccaccttctgtgtgtctctgcgtctgcctttcctttttagttctacaaccactgtgaaggcacaaactgccatcattcttacctaaagttaggatcttctgagcttgtctctatgaccttaacatcttccacttcaatccatcattcattccactgccctcttcactgtttcactgtttttgctcagaaacgatcaagatcatgcaatttccaggcatatcaaaccaaagcacctctacctgcttgggaagattttctgttatctggaaaggttctatttagccattcctgtctccttgctgttccgctaaagcactgtgttcattcctcctctgctgtttgtgtgttttctttaacaaatgtaccatgatccccttcatccaaattccttctgcttttcatttctcctgctcttgtaatgtctagaacaatctcaacctttactgatgtccatttcatctgaagtcttatagcacttactgatttttttaagtttgtaattacatgcttatttttatttctatttttggctgctatttcatattttagccttcttcacctaagtagataggaatacacttaaacagaaaaaaaaaaacccatctgttgtacttgtatatagtgctggtatgcaccctcatagctaccagtgttgttttttttcaggctgcataacacacaccagttcaaataagccaacatttctattgctttctcagatgaaacaagtctacatttctcagaagaaccaagcctacaatttaagtagggcaggtggaaaagaaatgaaggaaataagacagatttggagaagctgtgaaaatataaaagactgtagtatctttattgtaaaaaaaaatgttaataataaagctcttcttcctcacaccccatagacaggtggatttatcatacagctgatgaactttcaggatctatcatttgcattgactcttccaaggccctaagggagccttagcactctgtccgggtgtttttgtaaaatctgtaaaattaagatcgtgtaaaattttaagtgattaaaattcaaatcactgtggttcattatgattcacagcactggatagtctgtgggaaattttgcatttataatttattgtgttggatggccttggggcggccaagtccttttgcatttatttttcatgtcaggtgccactggagtgatggagtgggtatttcataattgtaatttttaatcttttgattttctcttttttttttttttttttttcttgagacggagtttcactgcgttgcccaggctggagtgcaatggtgtgatctcggctcactgcaacctccgcctcccgggttcacgccattctcctgcctcagcctccagagtagctgggagtacaggcgcccgccaccacgcacggctaattttttgtatttttagtagagatggggtttcaccgtgttagccaggatggtctcgatctcctgacctcgtgatccacccgcctcggcctcccaaagtgctgggattacaggcgtgagccaccgcgcccggcctaattttctctctgttttcttacttgaaaatgaaattgagtattctagagtctagctccagacagtctcccacccatatgagaaataacagacccccgtacaaacaggaaatgaaatagaaagatagaaactaatcttcatgtaggacatactatgttccacaggctacataggccattgatactttgaagtactgcaacaaccaacttacagcagatttcatcttccgcaattacaaaagagaaaactcaagctcaaaataataggtaactggttaaaagtcacatgaccagtaagaacttaaatgtggatgtgagcttaattccccccaatccaaagtccattgtgttcttgtaaccttagagggtttaagtgaaaatcaggaagcagatattataagtaaatgggaatatatatgggtaactatttttagaaacaaaaatctaaattctctcctatcttcctatgtttttcagagcctattcttaaacaaatagtaaaaatatgattactttcctgtacttctctgtattctgttgatctattacttcaagagattcagagtaaagccgcagtttccttagtgaagtcgaggatttacaatttgtcagtccctaaagaagaatgtgaaggagggggtatttgaaagatctgaagagttccgagtgtgacgcttagactgttaatcttcagggactggaatgttttgtttctcttacccttgcacttgtgatttgctgggtgattcaagttgagatagcagccactctaaaacactacaaggattgaaacttgctgtgtttaagtagttacttaattgtggctccttgctactttatagccttggagaagtccgctgttggtacttacatgtattttatttcaagttggcttttgatgacttcccgcttataatttcctaggcacttttctagctagaaaacagctttttcattgctttgataaaatgcatacaaagcttgctcctgactaaagatgttatgagacagagagagagattgctatgaagttcccatgcactccagcaaggacagctggttaggattagaacattctaccttcagcatgctggtttcccacagactttattgtgtttatggtttttttttttttcttcttttccgtagttgacataaacaaagtcaacatcatattctgagtagagttagcactcttgatgtaatcaggaaattccactaaataatttttaatgttgaatacagcaaacattttattagtcgagaatctgcattttaatcagctcatacattctcatgatgactgacacgtataaaatagattatattggtcaagatcatctctaccaatagctatagtgatattcacttgttcaatgcacatgtcagaattgttgctttttttttttttttttttcctgagacagggtattgctctgtcacccaggctactgtgcagtggtatgatcatggctcactgtagtcttgaaccctggggctcaagtgatccacctaaatcagcctcctgagtagctaggactacaggtatgcaccaccttgctcagctgattttttaacttttttgtagagacagggtctcattatgttgcccaggttggtttcaaatgccttttttttttatgataagcatatgtagtcccgggaactgtgtgaaattctagtaaagaacatgattttgtgacacaagtcatgaccaccatggacaactatttgtggcatcctgattgcagtgctacagaagtttagggtggaacttggtctcgatcatatcttccaataaaaacaagacagtgcacagattgcaaataaaaaagagggtcagaggctgcaaaatgcatataaagaatagccttcactcagcacactaatagtatgtactggtagttacaattactccaaggcagttctgcgtatctcccaagatcctgcctctgccttttttttttttttttttttaagttctgggatacatgtgcagaacttacaggtttgttacataggtatacacgtgccatggtggtttgctgcacccatcaacccatcatctagggtttaagatctgcatgccttaggtatttgtcttaatgctctcccttcccttgcccccacccgccaacaggccccagtgtgtgatgttcccctccctgtgtccatgtgttctcattgttcaactcccacttatgagtgagaatatgcagtgtttggttttctgttcctgtgttagtttgctgagaatgatggtttccagcttcattcatgtccctgcaaaggacatgaactcattcctttttatggctgcatagtatattccatggtgtatatgtgccacattttctttatccagtctatcactgatggacatttgagttggttccaagtctttgctattgtgaatagtgttgcaataaacatacgtgtgcgtgtgtctttatagtagaatgatttataatcctttgggtatatacccaggaatgggattgctgggtcaataactagttcaaccactttaaaaatcagtgacaagaaaagtcattgttcttgcaataatttagtctatgtaaaaccttgtttgagttcctagaaagtttgaaagcttgagttacgtagtaacaactactgtacatttaataacttatcaacctcctttaggatttttttggccatatatttatttcattcattcaattgaaaatcatgagcccagaagtctaccttgtaaaccttagtctgggtctcaactagctcttgagaccttgggaaattcagtaataatctacatcatctttttgttcctcatctgtagagatggggttaaattatgttatctctaaattttcttcaaacccaaatatgctatgtgcctagatatttgttcattactatactgtgttgtagcaaaatgatatagcatacaggccctgctttcaagactggtacattaaacaataaaaagggcaatgggcaatattctttcatttaacaaatattaagtgagtacttcttatatgttaggcactctgccaattgctgcaaagacgagcgtggatagtaactgctgtgggcattacaaagaagctatactggtattggacggaaagtgatcatgacagaggtggggtgagattgggttaataaattcaggcagaagtaggagagaagggaacagcatgaatcctggtgcagggtgcagagacagtgaaagctggccatgcaaggtcaacaaatccagagtcatcttgcttggctaaagtagaaagctgtagttttcaaccctcacatctgttcatttactatttttttctttcattccattcatttcattcattcatatattcaaaaactatttgctgagtacttaagttagtggatatgaggatacagagatgggcaagacttatccctgccttttaaatgacaataatgtcatttatggagttccttttatatagcagacactgctataggcttttatacatttattactgatttgcacaaattacaatgaggtataggtcttactatccccatttgataattaacaaaattgacacttaagagtaccttaggcatggctcagtggctcatgcctgtaatcccagcactttgggaagcctaggtgggcagatcacttgaggtcaggagttcgagaccagcctggcaaacatggcagaaacccatctctacttaaaaagttagctgggcgtggtggcacgcacctgtaatcccagctactggggaggctgaggcaggagaatcacttgaacccaggaggcagaggttgcagtgagccgagattgcgccactgcactcaagcctgggcaacagagtgggactccatctcaaaaaaaataagaaaaaagaaaaaaaaagagtactttaaataactcttccaagatcatatagtaactcaaggagtcagaattaaaatccagatccccaatttccaggatcggtgcccttaaccatcactattgtgccttctgagtatttgttaaactaaatattttgttaaatgctaaatgatttttaatcatatcacacaccaacacatggaacatgtactatgcatgaaacttttatctattgagtaagtcagaaatctataccctttccctactctcagatatcctttttttaactgtgatttggatctttctgtcattctttagtcagtagtttccaataatatctgacaactgggggtgggggtgggttaggatagagataatgaaattttgttcctttttatttcagtcatcaaagataagccctgtggcattagcttggtttattatgcaactgtggaagatctagatggcatcaattgtattcatgcaatataatgatcaaaagtggaaagatataggttatagtttgtttccatctgcattctaataaattttctcttgttcttcaacgatctggagatgtgaaagggtacacatagaaaacagaaacccagaagttcatccttgcaggctacaactgggaaaggcagccggcccctgagtgggtaggaggcgtgttctggcctgtgtccctacatctcttaaagctcaagactagttacttctcatttttatagtcacagttttccccgttgctattcttttcaagtgctttttgttcttttctttattctttttttttttaattttatttagggggtcgggttggggtgggggaaaggagggagaaggatttccagggagatgaccacaacattccgagaagatgaatacacctataaccctaaagcaggtctcctaaatatttggtagactgcttatatccctaagctgttatgtcttcaaggatttttggaaaaaggattttgccaattaaaagagaccacattcacccaaacgttagatggttactctagttaacatctgggctgcgtcctgacgtcagggctgtggtgatgaagtccagatgttataacttaacagtgtttttgttactcctaagcatttgctgcctttgagtttttttccccagactctaatttactaatacatgaaggttattaaaaaagagggggaaatgaaattagcatatggcattgactcagactaactgaattcctcctcttcctaagcccactctccagccatcacaggatgtgcagcctggggaaagcaggctccaggacttgctaagattaaggtgtttgcattcaattgctattttcggttaaaacaggtgagatgatttactaagtcttttcagtttagtatgatatggtaaggaaacagaaaaaggaataaaatcaattgtaaatattccacatttttgatagctgttttccctttaatctgaattttgtgtcatatgtccatgtgcatacacctatgcacatatctaaacaccacacatacaatcacacacacacacacacacataatatgtatttttctagaggagaaccaccacttacacaagaagccatgttaaagcaagtcctctcacaatgaacgaggacatccaatgacaatttttaaaaaggcattgttactctctgacatctgtgcaagaagcaaagaaaattaccaagaacagcttcttccttcaaatctcattttagatctatgtctattaatttatctacaaaatttgcatgactattcttatttttaactgatttcacttcttatgctaatgaattccatatgagctttcttacttgatattaatggctcaactttagttcttacaccagtccaggagttaacccaaattctgtgtatgttattgcaagttttggggacttgatcatacgatggcttctcatttcccttaatccactggattactgtttgtgaacctattctagcttcattataatgtattttaaggtacatgatactttaacagtgaacacagaagggtaggattagctttcttgtttgggttcttgataaaacttaatgttttctataaataagttctgagccaatttaatagacatgtggctataggtcaagacactcttcttcctccctttcctgtgtcattactatttggtcagagaccttaagagggcacgtgtaatggaacagttctttggagcatgacgtaaatcttttgctcatttttccacatgatgatctttcaaatatttgaaagcaagcaagagagatatcctcttaaactccaggttatatatccattattgcaacattttcttactgagaaagatttctaaacagtcccttctagatactttctagtattttaatagcccttagtaaataagatactatacatctgctctgagcaaggtagaatacagtaagattttttcttcccttattctaaaccatatgaccgtattaacagcctataacagcaacatatctgttgtctttgtatcacctataccgcactgatggttcatgttaagcttcttaacaatgaacaagagttcttagaccttccctctcgtgcagcagggtttggaggtctttctgaagcctaaacgtgagtggccctttgtcgcagttatatctaatgctgctcattttacatactcctctctttacccatcactggagactactgagataattctgattccttctctcttcatatatttgttctttgtcttagttttgtgacacccatagattttataagcatgtcacttgggacttttaatcaaggactttttatttaatttaatcaaaatgttacttaggacaagttcaatgacaaaattagagaattttatccaggcacacatccatatccagtcaataatcaacagtcttaaaggtcacttgctccacaaaaatatgactttattcaatgtcccagcatctgtcctgtctaaaagaatatcactaaagcttagtaaaatgcttttctggtatcccatttcccttatgtaactttataaaaatgtatattattaagaaattatttttcatctaattcattcatgtttcaatactttggacccaactatgttgtctctaataataattattatagcttatatttgtatagtgcttaaacataaataaccctcatggaatactttcaaacagattagggaaagatatgggattatcccccattttaaagatgaagaaactttggttcagagaggtgactagaatttagatctcatgattttgagctcagttatttttatttccatgaccccacagctgacaagattcaattgtattttactcacatagtcaggtactcaatgaatatttttgaatagatggataaatttatccaaaaggtcctgtatccaaggaccttgcctcaatgcagtttgtcatgtaaaagaggtggaaagttgttgccagaataaaaactaaaattataaataaaatatataatttttacagactttatatatggcccatacaatgattaggactatatttcccaaatcccaaattgataccagattggtatcaatccagtacgaaattgccaataatcagcagcaaaatgagaaaaacaagggcaattgctatgggctgaattgtaatttcccaccctgccccatcagcctgcagtttatatgttaaagctctaaccccgatgttactgtgttaggagataattggggtaagtggaaggtataaggaggtaagtgaggttaaatgaggtcataagggtggggccctaagccaataagaatagtgtcctcacaagaagagaaagagccagtaggagagtgcacatagaaaggaaaggccatgtgagaagacaagaaggtggctgtctataagccagggagagaggcctcaccagataccaaccttcagggtaccttgatcttggactttcaagtccagcactgtgaaaaaaccactgaatctgtggcattctgttatggcagccccagtagacttacacagcaatgcactgaattttcttttagtattaaatgtagtcatcttaaagccttatccattattctatccttcttgcttttgtattattaaaatatcctcactcttatgaaattatggtaataatagaagcttgtttgggaagatgtggactaaagtaagtactttattttttctttctctctctctctttctttttttctcattaatagcaacttccactctgcttaaatacatgcttaaatctcttctatcctggcattctgttatgggagccccagtagacttacacagcaatgcactgaactttcttatagtattaaatttattcaacttaaagccttatcgttattcagtctttattgctttggtattattaaaatatcctcagtcttatgaaactatggtgataatacaagctagtttgggatgatgtggattaaagtaagtactttactccagaattaccataacaataattacctatctaatcctatgcctttaagggtttataaattttatcagtctaggacatccagaactctagaagtcattggaaaagagcatgggagtgaagaaatgatactgtgtgggccagctgacttcaaccaggagaactctttgaactatagggaactctccaaggtctttgcagaagcttagtggagcagatggggacaatattgttctatcagaaagcagcagtatgttggttaaaaagtaatcaaattatatgaaagcaataaagaggcaatatgaatggagagtcatttggtagaagtttatatggaaatatttatttaacaagtacgtattgatcctattccatgttccagggattgtgccaggcaatggggacacaacaatgaatgcaatccattccacgccctgaagggtctcactgtccagtactggaatagagcaaggggacgtcagtgatggaagtggccacaatgtcccaaagcacttcaagggagaggccccccaagccatcctggagggttctggcaggcaaaaacaattcaggaagagtggatgacaggtggaaagacaagatatgggcaagtgtgtgaaggaagtggtaacctgggtggagacttgtcacatggagacattctcctgagaatgaaaaagaaggatcaatggggataatttaggatgggaaaggatgggtttatggtatgttgtggttttctgttcattgttgttcttgtgattttggtttgggttgtttcttaatcaggatggaagagactttagcatgtatttaagcagagggaacgttgctgtaaaagagaagacagaaagagaaagagagagaaaggaagaaataggttggaagtctgagaaaggaataagaaaattgttgaatcactaattcagaagactgtgtgaaaggcacaagtgaagagagccttggctaggaggaggaaccaccctgagactgatagaaatgggatcacggtggcagtgggtaccatgacaaggagtgcctggaagctgagatagaggataccaatagtctcaactctcttaatgcagtggagacaatacagtctgctgaaaatgagtcagggtggccggacgtggtggctcacacttgtaatcccagcactttgagaggctgaggcgggtggattgcctgaagtcaagagttggagaccagcctggccgacatggtgaaactcgtctctactaaaaatacaaaacaaatagtcagatgtggttgcaggtgcctgtaatcccagctactcaggaggctgaggcaggagaaccgcttgaacccaggaggcagaggttgcagtgagcgaagatcgcgccattgcactccagcctgggcaacaagagcgagactttgtctcaaaggaaaaaaaagaaaaacgaaggtttgagatgagtggggaaagtttagaggcatcactgaggaatggaaagtgaggagtctaagaatgagtaaaatacccctctgaggttagggagtaaatgagtaaaatagcccctctgaggtttgggagttccaattggtaatgatttctatctgcaaagctgtggaagtttctacagtggtaattagtcatcccagggagggaaaaaaaaggtgaattgcagctttaattcaatgtggaggttttcctggttgaagatattgagaagccaggataccagggaatggagaatgcgtgttcaagagtaaaagactggctccacccagctgtggagagggagacatgggatggaaggatgagatcagaatgcgttttcagggttgaggacttctgaaggaagcaccccaggggataaaaagatccagactgctgctcagtgatggtgctggaattgcagggttacaccatgtggggggtgtccgcagagactttgcctcccacggtgaggctgccaaggttggagttaaagggaagtatatgaacaaaaggctagaatctttaataaataagggggagtaactggggattggattgacatgaacttgacggcctcacttcaaaagagttgggagaataaggattgggaaacagctcagagtcagagagtctttctcagagtcagagagtctttcttcctgcaactaacctaatagaatatggaagcaaaatgaggcttcaggaaaagaggtttgctaagggggaagccaagtctccaataggaccaacaggtgcagaagctgctgcaaaaactgtggatataagagagtgtgttatcaattaaatatgatgtcaatggtacagagaaaggggctgggaagagaaggggagcaaagaaacaggagcaaaggagtgctggacaacatcacaaggaagtggttcatttaacaactgggcagcttccctgtgcaaaagcacactgaggactgagactaaccaggtgcctgctttcctggagcttcagttccaaataacttgcactgtgttttgtaactaaacattgtagacagccgatgcatggtttcaagctgtaaaactacagctaatcatttacatattgtttattagactcactgtaaacaacatcccattaaaatgaatatagaactgaaaaatgcttttaactttgagcggttatggatagcactatggggccagctataatattagtaaaatatcacatggtttggttaggaaattcttgtagcacgatggtgagcctcaagtctatgataatcagcctggaagataaagcagttctattttttgcacttgtttgatcatattttccacatatcttcaaagacaggcatttgcatggtgttagggcagttaagcatagtggttatgggaaacggtatcatgcgacaattgagagcatggatcttggagataaacctgtgggatttagatctccattctgtgcttagaatgtagggaattatgggcaggatacttaacctctctgggctttggtgtcctcacctgtaaaatggaaaggatatgaatacatctgtctcatgaggttgttgcaagaattaaatgagtcactaaaaataaagcacttagaatgctgcctggcacactggaagtcctaaataattgttaacaactaccataattgcatagagcatgccactctttgaaaggtattgtgtcttctatagttgatactgctttgcaaagtgttggctgtactagttttgcaattgtacttctgacctagtaacaactgtgccaaattgcacaagcagatagtaatgtctggcagtgtctgaagttttcactgctaatggaacaactggaactgacttttacttggcatccaaccaatgaattcttgccatcatttcagcaatatttttgccttttgtctctaatattttcagtggccatgcactaaatacttataaaaagcagcttatttctttctgggcaataggtgacgctccttacaatgtggttgagagcacaggatggcattcttgttaacagaggagtctgtttctgcctgtatttaagagagacactcagtctgggttttgctcattacagttttgcaatccagggtcacttctaggtggggcactctactgacaacaaaacaagcatgaacagtatttatgatctaaatgatggggtgcattggccttatgatactgctttattcattcaacaaatattagaaatatgtctcagatcctctgctagatcctgggtgacagccctactctgtagactatctccagatagttaaataggaactcagataaatgtgataaagatgttagtgaagcaatggcatgcaagtgggtgtcaggtgatggaatgtggtcgcgtagaaaaaaaaaaaagcatttgtcgtactatacctttgtaggtatctttattatgaacctgatgagaaactgcattgatatgaattgctgtgaactcttcattttcaaatgctttctgagcatcaaattctatttcagatgatcacacatacacacacacagtcatactctctccttctctctccgtaagaatgccacatgagtgaatctacgcagaaaaaagaaaaccactctatatgttgaaacattaataacttcacactacactaatagtatcatcattgacaccttaatgcctaattttcttttgggccaatcaatctcatctgaacagttacctggcaatcttataaaataaaagaagtgtaagatatttaaaagacgtgctttctgacttttaaaatcaaagtaattttcctccaaatgaaaaatattccataaataaaaatgtgtatttaattcaattccttcctgcctttaactcgccattattgcaaacagcctctaaaactcttctcagttctaggtggaagtgttgctggactctctaagtcagccccattgccttctgtaatattatgttgtctcaggaccaccaccctggttcatgttttatacttttcttcagcttgtttaaagtgttcttgtttaaagcattttaaaatagtttgtggctgggcatggtgtctaacacctgtaatcccagcactttgaggggttgaggcgggtgaatcacttgaggtcaggagttcaagaccagcctgtccaacatggtgaaactgcatctctactaaaaatacaaaaaattagccgggagtggtggtgggcacctgtaatcccagctacatgggaggctgaggcaagagaatcgcttgaacccagggagctgaggttgtagtgagctgagatcatgccactgcactccagcctgggtgacagagtgagctctgtctcaaaaaacaaataaaataagaaataataaaataataaaaaaattttaaaagtttgcatttatctaaacaatttctgatgatgggagtggtacagtatcttaacgtggatttccctaaagaaaagtccctgagacaaagattcaggtggaggtagctcatttagaatgtgttcccaggaggcacaaggaagaatgagagggtgagaggaagagccaataaagggttaatgagcagatttctgctgcggctgtgcattgttttactattgctgcaaaaccacctcaaaacctagtggtgtaaaacaaccacttattgtgctcacagcttctgtgggtcagaattgggataggcacagagtgcctctgctacacaatgtccgggatattggccaggagagtttcaaaggctagggttgcaagacagctagaggccagaatcacatagaggtgtctttagtgcctgctggttgatgcagacaccccagtggggcctcaacggagcacctacacctggcctcttcctatagcctgggcttcctcacagtgtggccacctcagggcagtcagacctcttaaaacaaggcccccaaaacaaacgtcccagggaacaagaaaaactggcatcacttctttgacctaaccttagaaatcacacagctacattctgttggttacaagcaagtgatactcctgccttaacataaggggtggaaaaaaataaagctcaactcttgaaggaagttatgtcaaagaatttccagcatttgttctagaaacaaaaacaagaacaacaaaatgttggcatagtataagcaaccgtcttccttcttgcctggaatggttaaagtgagtgaagaggtgtgagagggaatatgaattaacagacaattacaatatactataacatacaggtgataagaaacaaatatgtcgaaactataattggatcacagtagaggggcatgtttatcttggccaggagattcaggaaaggtgggtgagagtccatcagatgaagaaacgtagggaagagatttttaagtggaaggaataaaagcaatctcttggtgtgtgcaatttggtaaagtgggaggaggagagtggcagataaatgtggaaaggaggccaagagtggtggctcatgcctgtaatcccagcactttgggagactgaagtgggaggatcactttaggccaggagtttgagaccagcccgtgcaacataacaagaccccatctctataaaacaattaaaaaggtagccaggcatagtgctgcacacctgtagtcccagccactctggaggctgagaagagaggatcacttgagtcccagagttcgaggctgcagtgaactatgatcgcaccactgcactccagtctgaacaacagagtgagatcctgtctcaaaaaaaaaaaaaaaaaattggaaagggaagatcatgaaaaatcttgaatatcatactgacaggcagagatctgatttttaggcaatggagggtccttaaaagtcactgtaagtatctaagagaaagattatcatagcctgaaggaaggaagtatagctaaacagtagggaatgggtttgaaaaatatttagaaagtaaaataattagtgcctggggattactcaagtgtgtgaagcacaggaaagggagaagtcaagcttcacaccaggttcctaccttgggtgcttgaaggaatggtggttcccccaggtgaggaatttcctaagagaagcaggttacagaggaaaagagtgagtatgaggtgcctgtgacctccacagatacacaaccccaggacaggtgcatatatgagtctaaacttaagagagagggacagtcaaaagataccaattacggagtcatcaacaaataggaagagaatgagattgtccaagaatacatggaaagacagagagcagctcttttggcccttggaatgcagatgttgctagtaacttgatgttgttcgcagctgatgacctcaattttcttgatgataaggaagacaaagttatctcttgagagaaagtggaactcaaatactgatgacaatttttagtacaacagtgacaaagagaaacaaagatctagaaaaaaagaagaaaatatgctctgttagtgtcatgcaagtcttcatcattgttcctattgttaacaaaccctttccttgtactctaaaattctaaccctaggtctctaatttttctcacatggctgtacaaaactacctgagactggacatttatacagaaaagaggtttaattgactcagtttcacaggctgtacaggaggcatggctggggaggcctcaggaaactcacaatcacggcagaaggtgagggggaagcacatcttcacatggtggcaggagagagacaaagagtgaaatgctacacacttttttttttttttttttttttttttgagacagagtctcactcttgtcacccaggctggaatgcaatggtttgatcttggctcactgcaacctccagctcctgggttcaagtgattttcctgcctcagtctcccgagtagctgggattacaggcatgtgccaccatgcttggctaatttttgtatttttagtagagatgggtttttgccatgttggccagggtggtcttgaactcctgacctcaagcgatctgcccaccttggcctcccaaagtgctacacacttttaaacaaccagacctcatgagaactcactcaccatcacgagaacaacaagggggaaatccaccccatgatccaatcacatcccaccaggtccctcttctaacatgtggggattacaattcgacatgagatttgggacacagcatcaaaccatatcagtcctgctcactaaactggtaaaaaaaaaattgctaaaaatgttaaagtaatattttccataaccttgggcaccctcatagttgatttcaattccttctgatttacacacacattgaatcatcactaagcaagaaaatataagccttctccaatggcaacacctgtgtaaacctattgaggagaccaggcacaatggctcacacctgtaatcgcagcactttcacaggccaaggtaggagaatcgcttgagcccaggagttcaagatcagcctgggcaaacggcaaaactctgtctgtacaaaaaattaaaaaagtacagatgtagtggcatgcacttgtagtcccaactacttgggaaactgaggcgggaggatccattgagcccgggaggtcaaggctgcagtgagctgtggtcatgccactgcactccagcctgggcaacagagagagaccttgtctccaaggagaaaaaaaaaaaaactgatggggagatattttcttttttcttttcctttgatgtttaggattcattattctaaaacatctcaacaatctatgtgtgtcagaaatggtttccaacagacaataaatatagactcctcctatcaaccttcattaccacaagaaattcagagtattgatgctctaggaaagatgccttccctagagaaattggcagaggaacagaatgaggactaagaagacaagatgaacaacctgtttatatgaggacattactgccttactcaacagatacgagcagtgtaacgatggtaatattggagtgcatgagtgttttacctataaaagagatcctcctagttaaaaagagctgaaaaaccactgagttagataatcctaatccatggataatccccacattttcctttaatggcttcatctgccacccccaagaaagcttccatccaagctctgaacgtgagccaaatgggcagatctgagttttgccccctcttaatgaagcatggtaaatgaccacaaggcaagctgctaagagaggaaatgaaaggaccccggggtctggatataccaaactggctaattggcccctgaaagatagtgagcagcgtgttaatgcctcttgtgtcctaacagaacagcaggatctccatggaagaatacctctccaactgggaggtcaccataaaagcaacattctcaaccggcatcctttgtccctgttgaaagccctgaaaacatttctgcacagtgttactttgccgtttagaggacttggatgcagggtgcagagaaggaaaggaaaggcttttcatacatttcctccgctacattcagagactcttactgaaatatcagttttaagatcttccttttatagtctacctttgaacctgacctagaataccaaacacataaaaaaggtataagggggatggaaaaccagaaactgaggaaaaggaaaccagagggaaaaaaatgtaccccaaatcaggttggaaatgttagcatgggaaaacttctatacatgtgtgatgttgcctcccatttgcccacactaaagagtttacagtatgtatttgcataatattatctccctaaacggccttttcttaatgcttaattgaaagcagttctcacctctggatactttctaagcatctacttttattccaagtgagtagaagatcaaagtgtacatatagggatgttatgaagccacagtttggcctccaaagcctccttattgaagggcagtattcttcagatagaccttgagtccatgcaagaatgtaatttaagtgtagaattatgtgactgcagcaaagctcagctgctccccttcttttctccctggctgtctccctttctgtcttcaggatttattccccttctctctcaaccccttctttggccttccttgctctctccttcttagcctcctgaatctagttagaacagagagccaaatagtgtccaaacactattcatagtttaatacacatagcaccaggaaaggctcaggttttatacatttagatattttcctcatttggagcaaagatatttctaattaaagaaaatatatatatttccatttgaatagaaattggccatcaccaacttaggcagtgaaagttaccttaagaaaatattggccaggccagatgcagtggctcacacctgtaatcccagcactttgggaggtctaggtggaaggactgcttgagttcagaagtttgagaccagcctgggcaacacagggaagcctcatctctacaaaaatcaaaaaatacaaaaattagaggggcgtggtggcatgtgcctgtagtcccagctacttgggaggctgatgtgggaggatcccttgagccagggagatggaggctgcagtgagctgagctgtgatcatataactggactccagcctgggcaagagagagaccctgtctcagaaagaaaatgtacatatatgtgtatattagtcgagtgatggttgcattctttttctccaccaaagttaaaaagatcttgaggaagacatttgaggcagatgaaagttattgtcacgtttcattgttatgttcctttgaactaccagccctttcttcacctttgaatctgggctaaatctcttgcttctacagctttttctgtggtttagaggaggacactactacgggaaaagagcaagtccagcctggtaaactgcacagagatatgcccaggtctccagagacatctacttgaggtgtaacttccacagtacgctgaagtttgttcctgtggaagtttccatgaggggcttaaaaaaaaagtccccctaatcttgttcccacgtgtctactgtgcatttgaagatgaagattatttatgtttagagagcactgtagacacttagatacctctccagcaggcagaggtctgaagggtgcactaatgtttatcactggcaccagaacaagcattacagaaatgcaagctccttggcttacctcccaaattctgctttccctcctgatggacttcaagccactttgtaaattgctttgttgtttgaggagtgcatttctatctgggttacaattctgccggagtcaatattttgacagtcttcttctggaaaactccccatttctaatatatcaccccactggattctcctttgaagttggagaacatagcccaggcctgagattacatatcaggattatctccctcttgaggtctgtgcccctgtatgagtgtgcatatgtgtatatctgagctggttaattttttcgttggttgcttagagcatggtataatattggcctggatcctagactcagtccctgaacattacacagtgaaaaaagctgatcacagccgcagatccagctcacccctaaccactcacttggcaattatgtgcctgtgatcagtctaaaggatggaatgaggaaccctagtccaggcttgcctacctgcctggtccttgtaacccaactcaacactctgtttcagttatcctggacttttcactattccccacatatctcgtagcaattcccatctttgtgttttgacctacacagcatcccagtactggattatttgccccgctcttccctgaggatttaatactatgtgatatacagtcaagctcttactctaagaagcctccccagccatttgcacctaacaactgctcttgttgattctccacagtgagcactagatataacatattgccagttgttcttcgtagactggagataagaaacctatgaccccagatacgcacactcaaactgttcttacccaatctcctttttatataaagcaagaaagacaaaaaccaagtgattgtatattcagaacctgacttccaaatcacatcacactgccgagttttgtttcagctttccagctagactgtgtgccctgacgccagggactgtgcactttccccctacaccccccacaccatctggcagagtcagtgcacacagtaggctcagcaaatgcttgctcagcttctgattgttcccaggtaagcccacgcccctcctggaagcacgcgtcagagagcatacacatcacttgagaggaatgatttttacagcttccagggcatcagagtaattccagttgcttactgtgtaacccagggccacagctgggcaggatctgccccactcagtgactcccagcctaggagagacctgggagctgaaatctaggctgatcctcagatcgccaagtcctggaggggagctgattaaggaagggaggcctttttctaattgttaaagggtactgataacttccctaaggcacacacccacagggcaaaggctcctgagagagcacttttttttttctttctttctttttttgagacagggtcttgctctgtcacccaggctggagtgcagtggcgtgaacgtggctcactgcagcctccacctcttgagctcaaatgattctcctgcctcacctccccctgtagctgggaccacaggtgtgcgtcaccatgcccagctattttttgtgtttatttgtagagacgggatttcagccatgttgcccaggctggtcttgaacatttgaagaggaaggatgaccaaaattagtttgtagagctaataggctttagttttatattattgcagagtctagggagggagagatttatattttaaatttcccttaaaatcatgaaatacatgccttcaaaatacatatgttaacatacgcatatatgcacacatgcctgtgcatgcacacacccacatacacacatgaggaactggatttaggataacaatggggataaatgcaaagctaaatgtttcaaaacatagagctaccaatatttgttaatttactccaaaggatgttaggatggcattttcacctgttcgtttctttccttcttttctttctttctttttctttctttctttcttgctcttgctctctctctttccttctttctttcttttctttctttctttcaatatatgtattaggtaagtactatttttaaatgatctgttataacccaggaagagatatgaggcttcatattctctggtctggagataccacaaacatttccacagtgtggtcagaaaagccagcagcatactagaaaacctgaacaatagaaaaagcttgaccatctcccggaatagcatatgtgcatcctctcataagtgggagctaagctatgaggatgtagaaacatgcgcagtgatatagtggagtttggggactcaggtggggaggtagggagggggctgagggataaaagtctacacagtgggtacactgtacattgctggggtgatgggtgcaccaaaacctcagaattcaccataaagaagccatccatgcaaccaaaaactacctgtacctcaaaaactattgaaataaagaaataatcatcataataaaactgaactggaaaaaagaatatatatatgaactcatttaactgaagttcatacataatcacaaatacatatctgtgtgtgtggtgtgtgtatatacgtgtgtgtgtgtatatatatatatacacagaagctgatatatatgtatatatgatttatatatttatatatatatatacacctatatactcacatatatgtgtgtgtgtgtgtatatatatatatgtatacacacacacacacacacacacacacatatatatatatatacacacatcctccccaggatcattgtgtatattttttttccactgcattactggtccttagaaaaagagtaagcaaaacaacagaagagatataagcacttctgtatgagaatcatttttatataatcataaaaagttaaagttggaagggacctcaaagccatctaaacatcaatcttctcctgtcacagagagaaatttgtaatctgaaaaggttcagtgatttatttttcatttcttattttagagacaccaagttattttcaggatctaacatgtttcctctttcctccagattcctggaagccaggaacacctagctatagctttgtttttctagcactgaacacttctcatgggcaagtagcaaattcacccttttagatggatatgaactcagaatattgatctcaagttgtatttattttaataaactcataataaaaagttggaatcattacgtatcacacaatttatcccaaatggccctaatttatttttttggaccatctccaaagcaagtacagtaagatttacctgtctcagagttgtaacaggaatattgtcagagttcagtaagttctttaaaggacccagaaatctgtggttcaatacaatcaaatacattgctatttttcttttgttcactacactaattattgtccataatttcctgtgggaatgggtaaaacgactatatggacaaggttgataggctaattagtgaataagagattttaagattcaattctgttttcaatgccaatttacaaagaggaacagatagaatctcataatcacatctcccattacttaaagtacaatagcgctattcactgacgtcagataatcaacttgaactaagattgttaaaagaaataagttgataaatatagtcgttaaagtctatagaaaatcaagaatatgtaacagtaaatgttggaaaagtgaatgaaccttaaagaaagtatatccaaagaaagttttatacattccttgatcttacaaaattttatattgccaaaaaactacaatagattctaccttcagtattcttttaatccttaatgattgtttctatgtagttttaaatgttttatattcacagaatatattttagatttgtatagaatttgaaaaatgggttccatactaacttcagaaaatttggttaatatcttaattatagttttttttttaaatttcactttgccttctattacttcttcctgcttcttactagtagtgttttatataataagtagcaaaagctctagtcttcaatctctctgaaaatagatgtcagctatttatagtcttttcccttccatcttgctttaatggacacttttaaagctgttagaaattaaaggtcaccatggctgaatgtgtatgtggcaatttgtccaaattaacttattactgtggtcttgtgagtgaacatgagccatctggctccatttcttaggaaatatcttccaagagaatgatttctggggcaagatttaattatctttcacctaaaaaaaaagctctatagttaccctgtgagttaaacccatggattaattattattaaatttcagttcaggaggatctttcttccatgtctcatctgttttcatttgtacaagaaaatagacccaaatctgcctagaatagctacttttagaaggaggtttagaatatcacacattgaagaaagttgtcattctgctaaattgaagaaagcgaagagagatattgaatatacacattttcttctggccataagctttgaggagaatgtaatccattccctccacattttccttgtatttcctgaattttaagaaggtaccagctttaaacacagcttttagttgttactatctcactatgtaaatataaacaaagaccactgttgtcactggcctactgagtggcctccaaagtcaatatgacactaggtagttcattttcacctgccaaatagaagtaaaagataatcatacctgttctttcaattgcctcccagcttttcacagctaaatagatataaaatgcaaccaaattcaaatgtgcttttattattaaataattggataagactctatcacaatacaaaaatcaccaaaagataacagctgtcataactaaattgattgtaataaagaaaatcaaaatagtaacaaatttaacagacagagctagtcagggctacaggccctagaatcagtctttgctctccatacttttactaagggtctcaaaatattttctgatttagtttctttttaaaataatacgattcgtaaatcagttgttttgttttggttttctgttttgttttgtttcttaagacaagtctctcttttctttgccaagatcccataccaaaaataatccccaccaaatttaacttttcagcattcatgagctttatccgatttaatgtggcttcaaattttaatccatatactctccagtgttcatttgacaaatgtaatttatatgcaccattattttatctcaagtagaaccctagacaagatgtttaaaaaaagaaccagtaaaggtattctaccacttaacagatgttgccctggctagattccctcactctaaaatggaagtgctaagaagtagctttcttcatttgtaatatctccttcagatttcataggctaagtgcattgtcttaaattagctacatagccaaaacagaagacaaattaaggctgatttcaggatgctaatcagaattaaactaggatatttgtgtaaacaggaaataggcttgaaatagacctatttcattttttactgaacctgcatttgtcttcaactagtagatgaggaaccagtatctagtttacagttaatggcatgctgctatcagttttgttttttaatacaaataagttacatgaaaagtaactacagcatgatccaaagatctatcttgacttggccttaagctttgagaatgcaatgcattccctccacattttccctgtatttcctaaatttttaaaaaggtaacagctttagacccagcttttagttgttactatcttgctttataaatgtaaacaaagactactgttgtcattggcctactgaatagcctccatagtcaacaagacactagatagttcaatggacttgtgcatactctgttttcaaaataaagaagaaagaaaaaagataaacattgaaaacacttgcttcttgtagctcgtgaatggttgagacttttgagacatttaatgttatactagcctcagagaaacacagagagacgataaacaaataaaatccatctccctgcaaccagatccccagttcaagactctctagccctatggatttgtgatacatgaaggttgtatttatttaatacccaaacagctgatgaaaaagagtaatttaggcatatccaaatatcaaaacattgtgttgacaaaatatccaggtggcaagccaaattgttttactttcattcatgtgtttaaatgttctattgaaattgaagcaatgtgatagaagatgtggtacatattgactatgatattatagcatctttatttgaaatttctctggagtacattcttatcctatgcagattctcttttgtagaatatactccatgattggaataaaatattaaaaataatattcggcccttaaaatatcttatttttggaggaaaaaatttaactgttggggaaaaaacatattaaaatgtattgaaatctcttccatataaaaataagagtatctgtcatgaaatgagggtaaaaatggccaagggttgtaaaccggagttttcaaatatctattttgcaatagtcacaagtgtgaatatacactactcttttttttttttttttttttttttttttttttatacagagtcttattctatcgcccaggctggagtgtagtggcatgatctcagctcactgcaacctccacctcccaggttcaagggattctggtgcctcagcctcttgagtagctaggatcacaggtgtgtaccaccacacccagctaatttttgtatttttagtagagatgggattttgccatgttggccaggctggtctcaaactactggcctcaagtgatacatccacttcagcctcccaaagtcctgggattacaggcatgaggcactgcacccagccacaaatgtgaatatatgcaacatttttaatgattccttttgttcaatatttcattatttattccaaaaatgttattgattagtcagggaaagcaaacaaacagaagatctttatttactttgtgtttttacaaaaaaagttgaatctatcaaaagaaacaatgtcatgagaaaaataactatttctaagaactcatctgagactataggatattttcatggatgaaatgatttgtatttgagtctaaaattccagaattgatgaagtaaacatcagtctcttgaactgccaaggcaatattaatgtcacttgaaatgaatgtgaatgtcagagaagcatccttctagctagggctctgttgtcatgccaagactgtagcagaggcggggcaccgtggctcatgcctgtaatcccagcactttgggaggccgaggcaagtggatcatgaggtcaagagatcgagaccatcctggccaacatgtgaaaccccgtctctattaaaaatacaaaaattagccaggcatggtggtgtgaacctgtagtcctagctactcaggaggctgaggcaggagaatcgcttgaacccgggaggcagaggttgcagtgagccaagatcacaccactgcacaccagcctgggtgacagggcaagattctgtctcaaaaaaaaaagactgtagcagaatcatcaggttggaatggcaaggaagtcaaaatgcttcaatatttaccctgtgtgtgtgagcgactgtggaggaagaaaacctgaatccacacatccccaacccaatcttcagcatcactggtagacagctgtctattcccccatgcttcaagcctgatcattcccttcgtgacattgttttgccactgaccctaaattgtctctgctgcagacaccaaaggccaagtgaaatgaagccacctccttatttcagagcacaactgcgaccacactgaccaaagaactgagaagccatggatggctcatgaaagtcttaaagtgaacaaaagtaaacaaagtaggcctcactggatgtggcaggtaaacagggatttcagcaaacatgaataatgttttctggcgaccccaacagctggacacaggggcctataaaaatactcactgagattcaaaaataattaagcatatctacatacaagaaacgatggttctaagtccatgcttttgcagagaccttttaaagattgtttaaaaggaattcacaaacaattagaggataagacattttaaaactaatctgatcacatcgctgtgctcaataatgtatgccttgtgactttagacaaatatctcagtctcctcatctgttaaatggaggtggacaaggtaactactgcagaacttccctgctctaacaatctttgacttgcaatgcacaagaatatgtagaattgtagaccaatcaaaatgaaagaaaagttcaactctttgcttgtctgtcttctataagttttcttcaagaggcatgtattccttttgtaaattaggaagtaataactgattcgaatcattttttaaaatgtaaaatatacaggaatagaaactctagaaatcatctcatttaacaaaggagatcacagaagaagaataaggtttggtaatttgcccaaatgcacacagtcatcagtgggaaatctagaagcctgaccaagttcctttgactccaaggttaatgctctttggtgacacatgaaaacattaaacataaaatggcaatcgtttccatcagttaagaagaatgaaaatcccgcacttgattttttttttttcatcttcctgtcaggatttaaaaggcattgaggcctagaaataaaactaagaatttaaagaacttgaaggccagggacttatttgtaatgtatgcaactcctgcaacagaccaggccccacttttgtctgtgctgtatgtactggtccagattccaaagatccctttcctctcttcccagctagccatacaggtgtgtgacacagttacccgccattcccttctccacaccacaagtaaagtgacaaacgcctaaatccctttggtgtgatgtttcttctcaaagcaatcctgaaaatcccatcgatcaaaaatctatatctgggccagctgcagtggctcacacctataaccccagcactttgggaggccgaggtgggcagatcacctgaggtcaggagttcgagaccagcctggccaacatagtgaaaccccatctctactaaaaatacaaaaattaggcgggcatggtggtgggctcttgtaatcccagctactcaagaggctgaggcaggagaattgcttgaacctgggaggtagaggttgcagtgagctgagatcacaccactacactccagcctgggctacagagtgagaccccatctccaaaaaaaaaaaaaaaagaaaaaagaaaaaagaaaaaatctatatctatctggattgaagccacttttatatctactccatttaggcagcctctctcccctaaatgcctcaagttatcaaaacctgaaagaggaagagtgatattagctctcctggattcatgccacctaaccttgctttatcgtttgctttttaaatttaacaatatcatgaaacaaacatactctgacttttgagggaaaaggtgtaataaactagcaaaagcaaattgctgtgcaaatctggttggaccttacaagatgttctggactcttagctgctaccctttttacttgctctctgttgacaccagcagatcttgaacaaggtatttatgaaaatatcctacaatcactatttactggctacaagtaccagaaatggtttattggctagtattaggaaaacatcaaagtcctttcttagacaatgccgtttctcgcctgtttggtgtgcatgaaatcagtgaacctcataaagtagcaaaggctcattaggaagagcaacaaagttcccagtgtcctttatgagcctgcagctaccacagaagagatcaaagcctccatcagtagtgtctgtgcatctgttttctttttatccaacgtgttatttagttagtagtctgacaacatcaaagctttgggccattagattctttggtccacatgggactaaatttatttttacaaatgcatctggtctaagatggaaatgtttccgataactgcaggtcaccaatttgagcgcagtgaacactttcagaatttattgttagattttaggggccagcttctcttcatcagcctagaggtagagcacttcttagctcttggtaaagtcacccactttcatggcagaaatgtcacatacaatttagaatccaagaaaaagaagtctctctctctctcttctctctctctctctttctctctctcttccttcttctctccttccttccctctatccctccagctttactgaattataatttatatactaaaaagttcacctatttcaagtacacaatttgatagtttttaatgcattcatggagttgtgtaattttaggacattttcatcaccttaaaaagaaaccatatacccattagcaatcattttccattttccccaaaactaccccccaactgagtcctaagcacccactaatcttctttctgcctctatggattagtctattctagatattttatataaatggaatcagaggatatgtggtccattgtgactggcttctttcacttagcatagtgtttacaaggttcgtaatgttgtagcgtggatcaatattgtatttctttgtactgccaaatgatattctgctgtgtgtatataccacacttcatccatttatccaaatgtccagttggtggacatttggattgttgcctctttttggttattatgaagaaagctgctatgaacgtttgggtatggactgttgtgtgagcatgcattttcgttgctcttgggtatatacctagaagtggattgctgggtcacatggcaatgctactaacttttgaagagctgccaatgtgccaaggcagctgcaccattttatattctcaccaacaacgcatgagggttccaatccctccacatccttaccaacacttgttataatctgtcatttttattgtagccaccctggtaggtgtcaagtggcatctgtttgcagctttgatttgcattccccattctgtatgcatggctgatgatgttgagcatcttttcatgctcatcgaccatttggatgttttctcggaagaaatgtctatccggatcctttgtccattgtttttaaagagacagagtctcgctcttgctctgttgcacaggctggagtggagcagcacgaccatagttcactgcagcctcctgggctgaagcaatcttcttgcctcagcctccctagtagctgggactacagccacatgccaccatgctgggctaatttttttatttttatttttattttttttgtagagacagggtcttgctttgttgcttaagctggtctcaaactcctcccaatcctcccacctcagcctcccaaagtgttggggttacaaatgtgagccatcacgcctgaccctttgtccatttttcaactggtttgtctttttataattgagttatgagagtttattatgtattccatatacaattcctttatcaaatatatagtttgtgaaatctctccctccttttacttttatttagatgttccctgctaagtgtgtatttcctttttttttttttatgaatgggaaactccttaaaaagaaatgagtcacaatagaggaaataaagcatatttcagaaccatctgtttgctaaatatacaaaatccccccaaaaaatcccctaataagaatattagaacaagagcttagttagtaaagccatcatggtcacttgagttttgttccaacaataattattcccatttatatacagatttacagtttacaggataccctgatatacatagtctcttgtaagcttcctaatatttctatgaaatattaccattatcccatttaccaataaaaaaatggaggcagagtgggacaggtgataaagacattcagtagactatcttgtcacacttaagttcagcctaaataccatctatataaatgtcaaaatattcagaccaagattcattcaatgaaatataagagccaccaagccagttatgggaattgattttttaacactttattcatttgtatgtgatgcccaaatgtgagatgaaaagtaaaacaagtgtctatgtcacaatagactggccatggttataattacatgacatcaggaatccagaaacttaatttatctttcgtcatgtcttgcaacacgtatgtctaaccccctgaaaagatgcattaatatagggtctacggtcacacagtaaattagtgaaggggtcgagtgtatgtatgtttcactggcagaggctaccactaatttactgtgtgaccatagaccctacatcaatgcatggagatagcctatatcttgaattttcagctaccagtgaagcacaggtaccctcggccctaccactaatgtactgtgtggtattaggcaaatcacaaacctctttcagcccatacttcaccatctagggaatctactaagattcccaatccaagtctctccagtttataggattctgctgcattaaatgatctggatttgggctgaaataaagtacgagacataaaacatatgagcacctggcacctaaataagagagaagtagcaataatgagatggcgatacagttcttgtgggctagtcactaggtgagactacacttggaagaaggcaatttgtttttattaagattatcactaataacaattatcactaataatcactaatatcattagcaataatattaatagtggtgggaggattgcttgaactcagatgctcgagaccagcctgggcaagcacagaattcagaataagctcagtggtcagtccctgcccccgccccctataccatacacagagtaataatgaactatttctcatttgtgcccagttttttgcagaagttttttaaatggggattaacctcctcacagtatcagtccatggtggttccagcatagtctatacccaaaaccatgtttagaaccacttgagggaagctcagaaccaatcaaggctatacccaggacaatctactaaaccagaatcttccctcaggtcaaaagctaagcattttccaggctcccaaagctactctgagtcaatggaacttacagtgatgtgtggcagcaagtcagggtagcctctaattcctatacagagaaagatgttttctgaaacaaaattcaggtcacacttcctgacaatagagaatattgcatacatacatagatcaccctggaaaatccaggtcctacaattgccatatgtttgtaactgccaggtgatgctattaacaccccttaaggacagactagtgacctgctaagagaagatcacatttccagaatttaagttttgagcctgtccctgtaaactggccataggaccaactgtgggaaaggataactgctttctaagtcaattttagcccatatatcagtacttattaatgttaaatgaagcaataggatagatctctgtaaaatgctatgtggttatttgtgtcattcatcatgtatgcagcactactttatctgtgtctctacctgaatattacacaggtgaatataaaaatatatctgaaagtatttctaattttctagagaaatttccaaatataaatctaaaattatattaaccaaagagtattacattcaaatttattaatcaggctgggcatagtggctcattcctgttatgccagcactttggaaggccaaggtgggaggattgtttgagctcagaagttcaagactagcctgggcaacacagcaagatctcatttccactaaaaatcaaaaaaagtagccaagtgtggcgacatgtgcctcttttctcagctactcaggagactgatgtgggaggatcaattgagccctggagttcaaggctgcaatgaaccatgattgcaccactgcagtccagtttgggcaacacagggagaccgcttctcaaaaaataaaaaaataggccaggcgcggtggctcacgcctgtaatcccagcacagtcggaggccaaggcaggcggatcgcgaggtcaggagatccaaaccatcctgactaacacggtgaaaccccatctctactaaaaatacaaaaaattagccgggcgtggtggcgggtgcctgtagtcccagctactcaggaggctgaggcaagagaatggtgtgaacccaggaggcggagcttgcagtgagccgaggccgcgcctctgcactccagccttggcagcagagtgagactccatctcaaaaaaaaaaaaaaaaattaaataaataaaaagaaatcgattaatcaatttttgtaaaagaaaatccttcagccttgaggtaagaaaagcatatctctgctgttttgccaaaatggacctcttctcccatgtgctacatatttaacttaaagttcttaatgcccttctaaccagctgtgaggtcagaaagacctttgcagggggaagggggtgaatgagatatttgccctccctggttgtaggtgccaaccggttgttcacatccactcctgaactctgacaaatctcttgacttaactgggaaatcttcaaatgtaaatgtgttgattacacaattttgagtgcctaaagaatgaagccttttgaaagtgttttggggccacttcagcaatcccacggaaacttgttctctgtcaagaatcacttttaaaaagaagtataatttttttaaaaggcagcacacccacttttacacaagcctatcagctttctatttaaaatggcactgaggcaaggagggaacagacatttctgccctatcaaacatcctctaatgagttgaaattaagtggctgggatcttcaagaattcttcaggctggcctgtcatttcctggtagagataggaaaactcactgaaaacctagcaaagaaaaaaatgactgagcccctaagtgaagagctcatcttccataattgcctagaaaattcctacagaagcttccaactttctacaatttttttagttctgcccttggtggttaactaacgtggtgcataagactagcatagggtaagtgacttggcctttgtgggaggagtaactacagtgaagaagcaggaagagaaaaaatctgtaggcgctcactcttgtagacactgtccatatctagcccttcctgtgcacactgtcctgtgctaatactgaggagaggggaagtattgtttagaaggaagtagctcctcaaggaaggaagtggccagtacaggaaaaacaaagcagaaccttcccagaatagaattcacctttcacctttaacctttgaccaccccttagggctccttaccccacatccaagtcctgtcagacagtgatacacacgttaagacctgtgcctttgtctaagcctgcctttgtccattgttgaatcatgtatatttttccagaattaatgacacgggcatttgtagcccacagatactgcttggattctcaagcccttaataaacagttgagactgtgctgtttggtctcatgatgatcatggacaagttcttctgaccaaccggactgaaatctgctcctcagcaataggatcttccagaaaatgactccctttagcttacatgtctcaaacaaccaatatcattgctatttttataaaagctttgtggttgctttatacagcaaacaattttaattcttttttcccaaaagaatttcagtagcctcatgtgggtaaatcaatagttattcttctgtttacctggatctcagttaattgcttaacaaagaacgatcccagatgtttttgtcaaaggaaaaagttgtttttgtgtgtagatatcatactccctcagaatctgtaatcattccaaaaattacataatgcgatcttgacaacttaaggtaaaatagttgcaaaaagaaatagcttcttacacatactctatttgcctttttattagagttggtttcagacattcttcacatttttaggaaatcttttgatttgtttctgttttagtgtgtaatgtaaaactctccaccttttagtgaaacatattaaccactgaaaaattaaaaacagtatgaaggtaggaatagttgaagccagttttaaagactttaaagctaaaataaattgttcaaattataatgctctactttcatatatatgtattcctaacagaccaataaaatggagtgcttgttgtttattggaaattgacattccaatggtgttagccaaccaagtaattcttttttaaagtttcctacacaaaaatgtgtacaaaggaatgtttttataccaattaatgtttatagtttgttttggaacattaagttaaactaaggtgagttttatgtgttctctttttaccatatttaatgaatatcactggtgggcaatttttcttctagggtttttaatctttgttccatttcagagtaagagcaagggaaagatacaaaataaacacaaaaagaaaggcttcacagaggcaaacagattattgtattatttaaagtgagcatttaatattctttaaagaaaagtacagctagattacgtgcgaagaggctgcacgagatattagccaccaactgaaaaatgttgctgggggcggggttgttctagtctgatgggccacaggaaaaatttttattgaattccaactatgtgtactgctctctacgacaggatttttatatgtagcatttcacattatcatttaacaaacctacagtgttactctctccgtttggcaaagaaaatattgaggcacaaatatttaagaagattgcaggaagtcacataactaataaccgatagaactagaatttcaaaaaaaggtctggccaagcatggtggttcatacctataatcccaacactttgggaggctgaggtgggaggatcccttgagcccaggagttcaagactagcctgggaaatataccaagaccccatctctgcaaaaagtaaaaagaaaaaaattactagctgggtatagtggtgtgtgcctgtagtcccagcgactggggaggctgaggtgggaggattgcttgagcctgggaggttgtggctacagtgagctatgattgcatcgctgcactccaccctgggtgacagagcaagaccctgtccccccaccacagacacacccctcaaaaatttaggtgtatttgaatcccattcctgagctcctcttgttataaccaagaaagactcagtacctagacaagaggatggagtatcacatgaaaataagcagcagaagctatagcaaaactgtggtgagaagcaagagtgctggaatcaccaggtcatgcttagatttgggagacagttttgaaattttagcaaacagaatgtgagaacttctgacagagaagcaatcacacagcaaggtttccaagaggaaaatcaaaagaaaaaaacataatatgttacttagcttttaaaggatgtgtctaacctacataaaacaaaacatcagtataatcaatgaaatactgacatggaatgtaatgtctcaaacacttttagcagaatagctcaaaatccaatacagaataatctattgacagcactgttacaggcttcatttttctaccataatctgaaggaattgaaaatgtgggtttctctatctcttttctcacttatgatagcaaaaagtgagtgattaaatgattttacataaataatgcttttggagtggccctacatttcttgatgtgaaatacctctctgtaatatattctgttacacagaaacatgaacaccaaagtttgccaaatacacatgaattgatgaaaataatacagaggtcttcttagaagtcagaatttcaacctttgttcttagaacagctaagtttaacttctcacttggcaatggtttataatattatatattatataatatataattaattatatatgttatataaaatatagataatttatatattatatataactttttatatactaatatatattttaatatataattatatattaatgtattaatatattttattaatatattaatatattttatattaatattttgatgtattttataatatatgtattttatattaatatattgatgtgttttatattaatatattaatattatatataatggtttatcatatatatatatatatatacacacacacacacatatacacacacatatacacacacacacacacaaaatctttggggccaggcatggtggctcacacccgtaatcccagcactttgggaggccaaggagggcagatcacttgaggtcaggggttcaagatcagcctggtcaacatggtgaaacctcatctctactaaaaatacaaaagttagctgggcgtggtggtgcatgcctgtagtcccagctactcaggaggctgagacaggagaatagcttgaacccaggagttggaaggtgcagtgagctgagattgcaccactgcactccagcctgggtgacagagcaaggctccgtctcaaaacaaaaaaaaaaaaaagaaaagaaaacctttggaagcaatttttcctgttgagtaaaataggcccgtgagcagggatcctggttgtcagccagcttttgagggctcttcccaatctagatgtctctatttgggtgtgctgtctgcgtaatcatccgggtcagtggtgtctaacatcccccatggaaagaatgcggtggtgacacccagcatttgttttgtttgtagggagaacttgtgaaagctaatgaccttagtttaaggctgagaaaacccaatgagttgaaagtggctaaaaactgaagactcaaaagatattccctttattttattgtgcactggagtaacctctagtacccccttggcagaagcctacaccattaaatttaaaatgtgatcacctaacaccctcatacgtggggctgcatttcatcactctgcccacagcctgtcttgctgacattcttgactggctgtgaggctgtcactgagcttgcctggcagggcccacagtcaccctttccaaggctattgatctccatgtgaacagttgacaattctaatttcaaactccgtatatttccagttgcactttgatgctgtaataaatccaaggcaaattatacatatttagttcctaaagtaatgatgtatggatttactttggatatagaaaaaataaatatgctgtgcatgtccccacttctttcctccacagtaacgcagtatttgtaaaacaaatgccataaaaattgagctgtgagtgatcccaaggagtgtctgcttcttttcttaaaggcacaggaaaatagtatttaataataatatcaagaatataatgttctacttgatgtgtttacttattgatagttaaatttaatagttggggaacatttggtctctgctgaaaatatattttgtgctttaaattaatccttacttcgatcaaatttgtagactctaaagagacattcctcaacaattccacctgatccccacttgttacacaagccaggctgctcaagtttctatctttacctttacgtggggcacctttatcctttgctgcaaattcaaattcggattcaaattcaaatttcctttgttctcagaagcccaccttcttcaaaaaaggcttcacaatttcccttgccttcccagagaccaaaatgactcaatgttattgtggtaaaatatacatagcataaaattcaccattttaatcattttaaaatgtacaatccaagggcattttgtatatttacaatgttgtacaaccatcaccattatctacttccagaacattttaatcgccccagaaggaaacccctgtacccattgagcagtcactcccgccaacccctcctcttcccaggccctagaaaccactaatctgctttctgtgtctacggatttatctattctcgatagttcatgtagtggaattaagacagtatgtagccttctgtgtcgcattgtttttacttgctataatggtctcaattcatccatgtgtgtagcatgtatcagtacttcattcctttttacagctgaataataatccattggatggacatacctcatttaatttatccacccattaataacgattcagaatgcttccacttttggttgctataaatagtgctgcaatgaacattcttatacaagtttttgtttgaagacccatattttattttttcaatacaattcttggagatatagatatagatatatagatatctccaaaaatatctccaaggaattagtgaaggcttttttgaagaaggtgggcttctgagcacgaaggaaatttgaatttgagtcagaatttagatgtataaatataaatgtatatatatttaagataatttggcagtttcttagtaagttaaatatataattatcatatgacccagcaattctattcctgtttatatattttataaattataattatataagtataattatatgaattatataagtataattatatgaaatataattatataagtatatgaattatataactatatgatttatataattataattatatgaatataactattcatatttaagaatataactatataattatattcatattataattatatagttatattcatattcaagaatatcattatataattatattcatattataattatataattatattcttatatagttatattcatataattatatagttatattcatataattatataattatattcacatataattatataattatattcacatataattatataattacattcacatataattatataattatattcacgtaattatattcgtatataattatattcacataattatatacgtatataattatataattatattcgtatataattatatagttatatacgtatataattatatacgtatataattatataatcatattcgtacgtaattatataattatatattcgtatgtaattatatatattcatatataattatataattatattcatatataattatataattatattcatatatagttatattcatataattatgaatataattatgatatatatttatattatatataaaatatataaacatgaatagaattggtgggtcatatgataattatatatttaacttattaagaaactgccaaactatttcaaaagacttcatcatttttacattcccattagcaatgcgtgaaccagtttctctacctcctcaccaatacttgtgattttccttttctcaaattatgatagctgtcctagtgtgtgtgaagcattacatcactgtagttttgatttgcaattccctaatggctagtaaccctgagcatcttttcatgtatgttaggcattatcatctttggaaaatgtctactgatttgtaaattttttctcttattatttgggttgtctctttatcaacagtttcctttgacgcacaaaagcctttaattttgatgaagtccagcttatccttcttttgttgttcatgcttttggtgtcatatctaagacagcattgccaaattcagtatcatggacattttcatctatgctttcttctaggagttttatagttttagctcttaaacataggccttcaatccatttttagttaatttttgtatacggtgtaaggtaaggatcctagtttattaatttgcatgtggctagtcagttgtcccagcaccatttgttgaagagactgttctttccatcacccattgattttgaaactttctagtggatagcattttagttaattattatatattgctttttgttgtgatttgatacatgtatgtcttatttctacaagtagagaggactccattcaagggaggggactggcttctgtcatgtttctggtattttatgtaagggctaaaatggttcccagagtgagcaaaaaggaatcaaagaggacgcaagcccttgacccaagaaaatcagagtattttatttaaagaacaacttttagttggttggtttttttttgttgttgttttttttttgaaatggagtctcactctgtcactcaggccggcgtgcagtggcgtgatctcggctcaccgcaatctctgcctcccaggttcaagcaattctcctgcctcagcctcccaagtagctgggactacaggtgcccaccaccacgcccggctaattttttttttgtatttttagtagagacagagtttcaccatgttagccaggatggtctcgatctcctgacctcataatccgccctcctcagcctcccaaagtgctgggatttcaggcgtgagccaccatgccagccagttgtttttaattataaatgaatatgacagagtctcttccctcaaaatgttcacagcctaatgggggaagccaatgcatttagtaaccattagacataacatggctattgagtggctcagatgcagatcattctagtgagacatgttataagaggaaatgcacaacttagtacaaagagaagaatgccacacacatccttcatgaattgttgatattaataacgttgtaaaatgatattttatacattagattaagtaataaagtcacaaacgtgatttggttctttttactcttttaatgtgtcttgtattatatttctattggataacactggcatagacaaatggaaaagcaagcatctcacagctatacaaatagtaagagaactgatgtttatatccatttctttaaattttagaacttaggtttttatttactgtactgtacaactcaaaattaaccaggagtattaagatgtgattgctggctccaatttgaaactaggaagtggggcttagattcacaacctatattcagttctttattgtgcacagaacaccttcaaggacacaagcaaaagacaaacatgctgcccacagcctcaagtttcaggggaggcacacctgtcccacatcacccaattagagaacaattacaggttaagccagtggttcaaaaccagaggtaatttggtttggtttcccatggaacatttggcaatgtctagagatatttttgattatcacagctgggggtactactagtgtctactagatagaggcccagggatgccactaaatgtcctataatgcacaggacagacccccacaacaaagaatcagttgacacaaactgtacatagtcctgaggttgagaaaccctgggctaaaccattgctaagggaagtatttcagagaaagaggaggtgattgcatgctggagctctcaggggaaatgacacgaaggaaaggacccttaggcagactatgaagtcttggcacgttctgctgggtagagggatggggtaaaatgggcaataagagtgctgccagttggggaggagtgtggcaaggagtggaactagaaatggacttgagccccttggagtagagtgtgtcatgaaaggaagcagtgactagagaggtgatctgcaactcagaagaactggattttaaacctgatccttctacctggcagctgggtggctttgaacaaatcatgtgagttttctcaacttcaatatagtcctctgtcaaatgaaaataattgtaacaactttgactctttctaagttttgagtatcaaatgagacctttggtgtaaaataattcatcactgaaaatacaaagtattattgttgactttattgttgtgtttgttgctaaactgagttggtgccagagtgtggaaggctggcaaggagaggaaactgggtctgatgagaccatctggaacaggacagcaataagaggacagtgactcttcggaaggttcactttgatgcaatgtgtaggaaagatgggaactgcgagagaatggagttagaaaaatcacctaggaaacttttctggggaaacaccatgagtgggtaagagggatctggtgggcactaaatggattcgagcagccactcccagcagggcacactggggagacgagttgtagccttttgtagaggtagacagaaaaatcagtagattactccacgggcttgcgcactagtcctatctaatgcgaaagattacgagtgaaaaatatatgtggtttctaagactgggtgtttaatattttataaataatcaacacagaatcttaagaaaatatggattatgaagtttccctgaatatgtctcaccttcaatagttctacaatagtagtatgttttaaagtttgcttccctagtaggatgtactttctagctctttgtttgaatttttttcacatttaatatttgtttttgttttttgagatagggtcttctctgtcacccaagctggagtgcagtggcgtgatcttggctaactgaaacttctgccttctgggctcaagtgatcctgctgcctcagcctcccaagtagctgtgactatagacgtgccccaccacgcccagctaatttttgtatttttagtagagatggggtttcaccatgttggccaggctggtctcaaactcctgaccacaagtgatccacgcacctcggcctcccaaaatgttgggattacaggcgtgagccactgtgcccagccttcacatttaatatttaaattcagagtctttcagcctggtacctaggcagataactacttttattaattttttttgttaaaattatttttttgtaagacgtttgggaaatgatctaatagttttactctatcgtaaggatatagagaatgtagaaagtaggctccgttagcatgtaagcttccaaagggcagggatttggggctgttttgttcatggttataatcctttgcttagaacactgcccagcacatggtagcctctataattatttgccgaatgaataaatgaacaaatgaattaataagaggcacatattgtgtgtgtactcctcctggatggttacgtggttaaatgggcactgtgtgcattttgtggtgctgagtttgacaatatcttattcccagtcatggagcaaggcgcttacaaaagccctgtcatgagacccatctattgccactcattgattgccaccagcactcaaatcaatcattttctcctctcctttttacctcccctggaacccagcagcggtaaaatcagtaaagttggaagtggatgaagataagagcacaaagggatccaatttttccaactcggaagtggcaattggtttgtctccttacacctttccccagaagaggcttttccatgttgctggagaagaaaacatcacctaggccggtgtgtgcctggcagaacactgcactccaatttcctcgggcagccacaaaaaaaaaaaaaaaaaggtggggttggggccgggggacagctcttcagtaagatgtgacaatatgccagtttcaccaatgataagagaaacctgagataccaacagtcagcacagaccacaggtcatgtttgacagtgcaaagctgcaaggtccttcagaccaagcaaataggagagtgggctccaaagcctgtcaacagggtcccgaaagctaaaagggaaactttcctaaagaacccgggaaacaatgtaaggatgctaaattggtcatttacggatgccctccctggttagaagaaacttcctttgcatacgttccactctctttaaccattctgaggatttcctagccatccataatgtctgctcactttctgcatcaacttgcaatttgttgtgtaccacacttgaaatcttcacttagaagagaaagagaagccctgggatattgtactcagaatatatcttcttataaagaaaacaaataaacagccaggcccagtggctcacacctgtaaacccaacactttgggaggctgaagtggacggatcacttgagatcaggagttcgagagcggcctggccaacatggagaaaccccatctctactaaacatacaaaaattagccaggcatggtgggagtcgcctgtaatcccagctattcaggaggctgaggcatgagaatcgctttaactcggaaggcagaggttgcagtgaactgagatcacgccactgcactccaggctgggcaacagagggagaccctgtctccaaaaaaaaaaaaacggaaacaaacataacataaacacttatgaaacgcatcaagttaccaaattctcattaagcattggtttgaaattttattgtacagttgggtccatacagcagacatggctaagatacataaaagatgagactgcattattgaagaggcatcaaacagggaaaaggaagctgctatgtggtttctttcgccggaaatgaaagcctctcaagtttcatatttaattcacgcaaaaagccaactcattagtgttttttaaagtagcatatatattcaaatggtatatctttggatttaaaaccaattattttctaacatcttttcaagattctgtaatttatgggttctctgaaactctgatgagtcctgattaacttgggaagacattattctttaatctgtatgtagaaatatagaggcttctgttgttatttctatatattccaaagatataaagtgtattataggtgacaatagtgcccacagaggtgtataatgcacaactgtgcacctctatacagtgggcccaggtatatgtacacgtctgtgtagtcattttgctttcctgagctacatacagccaaaaatgtctgaagaaaattctgttttctcagagcctataaattccttatctgtgtatatttaatgttgatattatcatgcagaatttttattaagtctttcactgtatctttgagcgagactaaaatgaagagcagtccattaatatctgtcttcaactcccactacattcaacatctctttttgaaatgtgaggattccaaaagaaaattaagccatttaaaaatctatacatagcaaatagaaagtgatacaaataaaaaatttaaacggcgcccttcagtaaagcaaatttggatgagatcaaatgaaaagagtgaaagcttaagctagaaacaaacatttagtcaaacggaaaacatttctggacttctgcttttcagacctgtctgcctcccaagctgttatatggtgatattgaaaatgctttacatatcacagagataactgaaggattaaaggcatgtttgaagttcttggaactattctaagaaagccactcgagaaagcacaagcaccgtcaataatactgtgcagtccatcattaaaaacgggcaatcatttgtcacccatttcatcttttccttctattttctcacattaaactatcacatcatagttaacattttgaaaatcaattttatgttgcataatgagtgcccagagcaataccaaaaccgtataaaccaggacaagcagaaaaagatggtcttatgaaatgaacaaataagaattcactcatgtcaagcactatgctaagcactagagacatagcaataaatgcagaggcaacccctgtcctcatgaaacctagcagagcagagagtaattcctgattgttccaaaaacaaaacaaaacaaaagcagtgtgccattgaaatgtgtacgcacacatggacctaacatagtgtaggggaagatcaggaatatagacagggcagagggaattctggaagctgagaaggccatcgtggctggttggtcatcctgatatttttaaaaagccatgtatgttgttaagaggaatggaagcctctgtaatataaacttaataacataacataaatttcttaacatagaaattctctacggaatgtttacatatttataacataacttgttgaaactgggtcaatgttcattgttttgtctatcagggacagtaccagctgctttcatgcatgccttttccatggggtgttaatgtcctggttatgatttatttaacctcgttgttgaccagctttagtttgtcaacatttgacataggagttgtgttaaaatttcattctagcatgctgacatatacaatacacagttattttacctgccaggatttcatgtatgtttccaaaaaagcctctactcttcctcaatttgggggtttgttttcttttcaattccagcctagtttttatttctactctatagttatcatgctgtaacaaatcatttcaattacaaggaactaggcaaaagaaattgacattttcacctaccaaatcctggtaaggtgttattgtgttttgtatctaatagacagaggaaacatgactagcatttgttgacaactgatatagtggcttgcaaggagttttagaaagagaccaatatttacctcaaaagttccctacagaagatattgctctccttctctgtcttccccacacccagctgatgcaagtgaaccccaaagttggggcttagcctcagagggtttttggcttcactcaggagagaatgcaagtgtgagctgacagtgaaagaaagcaagttcattagagcaacagtgtacagcaaaacggtgttccatagacagagcagggctacccctaggcaaagtagcacacagagtacagcaaaacggtgctccatagacagagcagggctacccctaggcaaagtagcacagagtagcccttgtgcattgatggctagctatatttatgctcacttttaactatatgctaagtaagaagcgtattattcacaaacttcctgggaaatggggcaaggagttcccagaaccacataatgtaacttccaggtcgttgccacggcatttataaactgtcgtggcactgttgggcatgtcttaagcaaatacgtgataattcctagtcctagctggtttgaggcagtttctttgccacatcctgtttagatcaggagggtcttgaaaacaagtcctgctcatctcctacctcacccccattatttatttgtttagtagttgtaagtctagaagaatgagaaagctgacactctattcattttaaatgttcattctattcctacagatgaaatgatttaaaactaatagattatttaaggcagaagaacttcagaccagggaaagagacttaaaagcggcaagaatagcaaatgctgtatttggttttcattctgaagataataagggctaaatcattttcctcaaaagatgtcaaagtatgtatttaactatcaagtcactgaaagtggaaaacctaaagcggttctattgaactaccaggtaccaaataaccgatgaggaccaactgtgttacaatagcaaaatatcaattttcttctttccaaaagtcagagaaagtatttctaaaattgatttaatgtagtaaatgaattttcaataaaaaggtttttgaaagatagacctctatagaagagcaaatcttattgcttctgtttactttatgatgcaattttacacctattagcagggttagcatacttcgatttttttcttctaaactttcatctccaataaaagtttgttgacattgacattgacaatgacaatgcctccagtaaaagtttgttgacaatgacattgttgatgtcattcagtgctgtgatctttgatcttctccctttaataaatatcctggtcttctaaaaacagtatttaaagatacccagaattgagagcggaggtgggaaaccacatttgctaagcacaaaagaacaggatagaactcttggactatgctgtgttttgttagctattttaaaaaaataaaataaaagcaagaaatcagtattgacacatgggcaacaagtttccaattttttctatccttgctccagtagcatttaactatagaaatttgagagtaagaaaaaaacatttcctctctacctccctaccccacaccaaacaccaaaatttagcaaccataatcttaatatttcaaaggtcataactgattttagcttattgcctagacttgccattctcatatttaacatttacagggtgtgttaggctgtccttgcattgctataaagaaatacctgaaactgggtaatttgcaaaaaaagaggtttaattggctcctggttctgcaggctgtacagaaagcataacaccagcatctgcttctgagaaggcctcagtaagcttacaatcatggcagaaggtgaagggggagcaggcatctcacatggtggaagtagcagcaagagagacaggagggaggtgccacacacctgtaatcggccagatctcataagaactcattgactatcacgaggacagtaccaagaggatggtgctaaaccattcatgagaaatccacccccaagacccgaacactccaccaggtcccacctccaacactgaggattacatttcaacatgagattcgggcagggacaacatccaaactgtatcacagggttttgctattttttctatttatgagcaataccatattctataatctcaaataagctttaattttgtcagacagactgatgagcagaagtcatccactagtgagtgagcttagctacttttcctatgtccgtatctcatcatgatgttattgttctctacttgcactaactctccaaaggaattatgtttatatagtgaaaattatatgcaatactggaaattaagattgcatggactctcaaaaatcttgagatgagtctttatagatatctatctatagatttataaggatacataggttgatagtcacagacaaacatcatacatcaatatatatcaaatagctacaggaattattagcagttcctgtagccttggtgaaaaagcagttccccagtccaaagatctttttatcaaggaagtatttgtttttctggcatctacgggctttagaaagaatctagttagaaaaatcaaagtcatcaagttattcttaacattcgttttattttcatcttctttaacatttgtcacattctataacatcaactaaaatagtcatgtgtggaatacaattaatgcacacattataaatgatattttcacaacttaagctgcaaataagagatgttaggccattcatttttctcttctgatagaaacattttttatttttcccacatcatcagctcttccaagttttaaggaattgcttgtaaaactatcttacttcttagcatttattagaagtgtgtgtgtgtgtgtgtgtgtgtgtgtgtctgtgtgtatgtgtgtgtgtggtgtgtgtttcttgtcctgcattgaaatgtctattatctttttaattttataacttaatccttaagccacggttccaaagtcatgactcatacttgatctgaaattctgggcattgcagaaaggaagcagaagttcgataaaatatcacataagaagaacttttaatctaaaaaccctgcaccaaagaaaggaagactaattgtagcagcctttaaaactgatattgtgaatttgctacatttttgtaaaatagaatagtttctactggtaaacaaagtgataaataataaaaattgttttctcttcataatgttcttgggaagactggccaaaatagaggcaaggagcctgataacaaaaatctttggctgtgtttctaaatttagtccttctctgcctagaaactgataggtaataagatatgaataagcttcatgcaatttatttccatgtccatattttattaaatttcttgaattctgtatgacagtatacatatataacctcatgaaatcctgatgttttaaacagtttagtacctaaaaacaataacaccaacaacaaaaacagaagccagccttaaagatatatacatgtgacgttgctcactgagaagtccttttctagtcaacccatggtttaaaattcacagagctaaacataagatggattttaaatcaaaatactatggtgaattaaaacaaatactagacattttgcactttgaaccaaatagaatctcaactggtaattcagcttctcaaatgtcataacttacagtggcctccaaactgttttaaaatgggtatacataatactgtcaagtacacactatgtatatcataatcactaaagcatggtttctcaaccccggcaccattgacgttttgggcaagataattctttgtcgtggagaactgtacatcatgggatgttagcagcacccctggcttctaccaactgtatgtcggcagtacctcccccaggtgtgacagccaaaacctctccagacactgccaaatgtcccctagggagaaagatcactccaactgagaaccactactctaaataacgttcatgtaacactgcactaatatatggtgtaaagcaaccatgaaaaaatgtctatttttaaggttgagtttcttttttaatagggccaaaagaaactttctttctctataaatgttataatgaataacttttaggataaaaaatatgacagaatatgcttgaagttgctttttaaatcttagcctaaagaaggaggcacaccgattcaaactgcagtttaatacttgattttaaaagccgtgaaggtagaaaaagacatgtaactccaaacggacaaaatacaacttttttactaagtcatgatgcaaaatttttatctagcctaacagtaacccaaaggagtctactgaaattttactagtaaatatatatgccttgatgtcttgaaaacaaatcggaaattgcatttttatattttgaatacgtaatttgaaattaccacaagtgcaattattaatttgtcaaaattttaattgattggaaaactgtattcagatttttaaaatttgtgtatgagttttaataggtagtaaatacacatcattttcagtaataaattcatataacaatatacacatttccaaaatatttttagaatgatttatacataacacaacttcttttataaagcacttacttgctcactcattgtttaagtgacatctttatcttggagaaacaaattatgtaatgtttaaaaaaatgtattctcagtagcataatagtgacagctgcttatcatcactgaaatgtcagtaaatttgagttatttgatttttgtaaaaaaaaaattagtaagtcatgtgctgttcgagttctttgctctgagataaccagcaaacctctgtatggtaacaaatggtgtttgtggccactccctacctcatttcaaatattgtaaagaactcactttttactaatttgggtttttttaatgaaaacattagaatatcaatgtcagtctatagcattttgtgcacttttagctttaactttttgctaaaatagctcgtttattaattttgcaatgttatctccataaacttagcctagaattctttctgtggttacatttatagtttttagatgaaatattatatttgttaaacgagccatttactgttgagactatcacctcattggtctttcttccctttagtggctcataatgaaagggggaaggtaatcgttcatattccatcactgaaacaaaatttagcaaatactataagccgagacgtattagaaacatctgtgcttacatttactgtatattccaaaccttttacatgacataatttgttataaaacttgtttattcagatcttttgcaatgtcgactgtgtttttactgggaaatacattcaaaggaatgtattttagcctgctaaccacgttgttttccaaggattctttcagccatttttactaaggcaagatgaacatgtttcctcaatgagtctttagatcattggctattcagtgaagtttttcattaaacattaattgggtgttacataactaaacatcacaggagaaatcacagaatatatttaaaatgtcttgctaacagtgatgactttgctctatccttagctaacatctcaaggcacatttttcctctaggtcaaggttcactttgaaaaagagtaaggggctatctatattttaatagtcttcttgatccttccatgggggagaaggtggaggcagaaattttgtcaaatctgattagattgtcaaaacatcaatagttcctaataggactcagagaaatgtcaatggtctcttgctcttcactttgtcttgacttattagtattattttagtcaaatttctttcagatgagataatatgtctttaaactctcttatgtctacttatgttcatccataaatgacttgaaacatttaaatcaagcttgtccaacccacggcctgtggactacatgcatcccaagacagctttgaatgcagcccaacataaatttgtcaagctttcttaaaatattagaagaattttttgctattttttttttagctcatcagctatcattagtgttagtctattttatgtctggcccaagacaattcttcttcttccaatgtggcccagggaaaccaaaagtttgggccccccgcccttatgtaaatgatgaaagcaaaagaatgattgagagagacttggccaactcatttatgccgcggaaccacaatctccccttaacagactttgagtataagtgacacatgccatgtggaatgaagtaggaatcagcattaatccacttaagttaaatatttgcaaagcttaaatttattcttcaattaaaaaatgatataaatagaagttagtcatattttctccaatggatcatcttgcacaattgccgggggtaccagaccccattttcagaagccctgccttagagtaagtccagctattcttacaggtgcaaatgatatttattagtctgttctgcagactgaaatgaactctgttttcctatctaaaatgaaaacttgcaatgtagttttttggcattttttttttcctagtgtgaccacccaataatgccatctggtctataatagcctcattttaacatgggattgcaaaatgccatgttgcaagactggccaaattcaggcagtatgatcaagaaggtgttaagaagcaagccaattagtgtcatagttacagttatgatgcaaaatgtaagacaggtgcttgtaccagaaactgattgaaaagctttctttccacttagttatatgtaaaggcaatgcaggaatctgaccacaagcattcccataaatatttaaaaacagttttctggctgagttaataaatgaatggaatggttcagaatttccagccacagtgtgacaagtaattggtgaaatctgcaaaatacctagtgcctatttaaaaagatgttatgttttcagatcattaaaatacagcattttatttgccaatgatttattttatttgtaaagtatcttactcataatgaaatgaaatagccatgactttagctcaataaaatattttactgcttctaaaacctatgactgtgtgtgtgtatgaagtaaaagagttgaaattaccctgaaactgtctccatctgtaattattattatttttagataaaaagattttttaaaatctgaaatttaatccttgctcattaatactcatcagcaaaatactaaagcggactttaaagtctaagggaaatagtgtacttaaccttcacctatgatagcggttctcattacattggccggcaagtaacagaaagtgaatgagcattgtaaagacagctgctcttttcagagtttggttttgcactccgtctctctgttttccacccatccagcccactcagcctctatgtattagcacatccaacagaggtcatccaaccgcgggtcccgtcatcctaatccttggagattactagacctaatgaagacttcagaaatatttctggcttgacagtaatattttccttaacagaacagtcttttttccccctgagcatttttgtccttccaaacttcaagactttcttcaaagtcacctccgaccccaacaacacacaccgtgagtactacaatgattctgttgacacaaaacacatcaaagacccaagaagttactaatgctatgaagtctgtgcatggcttgtcatggtgcctcctccagggtaatagcaatggcagggaaatgagtcagcaaaaaccataaatgacacttccaaggaagagaatagatctaaaattaaggttaaactagagagctcttttcctatcatggtattttccatccattctgttctgtttcccaaaaggtttttttgcaagtaaaagacaagaatcatatcacaaagctattttaaagagaatttcctcttctgtcaataatcctgaggaatatttgccttaaaaagtaaaagcctatgtttacaaccgagtacaccacagagggagggggaggacattcgtagaagaaaactgacaagaagagaggatggaaaactagtctatcaaaacacttctgtccagacgtgtcaccagatgcatagttcagacaggattgcgcacaatctccaggttttcttcaacttcttcctattcataggaaattcaatcttcatttcatttttggtaactttccagggttagaaatactcatctccaacagaattctaaaacccatagaagaaatctagacacttcctgttacgtcttatttcccttttctgttactaatttcccactgaaattccctattcattattttggctgagtagcccaggtattgtttgaaaaaagaaatcattcaaataaacgtttgttaaaaaatcatggtaattatcgacacttaatgctgagttttctccagcatcttccaacctaaaatagaaaatgtagaaactagtgagtaattgaacagcacgtaagtgaacacaacctagataccatgaagtcaacactatcttaaatttaaggcaagacaaagataggtaaagtgtgcaaggttagttttcagaagaagaggcataggactgaatcccactttcctactattcggttttcatgaaagactgactaaagctgaaatctcaagctaattttgataaagaaaggaaataagatgtgttacaagggggaagcttggtgactcatgcctgtaatctagcattttgggaggctgaggcgggtggattacttgggcccaggagttcaagaccagccttggcaacatagtgagaccctgtctctacaaaaaatacaacaattagcgagacacagaggtgcatgcctgtagtcccagctactcaggaggcagaggtgggaggatcacctggggctgggaagtcaagtttgctgtgagctgtaatagcacccctgcactccagcctgggtaacagtgagaccgcatctcaaaaataaataattaaaaattaaaaaaaaattaaaggtggggggaacttcagttttgataaaagtaaagtcacagtgtgggaagtgaaatagaaatcaaatgaataattaaataggagggaaaagataaagcccacagcgaagccaagaagacaggcaggcttagaaattctgcagagatggtagaaagacggcaattttactaagtctggagaataaagacccagttcattggcctaaatatccaggaatacaaacttgatataacattctcattgcaaagaaatggcaagtgtttgaggtgatggatatgtcaattatctgatctaatcattatacaatgtacgtatgtatcaaaacatcacactgtaccctgtaaataagtacaattattgtgtcaattaaaaacaaaacttattaaaacgttttaaatttaaaaataccctattgaggcctggcacagcggctcacacctgtaatcccagcactttaggaggccgaggccggtggatcacgaggtcaagagatcaagaccatcctggccgacatggtgaaaccccttctctattaaaaatacaaaaattaactgggcgttttggcgcgcactggtagtcccagctacttggtaggctgaggcaggagaatcacttgaaccagggaggcagaggttgcagtgagccgagatcgcaccactgcactccagcctggtgacagagcaagactctgtctcaaaacaaacaacgaaccaaccaaaaaaaaaaaaaaaaaaaaaaccttttgggtactagacttagtacctgggggagaaaataatctgtatgacaaaccctgtgacatgagtttacctatataacaaaccggcatgtatatacccctgaacataaaataaataaatgtttgaaaaaaataaaaatttaaaaatacattttgtacacattcatgatgcgttttagagaaactatcaaagatgaggagttcagtattataaaaccacagagaagaatgtccagaatctacatttggagattttggagactccaaaaatctcagtgacacaaattgctttttctcctgaatcattaaattgcaatagtacttaaataacttgaatggtgactgtggcttttattctaatatattagaaattaagagcttttcttctctaacaaattctcagctatattttatagttcttgtagttgttcaatactgccttcttaaatttattttctcaataatctcaattcttataatgtattatcagaaggtataaaatatttgtatttgttcttatgcttttttaatgtaggttttacactcaaagtgatctttacaatgtgaactgtaatgaatattttaatttttattattacatgcaaaaaatcattaaaatagcagtttgacacaatatatttgacaatttcattttttcgtctctaagttatttcagaagtgaattcctgctttgaacactgaaaatgcaactctgaaagattcccaaaaccttggatccagtcccaaacaaatcagaaacaggctgttggctttttttttttccttgtttccttgttttctcaattgccaatttgttttattatttgaagggaagaaggagacaaaagtccaaaaataaaagccctgcttgtttcctaataactatccacatgaaacccactgtactcagtaatctgaatcaactccattttttgtgtgtgttctgtaattatagttgaggctataaatggagattcagagccaaacctaggttctataatatgcgtaaaatcaaaactgaagggctgggtgcagtgggtcatgcttgtatccccaatagtttggggggccaagtctggaggatcacttgaggccaggagttccggaccagcctgggcagcatagtgagtccccatctccacaaaaaacaatttgaaacagctgggcatggacctgtcgtcccacctactcaggaggctgaggtaggaggatctcttgagccctggagttgaaggctgcagcgacttatgactgtactactgcaggccagcctgggcaacagagtgagactctgcctctctaaaaaaaaacacacacacacaacaacaacaacaaaaattgtaatcagtctcgtagacagtgatcgtgtacaaagttctatttaggaaagaaaacatcagtatttaagtctacttttattaagaatgtgggttcctaaaccaattcgtctggttaggaatcagctctgccacttttatctgggtggcaagcaagttatttaatcattcgacacctcaatttccatacctgtaaaataagaataataatagtaaattatcggccaggtgcagtggctcatgcctgtaatcccagcactttgggaggccgaggcgggcagatcatgatgtcaggagttcgagacaagcctggccaacatagtgaaaccccgcctctactaaaaaaaatatatatatacaaaaaatagaaaaaatttgcagggcgtggtagcatacacctgtaattccagctactcaggaggcagaggcaggagaatcgcttgaacccaggaggcggaggttgcagtgagcagagatcacgccattgcactcaagcccaggcaacagtgtgagattcagtctcaaataataataataatagtacttctcttatagggttgttatgaggattaagtgaattaatacatctaactctttcagaacattgcctagcatactataaatacttaatacatgcaggccattagaatttgtctcaaaaattatcattaccattgttttaacaaaccaaaacaatagcgatacttgtaatatttcgtgaaaccaagcatcatagcatcttatgaaaagccatgctgtggagtagacagagcctgactttgagatggaacatctagtttcaaactcatgctctaaaacttattgactctgtttttacccatttccctcacctctatgttatcatccataaatacatagaaataacatcctcccctcaccatcttatgaagaagccattcataaaaatattttaatataggaactattttatataagaatttttaatatacagcaagaagaaatgagttgaagtatattaaaaatacaatagacagaagggaacactaagtgcagaacaacagagcaggtgggaaaacttcccagggggcatgatgttgcagtagggttctgaagaatgagaacgcggggcccagtggctcaagcctgtaatcccatcaccttggaaggacgcgggaggattgcgtgaggcctggagttctagaccagcctgggaaacatggcaagatctccatctacaaaaaaatttaaaaatcagccaggtgtggtggtgcatgcctgtattcccagctatttgagaggctaagcaggaggactgcttgagcctaggagttcaaggttacagtgagctatgattgcaccactgtactctaccttggacaacacagcaagatcttgtctcaaaaaaaaaaaaaaaaaaaaaaaaagaaaaagagaaggagacatttactagtgtttagaggtatttttaaaagcatgtttggagatcagtgaattgagatgagattatacgcaaagtctcttttaagctgtaagttgctattacatgcaaatgtttgtggaactcagtgatcaaaatgtcatgctaggccggacacggtggctcacacctgtaatcccagcaccttgggaggccaaggcgggcacaccacctgaggtcaggagtttgggaccagtctggccaacatcatgaaaccccgtctctactaaaaatacaaaaattagctgggtgtggtggtgcacatctgtaatcccagctacttgggaggctgaggcaggagaatcgcttgaacccaggaggtaggggttgcagtgagccaagatcgcacactgttctccagcctgggtgacagagcgagactccatttcaaaaaaaaaaaaaagccatgccaaggagttgtgaccttatctgtaggttgagggttaacgagaagttgtttacacaaagcatactttatgaaatgtaaagaaataagcaacattttccattttgaagaatgataaacctagaaatctcaaagccaacccaaaatctaaaagaaaaatttgaagtcatatagaaataacttttttgtaaagttttttatttgttttacttgtatagaaaagtataccagacacttaggaagaaaacaaacaaacattctttcactcgggaaaactgtcctgaaatgactctacgatacaaagagaagatcgagagcttttgttcaattgggagaggtaatatctggaaccggctcagcatctctcctttgcctttgtaaatggtaccaattcaaaacaaatggaagaactatgaaactgagaattactcatatgagtttgggaaatgactgtcctctctttgtcctgttatcaacacacattttgccttatcacatattttaaaatttaattattagcccagatcacacttgtgatcgtcactttcttctaagactgaacttagcttccaagagatttcttcaatctaaaattgacttaatttttttttttcctttttcgtttgttttttttgagacagggtttcattctgttgccgggactgagcaactttgagctcctaggctcaacctatcagccggtttctgccttccaaagtgctgggattacaggtgtgagctactgcacctaggcaatcttttcactttaaatgaaatacttcattcttagaaggatgtatcatcagtctaaagccaagatcaggcaaaaagaagtttaaactaatatgtccttgtcattacctctccaatagggtgtattttggctgttcctgaagtctcatcagactagttttagcacttattatattcaaatttttatagttcccaacacattttttatgccaaatccttctttttttgtttacccccataaagtccatattctggaaatgttagtcacaaaaatgtatttgttaagcaataatttttactcttttaaaaaaaaataaatcggcctggcacgctggctcacacctgtaatcccagcactttgggacgccgaggcaggaggatcacaacgtcaggagatcgagaccatcctggctaacgtggtgaaaccccatctctactaaaaatacaaaaaattagccgggcttgttggcgggcctgtagtcccagctactcaggaggttgaggcaggagaatggcgtgaacctgggaggtggagtttgcagtgagccgagatcacgccactgcactccagcctgggcgacagagcaagactcccatctcaaaaaaaataaattgaattaaaaattaaaaaaaaataaaataaatcaagggcttaaatagttactaattagggaatctgatcagcataggagagctactattaacaaattatgttgatataattctagccaagagcaaataagttgaacattttaagatttcttgaacatttccgaaattttgaagatcattcaatgacatgttattaatactacctttacccactagacatcctcagacccccaggtaggaaactatatgcaggattaaacaaaacgtatgaaatagacaaaaacaggaagcaatataggttctcattcattcattcatcagaaaaacaactactggatacatatcattgatcaggtactttgtcttgcataaacatactttcaagaagacatcaagaaagacccaagtcaagaaaaaataaactgtagaaagttctaagatagattttaatccctctgaagtagtagaatcaaattcacaccccactgtagctccatttcaaacatccctaccactagaaatcttttcatctcatttgaagccatgattataattgacttcacaggaggactgaaagatatttggttatgaggtgtgcaacatttgtatgtcatgactctcgtgacataaatgagatgttctcttagccccgaaggataataagcacagatgatcacagatgatcaaggtttccctggagaacttgtttccagtttcagaggaactgtaagacctgaaagaaactgtaaaaggagtatctgtgaaaaattaagaatcatagaaccacagaatcacagaattagaggaagcataaacataattcatggttcatagtaagcctatgagagacagctgatagatgaatagtctcctgtctcccaaataatggcctatgtgcagtaatgagcaatagaccttacacgggtatgtgttgaaatgagaaaaataaaggcaatgtagtaaagtgtcttcttgttttgtttgagaggaatgtgcaatccctttgaatagagaaaaatacacaataataaaatatttttttcttcttgtatccagaattaacaaatgagaacattttagcatacttgtattatcattttttacataaagaaataaattattgtggataaagttgaagtcccttttaaacacctctccagtcctattctccttcccctaatcagagataaccactctcatgtgttgatatttcttcgagttcacgtgtgtgtgtgtgtgtgtgtgtgtgtgtgtgtgtatcaatacagaatgtagagcattggttgtgttttaatttatataaatggtatatattgtataaagctggatttacttactattctagaatgatccttcattcttacattatttcttttctcttcttgaattatcctttattttgttaaatggtggtaattataagtggcaattaaaatgtcctaaattggcaaaattaaaaggtgacagtctatatttctataatgaccccttgctcatttttttaaatgattccgaaaatccaagagaaggatagtgctgctataggtcaaccacgatgttcctgccacatggccatcaaccctcttcttgaacacctccagggatgggcatgttacttggtaatgtggcaccatctctaaggagctatgttagaaaataatcttctgagttgatctgaaatctgtttttgtatggcttctacctattggcaatatttaatactttgaggttacacaaaccaaaacaaatttagttctccttcttcacagaagtacttcaatcacacaaagaacctacaaaattttctctgaatctcctttcctagaaattaagcatcctcatttccatcaactatacctcatatcatacggatctaagtagcaaagagctgtactcacactcgcttccacttgatcattcaccattggcaggagctatttatttatataggaaggctcaaaatgtcgatgcggctgttgctacctgtaagaacatgattgattgaaacagctcatctgcttttgatcttgcaacagaaggactgccatctccaattgctgacaaaatacatttgtcaagttcaacagatatcccaaggtatccatgcaactctgaagctacagggctaattggtgataaatttgggattagaacccaaaggctttgagattctagctattctttcccatgtgaaggaatatcatatagtattggtttgggccaaataaatgagaaatagccaaatcaaagggaaaaaccatgctcagtaattttctcagtgtatttgaagcattttttaaaggagagtttggtttttctaggtttactttcttttgctgtttttgagacaggatcttgctctgtcacccacactggagtgcagtggcacaatcatagctcactgtaacctaaaactcctgggcacaatccatcctcccgcctcagcctttcagctagctactaccacaggcgcatgccaccacacccagctaattttcctatatttttgtaaagatgggggtctctctatgttgcccaagctggtctcaaacttctgagatcaagaaatcctcccacctcagcctcccaaagtgctgggattataggcatgagcctccatgcccagcctgctttcttatccataacaaaatggaatgcttgcggcctacaatgtttcttcaagttgactatgaaaaggttaaaacttagttctgttatttttaatccccagaatggagtccttgtgcttttgccagtaatgctggcctctgcccgtggctttcttccaaatcaggtgtgttgactcagcttccaaacagcatttgcaaacatttttggagtatatccaattccaggatacacagttcaccagggccttcttttactccaggactgcctgatgccatcagcaaaagcattctttacaaaaatgcaagctgttattttcatataatattccaaggagatcagtaacaatatgtgtaaagggcaggggatgattcatagctgcccactcagctcccaaggaagtttccgaggctgatgttgaatcgttccacatagctattggcataagggccttggaagctgttctgattgcaaaagcagtcctctcagtttcctgaggatggtgatgaatgtccccgcttgaggaccttagtttactggaaaaatgtggcatttgataaaaatttgaacacaggtatgttttcttcctagaagattaagtgctcatttctctgtgggtagcgaatgcagattttggtgaactgagaagtttcttttattctgagaccaagccctagccactctctatcattgactctctaataaattactatacaatttttagtgcacatataagcctgaatttaaaatgctaataaagaagcacagttttatgaaactctatcaagcatgcatgtggattttttagcggcgtcagatattccctaaaagttaccaaaataggtgctcatttcctttgatgacttctttgaaatggattgttggttgaaatccaatgagtactggcagatttccacctcccagagagggctatggtaattacaacttgttggcattcttttcagcaatttcagaagggataccaaaaattaagcactcaaagaggttgaatcatcctttcacccttgaatgtactcacttcctttggttctggccagagcttttttggaagatattcctatgaacttccgttgctggtgtaagcagtagaaaaacagaaggcaacaaccagaattgggttgccacaacagaaataaagataaatgcttctaacccactgagttagtaggaaatggtgggagggagtaggggattccagccatagttgttatgctctttatatctgtacttagtacagatgtggcactaaactattagaggtgtggtggattcctactaagtcctactttagaaataacatttttaagacttttttggtcttatcatacatagccctaaatgggtctcttctcccctaactcaaaaagcgacactcaatttttttctaacatttgataataagatgttgtccctgataggcttcaaaacactgacctgataaggaagaaaagttatggtcttttgaaaagtcaaactaacacaacaggataataatataagagctgtggcaaggaaattcctatttgtttcccaaatgagtgacagtcaataggtgtcagtgtgttctaagattgagaggtctctccataaggaagacttaaagaagaaaagtcctgagttggattggataggaacagagaggagggggatggtttgggacaagggaacagacatgaaagaataaagtccttaggcagaggaagattcatcaagagggtcactgtattagtttgcttgggctgccatattaaacgccacaaactgggtggctcaaacaactgaaatttatttcctcatagtcctggaggctagaagtccaagatcaaggcgccagcagtgtcggattcctccgaggcctctctcctttgcttgccgacgaccaccttctctctgctttgccctcagagggtcatccctttgtgcaccgttggtgtctcttcctcttcttatgagaccagtcctattggatcaggatcctgccctaacagcatcattttaacccactcacctctttaaagaccttatctccaaagtcaatcacattctgactactgggagttgagacttcaaaatatgaactttgagtgctacaattctgtccaaaacattaatgaaaattacagactagagaccctgacttagatgggttgctgtgagtgtgaggatttgcagtgctgggggagaggagaagctgtgttagaaacaggaaacatttctatgtacgcatgtgtgggaaattgccaaaagagataccacacaaaaaagacttgaatcttcaaaactctggtaacttcctgtgatttcttttctcgttctaagtcaatattcactttcatcatgaattttgtattactaattttgtcatctcatttttaaaaagggcatcacccaaaattgcacagcattgagtttcacaaactcggctccttcctgacatacaagaataatcaggctggctgggcacagtggctcacacctgtaatcccagcactttaggaggccgaggccggcagatcacctgaggtcaggagttcgagaccagcctggccaacatggtaaaaccctgtctctactaaaaaaaaatacaaaaattagccgggcacggtggcatgtgcctgtaatcccagctagtctacttgggaggctgaggcaggagaacctctggaacccgggaggcagaggctgcagtgagccgagatcacaccactgtactccagcctgggcaacagagcaagactccataaaaataataataataataataataataataataatcaggccactccccttaaagcagagttttaatagaaaaggagacgagagaggtcagagtcataggcactgtaggcagaaaggactacagagttagtactgcccaatctattatttcacagatgaagaaactgagatccagaaaggagaatgttgtggccacagtcacacacagcctggacaccaggaaaaacagaatcctaggttttgaccctcagtcctgtggtttgtcccatagatttaggctttataaaattaaggagcacagaaattgatttaacattgtgattcatcatctgggcttatatggggaagcctcccatgatcaaattctcggggcatcttaaatactgtcttcagtgcacgccaccaggcacatactttactttctcctccttactgttctggtcgttaagggtttgttgttgttgttgtttttgagacagagttttgctctgtgcagtagcacaatctcagctcattgcaacctcagcctcccaggtcaagtgattcttctgcctcagcctcccaagtagctaggattacaggcccaggccaccacgcctggttgatttttgtgtttttagtagagacggagtttcaccatgttggccaggctggtcttgaactgctgacctcaggtgatccacccgcctccacctcccaaagtgctgggattacaggcatgagccactgtgcctggccaataagggtttaatagcaatgtaagcaaacccccaatttatctttggcttcctataaatcatgtggctacgaagaggcctcaggaactccactttctttgctattaccagtcatttgtaatttcctttctcacctttcttttgaattttcttgtggagctgatggaaacccatttctacttttctacctcgttatctatctcacccccaatataatcccccagcactcccccaaacacatactacagtgtggagcaagcttatcatttaatccctcttccagatttttcctcaggccaatgaatgtttaggggaacattttggtgaagaaagggtggaaacggagttagtggcccaaggatactccttcaacttccccccacacttggcgacttcatcttcatctctaggtgaggtcagcatcactctaaccctgcttggttcttgtcccctgtgccacccttccactcacctctcgggcccacgcctctccctccactccaccagtaatctgaaaccttcttctgatcccacagcccacagcttctgatctgctaaatcctggtacttctctaaacataactgcatcttaagttagtttttgtgtacctgcaaattcattatttgctacctatttatgacttttgcctttctcaaaggcattcaaaagacacttgacctgtcagtataattcattgtttcagcaatcactaaaacccttcataaaccctataaggggaatgtaattccaaggtccagaaagagagagagagaatactgtctgcagacagattttattatgtggcattgacaccagagaagagaggaaaacctcaccagccatgggtggtgacagtggaaagggaaacagggaccacaatccctggctctcaccagcaagctcacaccagaggcaccccatagatatctccaaagcctgcaatggccaagagggtagccacagccactcgtggccaccaagcactggaaatgtggccagtaccaccttggataaagtgtaaaatacacaccagatgtcaagcactcaccttgacataaacaatgtaaaatactttgttagtctttacatcgtttacctgccaaaatgatatttggaatacattgagtaaaataaaaaattgcattagagttagtttcatctgtttcttttgatgttttttgcagcggctactggaaaattttaaattacaatgatggcttcatcatatgtcttttggatccttctaaacctctgtccatgcgctgggctctctctcacctggctgaaggctctggctttgtgggaagccagggccaagagtgcagcttctttttttttttctgggatggagtttcgctcttgttgcccaagctggagtgcaatggcgcgatcttggctcaccgcaacctctgcctcccggtttcaagcgattctcctgcctcagcctcccgagtagctgggactacaggcatgtaccaccacacttggctaattttgtatttttagtagagatgaggtttctccatgtttgccaggatggtctcaaactcctaacctcaggtgacccacctgcctcagccttccaaagtgctgggattacaggcatgagacacagcgccctgccagagtgccttcttttctctccgtgctaatcacatgcctaattggatctgaatacatttttacttgattacagttgcatttagcggttagggcctgagtattgtcactacactaccttgaattccataggctttttctttttgtttgcttgggtggagtgcaatggcatgatcagagcttactgcagccttgaactctcagccttaagtgatcctcctgcctcagccttccaaagtgctgggattacaggtgtgagccacagcacccagcacgcaatttatttcttggctggagttccacttgtattggtgcaaagaggagaatatttagagtttaaaacaaatggttcataaacaaacaaacgaaatgaatctgtatataaccttaacaggaagaggctattttagcctctattgttgaatgaccttacataaaagctttccgcagagagagttgaaatacttacaattattttatcatgaaaaactatgtcttttaatgccactgaagtaactttgttgagtctaaatctaacacatactaaagacttttgattgtttgagaaaaggcttggtccatagggatttttatttgtttaaaaatatttaataaaggccgggtgtgatagctcatgcctgtaataccagcactttgggaggccgaggcgggcggataacgaggtcaggagttcaagaccagcctggccaacatgatgaaacttcatctccactaaaaaaaaaaaaaaaaaaaaaaaaaaatatatatatatatatacatatatatatatatatatatatatacacacacacacacacacacacacattagctgggcatggtggcacatgcctgtaatcccagctacttgggaggctcaggcaagagaattgtttgaactgaaacccagttggacgaagttgcagtgagccaagatcacaccactgcacttcagcctgggctacagagcaagactctgtctcaaaaaaaaaaaaaaaaaaagtaatagacattgtatagaaatatagaatatatgaaaaataataaacttccttgtactcaccatccagcctaagaaatctaacatctccaatactatagaaagtccctctcaactcccaaaagtaactgctaatctaaatttcatgtttatcattacttttcttttttttttttttttttttttgagacggagtcttgctctgtcacccaggctggagtgcagtggcacaatcattacttttcttttagttagaaatttactaactaaatgtctaccaaagtagacatcttaaaagctggctgagaccagcctggccaatgtggtgaaaccccttctctactaacaatacaaaaattagctgggcatggtggccggcacctgtaaccccagctactctggaggctgaggcaggaatcacttgaacacaggagacagaggttgcagtgagctgagattgcaccattgcactccagcctgcgcaacaagagcaagactctgtctcaaaaaaaaaaaaaaaaaaaattgccactgttgtatggacctgcttaaaataaatatcctggattctgtatagcaacctaaactcccaaagcaactattctatttttacaagtacttttccattaaaaagaaggaggaaaagagaaggagagcaagagaaaaaaaaattaccttatatgtctgtcttcttatataagaaagtgacaccatacaaagaaacaactattcaggctggtgctagagggttggggagccgaggaatccctggggagcagtcacagggaattccatccaaaagtccaacatgcagtgaatatcccacaaatgttagtggtgcctctgcagaggtagcaatgttgaacgcctcgagtattcccggatgattttgattaatttcctcattccttttctcctgagtccagatatccccagcatagattgcttcccacatagtatctccaattttaagtaatatatagtctaatatctgtttctttattggctaagtgtctttctctgcgtctcctctatatcatcaatagtcctctgtcatctttctgcacatcttgggatgccgtcctcaaagaatcacagagtatgttttcctttaacacaatttatgaccacctagcattttcaagataccatactaaaatctgaagatcagaaaaattaacatgacacaatctctgccccaatgggacctatagtctagtgaaaaaattagggaggttaaagatccttcattcaacaaatatctattgagcacctattatatgccgattattttcttatgctccagggacacatcagtgactaaagcagatcaaatgtctgctatcatagaccttacattctacaggtgagaggcaaacaacagagaaaaaataaattatacattctgtatagattcttacattggaaggtaataagtgctatggaaaaaaaagtaaagcagggaagaggtggggaggagaaggggaatgtgagtgacgtttgaaatacggccacctgatccacagacacctcacataggtggctgcccctctggcacgaagcttccagaggaaggatcaggaagcaatatttgctgttctgaaatatttgctcttctgtagcctccgctggtgatacccaggcaaacagggtctagagtggaactccagcaaactccaacagacctgcagctgagggacctgactattagaaggaaaactaacaaacagaaaggaatagcatcaacatcaacaaaaagttcatctacatcaaaaccccatctgtacgtcaccaacatcaaagtccaaaggtagataaaaccacaaaggtgggaagaaaccagagcagaaaagctgaaaattctaaaactcagagtgcctcttctcctccaaaggactgcagctccttgccagcaacggaacaaagctggatggagaatgactttgatgagttgacagaagtaggcttcagaaggtcagtaataacaaatttctccgagctaaaggaggatgttcaaacccattgcaaggaaactaaaatccttgaaaaaagattagacgaatggctacctagaataaacagtgtagagaagaccttaaatgacctgatggagctgaaaaccatggcatgagaacttcatgacacatgcacaagcttcaatagtggattcgatcaagtggaagaaagggtatcagtgattgaagatcaaattaatgaaataaagtgagaagagaaggtgaaagtaaaaagagtaaaaataaatgaacaaagcctccaagaaatatgagactatgtgaaaagaccaaatctgcgtttgattggtgtacccgaaagtgatgggcagaatggaaccaaattggaaaacactcttcaggatattatccaggagaacttccccaacctagcaaggcaggccaacattcaatttcaggaaatacagagaacaccacaaagatacttctcgagaagaccaaccccaagacacataattgtcagattcaccaaggttgaaatgcagaaaaaagcgttacgggcagccagagagaaaggtcgggttgcccacaaagggaagcccatcagactaacagtggatctcttggcagaaaccctacaagccagaagagagtgggggtcaatattcaacattcttaaagaaaagaattttcaacccagaatttcatatccagccaaactaagcttcatacatgaaggagaaataaaatcctttacagacaagcaaatgctgagagatttttgtcaccaccaggcctgccttacaagagctcctgaaggaagcactaaacatggaaaggatcaaccagtaccaaccactgcaaaaacatgccaaattgtaaagaccatcaatgttaggcagaaactacattaattaatgggcaaaataaccaatgaacatcataatgacaggatcaagttcacacataacaatattaaccttaaatgtaaatgggctaaatgccccaattaaaagacacagactgggccgggcgccatggctcacacctgtaaccccagcactttgggaggccaaggcgagcagatcacaaggtcaggaggtcgagatcatcctggctaacacagtgaaatcctgtctctactaaaaatacaaaaaattagccgggcgtggtggcgggcgcctgtagtcccagctagtcgggaggctgaggcaggagaatggcatgaacccaggagatggagctttcagtgagccaagatggcaccactgcactccagcctgggctacagagtgagactccatctcaaaaacaaacaaacaaacaaacaaacaaacaaacaaaaaaaacagaaaagacacagactggcaaattggataaagagtcaagacccatcagtgtactatattcaggagacccatctcgcatgcaaagacacatataggctcaaaataaagggatggaggaagatctaccaagcaacagaaagcaaaaaaaaaaaaaaaaaaaagcaggggttgcaatcctagtctctgataaaacagactttaaaccaataaagatcaaaagagacaaggccattacacaatggtaaagggatcaattcaacaagaagagctaactatcctaaatatatatgcacccaatacaggagcacccagattcataaagcaagtccttacagacctacaaagagcattagactctcacacaaaaacaatgagagactttaacacccctctgtcaatattaaacaaatcagtgagtcagaaggttaataaggatatccaggacttgaactcagctctgcaacaagcagacctaatagacatctacagaactctccaccccaaatcaagagaatatacattcttctcagcatcacatcacacttattctaaaattgaccacataaatggaagtaaagcactcctcagcaaatgtaaagaacagaaatcacaacaaactgtctctcagaccacagtacagtcaaattagaactcaggattacaaaactaactcaaaaccacacaactacatggaaactgaacaacttgctcctgaatgactactgggtaaataatgaaatgaaggcagaaataaagatgttctttgaacccaatgagaacaaagacacaatgtaccagaatctctggcacacatttaaagcagagtgtagagggaaatttctagcactaaatgcccacaagagaaagcagaaaagatctaaaattgacaccgtaacatcacaattaaaagaactagagaagcaagagcaaacacattcaaaagctagcagaaagcaagaaataactaaaggagatagagacacaaaaaacccttcaaaaaatcaatgaatccagaagctggttttttgaaaagatcaacaaaattgatagacagctagcaagactaataaagaagaaaagagagaagaatcaaatagatgcaataaaaaatgataaaggggatatcaccaccaatcccatagaaataaaaactaccatcagagaatactattaacacctctatgcaaataaactagaaaatctagaagaaatggataaattcctggacacatacaccctccaaagactaaactgggaagaagttgaatctctcaatagaccaataacaggctctgaaattgaggcaataattaatagcctactttccaaaaaaagtccaggaccagatggattcacagccaaattctaccagaagtagaaggaggagttggtaccattccttctgaaactattccaatcgatagaaaagagggaatcctccctaactcattttatgaggccagcatcatcctgatagcaaagcctggcagagacacaacaaaaaaagagaattttagaccaatatccctgatgaacatcgatgcaaaaatcctcagtaaaatactggcaaacctaatccagcagaacatcaaaaagcttatccaccacgatcaattcagcttcatccctggaatgcaaggctggttcaacatacgcaaatcaataaacgtaatccatcacataaacagaaccaatgaaaaaaaccacatgattatctcaatagatgcagaaaaggccttcaacaaaattcaacagcccttcatgctaaaaaccctcaataaactaggtattgatggaacatatctcaaaatggtaagaggtatttatgacaaacccacagccaatatcatactgaaagggcaaaaactggaagcattccctttgaaaactggcacaaggcaaggatgccctctctcaccactcctattcaacctagtgttggaagttctggccagggcaatcaggcaagagaaagaaataaagggtattcaattagggaatgaggaagtcaaattgtccctgtttgcagatgacatgattgtatatttagaaaaccccatcatctcagccccaaatctccttaagctaataagcaacttcagcaaagtctcaggatacaaaatcaatgtacaaaaatcacaagcattcctatacaccaataacagacagagagccaaatcactagtaaactctcattcacaattgctacaaagagagtataatacctaggaatccaacttacaagggatgcgaagcacctcttcaaggagaactacaaaccactgctcaacgaaataaaagaggacacaaacaaatggaagaatattccatgctcatggataggaagaatcaatatcctgaaaatggccatactgcccaagctaatttacagattcaatggcatccccatcaagctaccaatgactttcttcacagaattggaaaaaactactttaaagttcatggaaccaaaaaagagcccacattgccaagacaatcctaagcaaaaagaacaaagctggaggcatcacgctgcctgacttcaaactatactacaaggctacagtaaccaaaacagcatggtactggtaccaaaacagagatatagaccaatggaacagaacagaggcctcagaaataacaccacacatctacaaccatctgatctttgacaaacctgacaaaaacaagaaatggggaaaagattccctatttaataaatggtgctgggaaaactggctagccatatgtagaaagctgaaactggatcccttccttacaccttgtacaaaaattaattcaaggtgaattaaaagtttgaatgttagacctaaaaccataaaaaccctagatgaaaacctaggcaataccattcaggacataggcacgggcaaggattttatgactaaaataccaaaagcaaaggcaacaaaagccaaaatagacaaatgggatctaattaaactaaagagcttctgcacagcaaaagaaactacaatcagagtgaataggcaacctacagaataagagaaaatttttgcaatctacccatctgaatctacaaagaactcaaaccaatttacatgaaaaaaaaagaaaaaaccctatcaaaaagtgggcaaaggatatgaacagacagttctcaaaagaagacatctatgcagccaacagacacatgaaaaaatgctcatcatccctggtcatcagagaaatgcaaatcaaaaccacaatgagataccatctcacaccagttagaatggaaatcattaaaaagtcaggaaacaacaggtgctggagaagacgtggagaaataagaacacttttacactgttggtgggagtataaattagttcaaccattgtggaagatggtgtggtgattcctcgaggatctagaactagaattaccatttgaccccaaaatcccattactgggtatatacccaaaggattataaatcatgctactataaagacacatgtacatgtatgtttattgcagcactattcacaatagcaaagacttggaaccaacccaaatgtccatcaatgatagactggattaagaaaatgtggcacatatataccatggaatactacgcagccataaaaaaggatgagttcatgtcctttgcagggacatggatgaagctgtaaaccatcattctcagcaaactatcacaaggacagaaaaccaaacaccacatgttctcactcataggtgggaattgaacaatgagatcacttagacacaaggtgggaaacatcacacaccgggaccggacatggggtggggggctgggggagggatagcattaggagaaatacctaatataaatgacgagttgatgggtgcagcaaagcaacatggcccatgtatacctatgtatcaaacctacacgttgtgcacatataccctagaacttaaagtattactaaaaaaaaaaaaagaaagaaagaaaaaaaaaaaagaaatacagccacctgagacagtgacaattgagtaaagatgtgaaggctgaggcagcagccatgtgcttgctgggggaagagctttccaagtagagcaaacagtaagtgcaaaggttttggagtgagagcaaatctcaggtcccttttgttcctgggtttcttttcaagaaacaacaagggggacaccatgggaataggagagaatgaggaaagggcagttggagaaaaggccagaaaggtaacagaagggacagtggtagatacatatatatttgaattaagataggactttttgctgataaatttcaaaatagatatcttcaacagaaaaaaaaaggaacattatatgtcaagcgctaaatagtgaaaccaatgagtaagaagtagaaattctgaataagaaaataaaaattaaaaattgattctcatatatactttatgtctgatagtaaaaattaggatttacctatttgagacaactctctattttcaatatttaaaggagttagatgttatatttttggaaacttaatttcatgtgatggttttggttttaattgaattcttactgagaaaatggtgaatataggattatataggcatgttaaggactgagattagttgtacaatgaataaagaagttgaagtgggtgttcatatgtgattacattgatttagtgaccagttctacatgatgcactgtaagaaactcctaaattcaacatgatgcttctcggtgaaagttattgccaaaattgtgttctttctacccatggtctattgtacattggcttcttcaagtgcttagtttgggatttataataattaacctttatttataagaactaaccttttgatttttcacagtgtctggcttaagcaggctatgaacttagagtactaaagacaatctaactaatgtttctttgatatttgggatgtgataaataagccattgtgctgtgtgacacacacaaaaaaggtgcttcccttcaagggctaatgatcaagtggataagagagatacatatacaactaataaaacttcataagtaatggagtaaatgctttaacagcagtaaagacgaaacacaatggaagggccaggcagggaacaagtagtttgactgcactaaagacagtaagtctgcttcctttgatgggaaccttgacatatgaattaagggagtcaaagaatgtctgtaaacaccatctcccttggataagtacctggattgctaatactacatacgattccaccacaagatcaaggcttacgtctagagcaaccactgatatcacaaagccaatgatgtgttcacgttttaaagagaattaaatcaaataggcataccaagtatgcctatttgaagaggtagcaatgcctcaagtattcccagatgattttgattaatttccctcattccttctctcctgagtccagatctccccagcatagatttattcccaaatactatctccatttttatataatatatagtttaatatctatttctttattggttaagtgtctttctctgcctctggtaattagcttcctggggtgttttttctgtgtgtttttgtttttttgagactgagtcttgcactgtggcccaggctggaatgcagtggtataatcagtgctcactgtggccgcaacctcctgggctcaagcaatcctcctacctcagcctcccaaatagctgggactacaggtgtgagctaccatgcccagctaatttctatattttttgttgaggcagggtttctccacattacccaggctggtctcaaactcctgagctcaagcaatctgtctgcctcagactcctaaagtgctgggattacaggtgtgagcctccgcaatcagccattaattctttattaaaaaatatatatacagtgcatgtgtaagtgtacagcccgataaatttttagggttagggttaaatgaacatacctctttaactaaaacccgcatcaagaaacaaaacattaccaaccaactctgcagacgatcccttcctgccccaccccccacctcccagtcactaccactacctcccaccaaggctcctgatttctaacagaagagattcgttctgctttcacataaatacagtcatacagtgcacactattttgcatctgtattccctcactgttatactcatgaaattcttcaaattattttgcaaagttgaagcatgtctgttttcatcattctgtagcattctattgcattgctctactacaatttatttatctgttctattgttgatgggcatttgtatcattttcagtctgaagctattatagataatgctgaaatgagcatttcaatacatgtcttttggtgaacaaatcgacacatttctatttggtaaattggtattcggtgtatatttggtagaattgccatatcacagttgatacttccaagtaattttccaaactgtacttatttatactcctactagaagtttataagagtttcgtttgctccacatccaactcttggtgttttccatctgtttcattttagccattctggaggatatgtagaggattatctgtcttttttctactgatttttaggagttctttataaattggggatacgaaaccattgttgattatatgttttgcaaaaaaaaaaaccttcttccactctcttaatggtgtctttggatgtatagaagttaatatagaacagtaatcttttttttttttttttttgaggcagagtctcactctgtcgcccaggctggagtcccagtggtgcaatctcggctcattgcaagctctgcctcccgggttcacgccattctcctgcctcagcctcctgagtaggtggaactaggaggaactacaggcgcccgccaccacgcctggctaattttttgtatttttagtagagacggagtttcagtgtgttggccaggatggtcttgatctcctgacctcgtgatccgcccgtcatggcctcccgaaatgctgggattacaggcgtgagccaccgcgcccggcctatttttcttgtatcatagtttttttggggggttgccttttgggttgtctatgaagactttggccatccccaggtcaggagtgagttctacttttcctctaaaaggtatattgtttacttttcacttctagatctgcaattcattgaattgattttttttaaatcaatgatgtgaggttgtttttccctatacagatatatgattgacccagaaccattttactgaaacagggaattatttttaattcatttaaaatgtattagagctactgaaataagaatcaaatatatcttattatcttaaatatttcctataatctgaaatcttagtttaagtgtcaagtccccttttttttggggtctaacacaaatttccaacaaatatggaaagaataagagaagaaataagtttatttcactactattaatctattatccaaatattaaattggaatagttccacctgattcagcattttccattctgtccaggtgtagcactggtttttacatgattctctgtccaagaaccaaaattttttctggttacactcatgattagaatactatctgaaatataaaaaagcaaaaatgaatagaaatataggcatttttgccctagattacaatttcatttgcagacctcagtattgctgtatgttatgtccttcaaattccactcgatagagtggttgttttgtaatgcatatatcaataaaccacttaacccaagtgtattaccacatctcttacgcaggaatgtgagggaagtaagattgaagactatgcacttgtgaaattctataaacaatacactcagtttgctgagaagtgctatatttaaataacataagggttcttttagttctctatagttcctggaattacaaaaacaatgaaaaatttcatttctgaaagtaaatagatgacatagaaaactaatgacatatcattaatatctagctttttctataaaaattgacactttttagcacaatagaaaagatataaaatacattatgaagtttcacaagacccaagaaaccccccaaaaattgttcctaaaacaaaactttgtctctcatctttcagagacagtagactcaatggctggtatatcattgtcccataatatttggttctgttctgacaatcaactataaacaattaaaattttaaaaattatgggagagttaagaaatgtaaacacttggttatattattataagaaacctatgattagatagtttagattagattcaagatggcagcagggctgtatcccttcctggaggctctaggagagaactgtctccttgctgttcccagctcctggaagccgcccaccatccttagctcacctccatcttcaaacccagcaacagccagttcttctcatattgctttactctgaccttgtcgtctatctcatttgttcacatgtaaggactcttgtgattacattgggcccacctagataatccaggacaatctccatatttgaaggtcagcagattagcaaatttaattctatctgctaccttcattcttcattgccgtgtaacataacatgtccataggctcctgggattaggatatggtcattgtcactggggagctggggctgtgggtgtgcattagtctacctaccacgactacctttttttaatcaaaaagagagggttttgtgtgtttgtttgtttgagatggagtctctctctgtcgcccaggctggagtgcagtggcacaatcttggctcactgcaagctccacctgccgggttcacaccattctcctgcctcagcctccagagtagctgggactacaggcacctgctgccactcccagctaatcttttgtattttttaatagagacggggtttcacggtgttagccaggataatctcgatctcctgaccttgtgatccacccacctcggcctcccaaagtgctgggattacaggagtgaaccaccacacccggacaaaagagagtttttattagaaggcagttttcatccctctatcaagaatttaaatcacttatttcatttcttttccctagaggaaatggagaagaaatgaaaaatgtaataaaaatttgctttagaatccataaaatcaaaccaggtcctgacctgactataatatattttatgtttctgaaataaaaaaagaagtttatatccagaaaagcaaagcatgatcctagaaatgtaatttaataaagatcctaggcagtgaaatttgttgaaatttgtggccaaaaagtagataaattattctccatttacaataaagatgtgctacatactatatgactctgtttatataacattctgtaaatgaaaaaattatagaaatgaagaacagataagtgtttgcagggactggagaaggagagggaagctgtgaccaggaaggaaagcaggagggagttccactttggtgagagaacagttctgtatcatgattgtgctgccatgacagctataggaatatatatatacatgtattaagcatgtcatagaattatctaccaagacaagaaaaaagaagaacatgcaaaatttggtaaaatctgactcaagtctgcggtctattagttaattgtattatgccagtcaatttcttggttttgatagtgcacattgagagaagttgagtgattggtgtactacttttgcaactttttgtgagtctatagagttatttttttaagttgaattttaaaatatgtgtttaaaaaacaagacagaaatgagagcacagacagacggttaaaagttgaaaatgagcacttaaacatctatctgcaatgtttaaggtagaaaaggtgaactttcagattcagtgctatttctatcaaactacaaatgtcatttttcacaaaattagaaaaaaactactcagaacttcatatcaaaccaaaaacgagcctgaatagcaaaaataatcctaagcaaaaaaaaaaaaaaagctggaggcatcacattacccaacttcaaactatattataaagctacagtagccaaaaccacatggtactggtgcaaaaataaacacagaccaatggaacataatagagaacccagaaataaaactgcatacccacaccatctgaccttcaacaaagtagacaaaagcaagcaattgggatagggactctctgttcaataagtagtgctgggataactggctagccgtatgcagaagaatggacccctacctttcactgtattcaaaaattaactgaagatggattaaaggcttaaatgtaagactttaaactataaaaatcctagaagaaaacctaggaaataccattctgagtatcaattctttgccttggcaaagaatttatgactaagtcctcaaaatcaattgcaacaaaaccaaaaattgacaggtgggacctaattaaacagaagaacttctgcacagcaaaaaaaaattatcaatggagtaaacaacctacagaatgggagaaaatattcctgaactctgcatctgacaaagttctaatatgcagaatctataaggaacttaagtcagcaagcaaaaaacatacaaccccagtaaaaagtgggcaaaggacatgaacagatgcttcttaaaggaagacatacaagcagccaacaaacatataaaaatgcttatcatcactaatcatcagagaaatgcaaatcaaaaccacaagaagataccatctcacagcagtcagaatggctatcattaaaaagtcaaaaagataacagatgctggcgaggctgcagagaaaaggaaacccttagacaatgttggtaggaatgtaccttagttcagccactgcagaaagtggtttggagatttctcaaagaactaaaaatagaactaccattcaacccagcaatcccactactgggtatatacccagaggaaaataaatcattctatcaaaaaaacacatgcacttgtatgttcataacagcactgctcacaacagcaaagacatagaatcaacctaggtgctcatcgacagtgggttggataaagaaaatgtggaacacatacaccatggaacagtatgcagccttaagaaagaaagaaatcacatcctttgcagcaacatggatgatgcagctggaggccattatcctaagccaattaatgcaggaacagaaaaccaaataccacagtccccactcataagtgggccctaaacattgggtacatgtggacgtaaaggaaaaacagacactggggactataatagggggaagagtgaaggagggaaacaagggctgagaaatgacctattggatactatgttcactacctgggtgatgagatcgttcataccccaaacctcagcatcatgcaatatacccaggtaacaaatctgcacacgtacctcccaaatctaaaataaaatatgagatttaaaaaataaaaaatggactaattatgatttaatatttggtagatacatgggccaggtaaattagtaaaagatccaaaaattcattccaactctcaaaccattcgaaatctgtagttttatatgtagttctaattcaagcaactaaatagctttatccttaatttagtagcggaaaaaagggagcagaacaggccgggcgcggtggctcaagcctgtaatctcagcactttggaaggccaaggtgggcggattatgaggtcaggagatcgaggccattctggccaccaaagtgaaaccccgtatctgctaaaaatacaaaaattagcagcgcttggcagtgcatgcctgtaatcccagctactcgggaggctgaggcaggagaatcgcttcaacacgggaggcggagtttgcagtgagccgagatcgcgccactgcgctccagcctggagatagagcaagactccgtctcaaaaaaaaaaaaaaaaaaaaaagagggcagaacaaagaaagaagcattatttggtttccatagaagcatcaaaagttaaataattagactgctctcgaaatgaagaaaatatagaaagcttaaattcccaccccacgcgagctctgaagagacctggatcctgcccagaggagactttccttcactggtttgcaagaagccaaacctctcatggggaactttaaaaatagggctcaaacgtttgtctacttcaagctattcaagataattccataaagcatctttcaaagatatgttaagtttaagatatgggtgttcactctgattcaagaaatttcaaaacagtcatcctaactgtgccaggacaaaatgctgtatcaataatcgttacacatagagaaaagaaaacattttatacaccctaatgactttttggttacccagtaagggtctgtaatcagagaagcagcaacatcaactacagaaagatggagacgcagcagaaattaatggcagaaaaggaactcgggatgagagtaagctaggatttgataaatgaatcttgcagcctctggaagattttgagagctgattcccactttccttttgatagagggctttaaaatcccctgttagatcagcgaagctactgaggaatcgaacttccattttctgatactgaaacagaaacaaccacacaaatctatattcaaagcttgttcaaaacagtacatgctcctaactgaaatctggcaagttcaaatccccatcctgccacttactgtgtgagttgacgaagtctctaaaataaactgagtctgaattgcagcattagtaaaagggaattataataacggttaacatttattgaggggttgctatgttccaagccttgatctgagtttatgtatatggattcatttaataacacttaatgaaatcctactacttacctcacaggaaatgatcaaatgtgagggataaatgagctacaaagtgtaaaatccccagcactacaaggtactgaatacctgttggcttcctttctttggtttttcttttttggaagtttcccttgcagtggttttagtattgaggctccagctggccacaccctatcaggggtctccattagtgaggttgaaaatatagtactgaagtatttgcagaagcacccatacaaggctagcagatagctcttaaataattaccactttaatacttcagattccatcaattaattataaaaatagctaccccccaaatgacatctataaaatgttttgttatcgtaagaataatgccatatagatgaagcacaattattgctctttttggttattataatgatcgactttttaatggtagtgatggcgtgtagatgtactgatcttcttagtcttggtgctgagcccattaactaattctgagctctgctctgccatggatgagcattcagatacccgtagccgtaggattcatttggaattcactttagaaccaaacctctcttcccttctccctccaattgaccctcacctggggcattgcctacactggaaacactgacgtccccaagggttttgagcctccaagtactctagctataccctccgcaaggccttgattagatgttatatgttcagctgtacatagaagtccactttctcctctgtgtaaactactttttaaaaggaagtgtgggccggccgtggtggttcacacctgtaatcccagcactttgggaggtcgaggagggaggattgcttgaggccaggagtttgagaccagcctggacaacccttgtttctctacaaaaaagaaaataaaaaattagtggggcatggtggcacgcacctgtagtcccagctactcatgaggctgagacaggaggattgcttgagcccaggagtttgaagctgcagtgagctatgcactccagtctgggtgacagcactccagtctgagtgacagagcaagaccctgtcactaaataagtaaaaggaagtagggcacctacagaatctcagtgagttatttcggtccctagtgactctgtgtctattagaattttttttaatcatatgagttgagaataagaacaaacaggttgacacagcctaaatggcatacatcataacattcctgaaaattgcacttagtccttaatcaaaacccgtgacacgttaattcagtagcaactctttctttctttcttgcccaaatctctaattgcaactagaggggaggaggtattccctttttttctcctgcactttaagattaccaaatctttgatcagtttagcaatttagtttctctccctgattcagcaatttatgagatagctccacataccatcttctgataatcagtaaacataacatgagttatagttcttaaatcacagagctttggtgaccctcagtcgcaaagtggtctcttgaggatttcaatacttttgagcaagatcatgcaaggttagacctttaggctaactacccaggttaaaagcccacgactgagaacacctcttccattcttctcaccagacaccctaagtgactctattcttctagcattagatgtctggaaaataatgttagctcacattttctgcaacacacattatacagaaactttttttttttttttttttttgagatggagtcttgctctgtcgcccaggctggagtgcagtggcgcgatctcggctcactgcaagctccgcctcccgggttcacgccattctcctgcctcagcctcccgactagctgggactacaggtgcccgccaccatgcccagctaattttttgtatttttagtagggacggggtttcaccgtgttggccaggatggtctcgatttcctgacctcatgatccgcccaccttggccccgcaaagtgctgggattacaggcgtgagccaccgcgcccggcccggaaacacattttcaaagtgcttttctgagataagtaatgtatgccatttatatgttactaatgttcaattcagaagactactattaatttctagttgctatgaaagagtgtttaatggattttcttctcaatgattgtgactgcattttaaataagagttctattgtaattactgcatcaagaactctttggctcttcaaatattaaagaacatatagaaatgtatccatcataacatctccatctctaaagaattttagtatacatcagcggccttttctagtatagcatgtcttaacaattagccaaaaaattatatgctaaataaacttgaaattagctttatttcataaatcacagaattttcgagctcaggggacctaaagcatgaaatattcctctaattttttttatttttttatttttttgagacaaggtcttgctctgttgccaggctggagtgccacagggtgatcacagctcaccgccaccttgacctcccagactcaagtgatcctcccatctcagcctccacagtagctaactggaactacaggcatgagccaccgcatctggcttttttttttttagatgaggtatttctatgttgcccatgctgctctcaaaccccttgaccttaaacaacccccccaccttggcctcccaaaatgctgggattacagactagagccactgggctcaggctctcttccatgttcttaatctctttcagaacgtaataaaaggcaataacacctgcagactttttaaaaaacaaagtcctgatttagaccacctcttttatttttcagatgggaaaactgagtttccaaagattaagacttggccaaaaccacagagcaggttctaaggctcaagggtgaactgaaacctaagtaccccctcacttgaccaatagtggtttttattaggaaaaaaagctgttctttagtgaatttctactttaagccaggcaatattttgagatattttatccatattagctctaaagttacaaatgataaaaccttacaagataggaattatttccccattttacaaaaacattcacatttgagagattaaataattttcccacgttctcatatgtaattcaacaagaaagccaggatttaaatccctgaatatccaaactccaaagcaaaaacaacaacaaaaccccacagtattacattcaggatagtatctttcactgaacatagttgattcatctgtaagaaaggaacaaaccaatcaaaggttaaaaatgagtaatgttgagtaagttctaaccttgagctacatagtagtaaagcccccaaatttccaagtactatatatcacatttccttctgatccataacaaggtgaagatgaagatagatgcctatgtactatttatggctgaataataaacttcacagaaaattctaaatcatatttcctatacccatgaccttttctacaatgcaaagaggactatgtgctccccctaacattatgataataaattagactcttctgtccaacggtcataaccacagggtcaccatcaggaaacacagaattctaatcaccgacttcatttcctgactgctgtggggaattttgaccgttttaggaacacagatagatatagcaacgagaaggtcacccgtgtgtccgtttgacagatctaatgcctgtcgataatcggtttgatgtggacttcactttgaattttaaacagcaaatgcaaaacagccaattgtttctccttattccatggggaagatcaaaaggagccttatctggactagagacagtttatttccatctcagaacaaaagacaaaagatactgtgtcttttcctttcctctgagttcctttccactccctttcctgattggcagtaatatcctgaccattaatctacgtattttaagcataaaatcaatttctgggacttgtctcatttatttccataacaggaataatggaaatagcaccaagttgctactgagagtaaaagagatttaaaatactgtgttaagctctcctttcagacacatgatgatatgaggaactgaagtacaactggaacgagatctagatacagacctagagctctgggaagaataatttcatttaggaaaatattggtccttcctctcattaaaattttgagaatccagccaataatcaaatttataaacttctttctcgggaagccattctaatctaaaggctatttgtgctgtcttcttcactcagtcaaagccttagagatagacgttttatgtcttagaagtggcctcataagaaagataagaaatggagaacaagtacagcatggctgcactattagagacatcactgtggcttagagaggccaatctgagacaacatctagcctgattctttatatgcaaaagcttaatttccctaagaacacagaaaatgaaaaaaacatgcagatttattttttaagaacactctaaagggactaagtattaataaatggtacttggtgtacattgtcagtcatagaaggccaattgtatgattgggtggtctaaaaataagtttagtttttgtttttgttttaaattgcggtttaataaaataacaaatgtgagttatacttcccagttggagttacttaaggctaaaataatacatgcaggtaatgccatttgcaagactgtatggatcaaataaatactgttttgtgggactccgcccagaattaagtgactgatccaatgagaattgttattagaaattcattctcattttgagaatccatccaatatgcaaattaacaaatttggtagctgtgcaggtgcctttcacatagcaaggctgtgctctttccgggatctgtactctgatttcaggcgtcacccatcaagccacaaagagccacaaatagcagctttgagacccggtagataaaataccgaggtttccccactgagaagccattcagttttaatccataatccccagggaaatgagggaaaggacctcggctaaatccaaaaggaggcatggtccagatcacacacataatatatgtaattctgtgtaatcagagtcgcttactaaagagtccccaaacccctcatatgaagattaagttcccttgcaagctttcagaaagggcagttagacttaagaacataggaaatgttaagacaaaaggagacttgagcagagtcaactttagttagtatttgtgccttttacgcccttaactccctttgtaaccattttctgaattatcttcttgctgagtgtttaccctagaatgtacacaggttgtttccactagaaaaggtattttggtcatttcctctagttgcgtagttcagctcaatatatactagggcctttttcatgttcattcagaattcaatccattttctgggttttgtttgctttgaaaggagatgaactaggcaaaatttttctaaccccgcttgcttcattttcatcatagggaaatgggtccgtctctcaggaagcttctttttctgccacctccaaaaaaataaggtattttctccagggccacagggcaccaattcccagcgtcctctaaactcacctctcaggccccacctaggtcccagcacctgcagtctttctcccccatagctgcacttagtatgaactgggattattaaacgatttcaaatagccagatacatgatcagaggtgtgtctaaaaaatatattcagcagtttaaataagttggcttatttgatccatttaggtaagtttgacttattcaatcagtttaaataagatggcttaaagagaaatcgggcctggagccacggcttatgcctctaattccagcactttgggaggccacagcgggtggatcacttgagttcgaggccagcctggccaacatggtgaaaccccatctctactaaaaatgcaaaaattagccaggtgtggtggcacacacctgtaatcccagctacttgggaggttgaggcaggagaatagcttgaacccgggaggcagaggttgcaatgagctgagattatgctgctgtactccagcctgggatacagagcagaccccgtctaaaaaaataaataaataaatgagagaaagaaaaataaatcaaacacgaagtgattagttaatggtccatagccctgatcaaaaggaatgatggcctgaattagggtaatggcaggagcaacggcagacacactgcagagagaaaatgtgctgggctttggaaatcatcagcattaggggaagagaatcatgcagaggagtatgtggtcaaaaaagatgccagggttctgagcctgtgaacggggatggcatcctgtcattagggaaacaccaggaggaaagatggtgagcttcattgggaataggttttgtggccatatactttaagatgtggaaatacaacctctttccagtccctctggctcccagtggtggaaatagtgacatagtatcgactactgtacccctaggaggaatcatatcagtgaccctggattaaacactttcccagatctgcccttctagactcatctagccatctgagtgacacgatccagagagccaatatatgggtctgtgcttgaggaaactgacccaaggaagccattcaccctactgctagtcaaggccacaagactgagtggaaagagaatcattgccactcatgtgtggtcggcccttttcaccagagtaggggaatacaggaaggtgtagaggccgatgttttgattggagcgtccactgctctggctatactcttcaggaaaacgtagttgaaggagcagctgtttaagatttcagggatcctggccaaatctttccaaaagagctatagcaaacagaaatcctggccaagtgtctgccttcagcactaacagcattgtgttagagatggaacagagcgtgaaagtacggaccatgaggtgactgttgcaactttgggtctggagcactttatgtgaagctcagaatgtctccagcaatgcaacaatattgctgctcagtccacgtgtcatttacctaccagctaccctttccgtgtgtcacgcgaaaacctcttcaaattccttgcctacttattccctttctgaagtaggccacttacctttctttcatctccttctttcttttaactgaacacttagaatctcattaagactactgtataaagtgggattgctagatctagcaaacaaatacacaaaacacccagtgaaatttgaatttcagataattctttcattatatatcaaatattgcataggacacagttatactaaaaggtatacttgctatttatctgaaattaaaatgtcactaggtagcatgcattttatctgacaaccctagtagaaagagaaaccaatcagaaaccagtcataaagccatccatatccattctgcaacttaccatattcagatgacaatttcttcactgatatccggggctacaaaggtacttcaactcccacacacaaaatgcagcaaaagcctccagaaaatggaaaatggagattcacaatctctgctaattcagattccatttcataaccatcacaactccattttcactaatatagtttaaggcaattccactgaattgccagagctgacaaacaattttagtacaatgccattgacagtgtctgggtagagcatttgtgaaagctctgaaggagaagtctcagaagtaaaatataattatgacagaggaaagagctttctcctgatgtaaaagtatcaatgtctgcactggctatgccttgctacctccagaggggtgaagtttttgtaccaattcacacaccacatcccatgccaacatggttccatgttgatatgctcatatagataagatcccgttaaaattaatgccaagaggaccttcaaagggaacatcaggaagatgagagaaaacaaggggaagatatcaggcatatgacccaactaccagccctactgccttgactggatgaatatgatcattctacattggaccatgaacactaccttgggtttttttgtttgacacacagatagacagaaacacaaatagacagacagagagagagacagacagacagacagacagatagatagatagatatagagattttttttttttgagagaagtctcgctcttgtcccccaggtttgagtgcaatggcttgatcttggctcactgcaacctccgcctcccaggtttaaacgattatcctgcctctgcctcccaagtagctgggattaaggcgcctgccaccacacccagctaattcttgtattttttagtagagacagggtttcatcatgttggccagcctggtctcaaactcctgacctcaggtgatccgcccgcctcggcctcccaaagcgctgggattgcaggtgtgagccaccacgcccggctgagaattttttttaaggcagtgtctcctctgtcatccaggctggagtgcaatagcagtcatggctcactgaagccttgaatccctgggctcaagcaatcctcccacttcagcctcctgagtagcccggactgggcatgcatcacaatacttggctaattttggggttattctgttgttgttttggtgcattttttttcccttttgtgtttgtagacatagaggtctcactgtgttgcccagactggtctcaagctatcctcccacctcagcctcccaaaatgctgggattacaggtgggagccaccacgtctggccagatcttgatctagctagctccttctccctaggctgcctcctgagtattttaagccaccttgttctggaagtagtaggaacctttccccagtctgattcctgctgttttagccaccacaatgtatcactactcgttctcttcccatcccaccccacacacaaaagtgcctgtgactggtgttgtcacaggcacttcgttgagctgcctaaattcatcctttcattgaaatttggaggaaccacttattctccaccttaatgcctgggaaccctagaacaggagcctcccaaccattttcaaaattatttcatgatcctaggtgctttccagaaggtcttgcactgaacactagatgaattatgttcctttctcccaactttgatcagctgagcatgcaatttaccaatcaaacaatccagtactgagtgcaggtaaaaatgtgtcttaaaggtgtggattaatatttttatgatattgcaattttaacttattaaagaagtgtggtaatattataacacaatggactcttgctgactatgagccaagtaacatatatttaacattgaggctaaaatcgtgggccaccaagctgtctttcagcctcttcatgtatgtgtgctggttgtatgcctgcctgtacaggtgtctcaaagccctacttagagaggctacatggtgtcaacaagtacagacaatggcaatgactttaggaaagatcctcagtcaatttgataagtatgtaagaatcctcaagccccattgtttactttattcttagttttagaaacagggtcttcagactggaatgtagtggtgtgatcctgcagcctcatactcctgggctcaagagatccttctgcctctgctaggaatacaggagcatgacaccacaccgggcttttttgagggggctggggaggcgtaaagacggggtctcactgtgctgcccaggctggtttccaactcccggcctcaagtgatcctcctgccttggcctcccaaagtgctgggattacattcgtgagctgtacccactgtaccagccaaacccagttgtttaaaactgtagcctactggctgggagccgtggctcacgcctgtaatcctagcactttgggaggctgaggcggggagatcgcctgaggtcaggagctcaagaccagcctggccaacatggtgaaaccccgtctctactaaaaatataaaaattagccgggtttggtggcaggcacctgtaatcccagctactcagaaggctgaggcaggaaaatctcttgaacctgggaggcggaggacgcagtgagttgagattgtgccattattctccagcctgggctccaagagcaacacttcatctcaaaaacaacaacaacaacaacaacaacaaactgtagactaccatcattgagttgccaagacaacaactgctttcatttcgatattcttcaagttccaaaatggtttagctcatctgccaagaccatagaattgtttgccttttcctgatctcctcttatgtttctcttaagtagtcaagctgttccaagagcagtggctatacattgaggcagccactctatatagcagtggtttccaacctttctgctataaattcttatgaaagtcaaaaactttcataaacccctacagaagtgcagctgtacttttattctgttgattgaaatataccaaacggctgctatgaatttggtacattttgaaattactttgtgttttatttatcacaaaagcctctacctatattttaataacataaaatgtgtacatatctgagtaagatattttgtcccttatgtctaaaaatactacgaatattgatttatggcccttttaacaagaagcacagggctctgaacatgagttcgcattgcacaggttaagaatcagtgtattgttctctatgttctgtagcatctcagaaaagacatccacaaggaagcgttctctccaagggatgtgagacatttccataaggaacagaggtacatataaaccagtcaccctcaaaccagaaggggcagggacagggaaagtagtttaagttaggatcagaatcaagggcttgtaatcccaagactttgggaggctaaagcaggagggttgtttgaggccaagaattcaagaccagcggcaacaaagcaagacctgtctcaaccaaaaagtaaaaaattagccaggtgtggtggtgcgtgcctgtagtcccagctactccgggaggctgaggtgggaggatggctcaagccatcctcttgatagaggctgcaatgagctatgatcatgccactacactcagcctgagcaacagagtgaaattctgtctcaaacaaaacaaaacaaaacaaaaaaaacccacaaatgacgctgatcacctccctttcactgcattcagtgctgctcttagaatcgtcaggtttactgtggtcgcacttactatgctcctgttgttcctgcacgccttcatctaggtttcatttctgcttcacgtagacataggtggtatattttgggtgaggaaagagattaattagattaggttacctatgggataatcttttgtaggcctacctctcccactcccacctccctaaatctttttgagacggagtctcgctctgtcgcccaggctggagagcagtggcgcgatctcggctcactgcaagctctgcctcccgggttcgtgccattctcctgcctccgcctcccaagtagctgggaatacaggtacccgccaccacacctggctaattttttatatttttagtagagacggggtttcaccgccatgatggtctcaatctcctgagacctcgtgatcctcccgccttggcctcccaaagtgctgggattacaggcgtgagccaccacgcccggctccaccttcctaaatctatcctgatccccaccccctctttcatatggtagtttcacaaaaacattgaaggatattatcaatcattacctgctccctgccgtccctaatcaaagccctctcttttaacatagagctaggatgcatgaagctttctgcggtttagaagccaaatcattctggtggtttaacctatgccaggtaagagagagagaggaaaagaggaagaaagtaaggagagattcctaaggcccttgctcgccttatggagtgaagtaaagcagagatgggaatgcccagccttctagccaccacatccaagaggacagagcctgtgaaagcccagtggggatgatgagaaacattacaagtctttaaatcaagctggaacaggtactggaatattttctgagtcaaacagcattcagtccactcatcagagtcattctttatgactcaaatgtttatggcttcaagttagcaacacaaagttagtgtctccccaccgccttttaatttttttatttttttaggctagtcaagtgaagcagcgggcgtggagaaggaacaaaaaaatctgtaactggttgtgatcaattcgttgtagataccattgcacttggaccagcccccctactcaccttttttccaagacggagtctcactctgttgcccacactggagtgcagcggcacaatctcggctcactgcaccctgcacctcttgggctcaagcgattctcctgcctcagcctcctgagtagttgcgattataggcgtgtgccaggacacccggctaatttttgtatttttagtatagacagggtttcaccatattgtccaggctggtctcgaactcctgacctcgtcatctgcccgcctcagcctcccaaagtgctgggattacagacttgagcctccacacctggcctcgcctttttttttttttttcaaaccaggtttccactccatgcctccatccatcccttaccttcttgcttcttgccacttgcccttcagattcacacactccctggaagaacatccccaggaacaagcaccaactaagccatcaaggcctactgggtggagacagactttgccctggatgccgtctggagagacggtggacatgtgtgggctctgttctgtagtacctgtgccagctcacccaggaaagttatgagatgatggggtatggggagaggaaagccccagtctgggtttataattgaggtgatacacctagaggtttcacaatagtaaacaaaagaggaggtgttgaatgagatggtgccttcagcaagggagagggcacagagcccggagagcccactaagtcctctctccacccttggaaaaacctgaacgtgagaatgcgcagctgtctcccgatcctttgataaagtgcagcgccctggagtccttcagagtgacccagtactgagcctctggggtggctggcaccactgcctaacaagggcaattttacgaaatgcccgcttggcatcccgtgtgatactctcacttaggagcttctgtagcttggcagaaactgggaacccaaagctttagggagtggacgcatgagaattttctggcctcaatctcttacagtttcttgggctcctgccaccgtactggtatttgatttagaggcctaaaagggaaatcagtcccacgtgggtagataacaaaacactctccaccttgggctcatggagtggaatttgaatatgaagccaaaactcctatctctgcctgcttcactaattacataaatttccttgctacattctgcagctgtttgtatgaatacagcgctggttcccagagtggtccatctcaacgcaaaggttcaggggctcagggcactcatccctgggctgcaacccagactccagtgttagttgtatgtctgttgggtgtaccaggggaccctggatttgtttctctctgtcataaaatgaagctaaacaaactacctaacctgtcttatgatgcagaggtgtcaaagaaaaataagacagaggaaaaaaagaggagagatgtgtggcgggcggggggggggggggagggtggtggttgtgaacattaactctagcaataaagattactgaggaaccttaatgaaaagcactggaagaaaagcagggctagatctggagggaagtatctgtccctccctttaaaatgttccagatttcactatgggaaagcttcacagatatcacaagatactgtttgacccgaggaagaacaagcacatattactggatgcatttcctcttctcttacctgtctcagaacctctcgccagccttgtctaacaagattcacctttgttttcataggcgtcacaaagttagggtcaaggtacaattgaataatcatgaattttccccaaatacacaaatgatttcaacacaaccgtttctaaattaaaatcaactgtagttactccaagtagagcaaatgcattgtaaaatactgtttcttttgtttattatgtagaaagatgaacaagtttcactgaatatggctcccataaataagtgtacacttaacaaaagtcagacacacaattaacccctcttgatgatatggggtgattgggcggggaccccagagatacactatggttaaaaacatgggcttttatatgacacacagatgaaccaataaaaatgtgacctcttgacatatataaaaaaagctgtcttgagtttctctcattgaaatatctgaaggctttaaaactttaaacaaagcccagctggtttgtatgcacaagttccaaaccctgaaatattcccatgatatctcgtttcaaacaattctacttcaaagaattctactactgtaaactagtgagtaaactaaatgagtaagttttcccttttaaaatgtgctttatttttgttgtaaagcatgttgtgtggtaaatagaaattgagaggaaaaaacgtcaattgccctagtggaagaggaaaagaaatattatgattccaagtgtaataaaaattataaaagctaagtttccatgcagagtgtgaaagaatctccaaggatttacattcagatagaatttaattatagccaccctgttagcatttaaattctagagctcaggatagcatttttgaagacatccctttttagacctctgccccgacaatatagttatttttgtgaggcaacaggctgcttgacccttcttcagtcagcttagattagttcagttagcctatgatttgggagccaataaaaagtaggtgtgtggtgattaccaaagatttcttatttttcaaatgctaaattacccttaatcactgcctttttttgttcctcacctgcttattccaattgtcccctctgaagctatgcattagcaggctctctcttacaaaaacacatgttcttccctgtggtaaattttcgtctgttcccaaactccttcaaggctcaatttcactttttgctcctgtactttctctaaccccgcctactcaaattgcacgtattcttttttttctttttactgtcaaagattatttgagtccttaatgtcatagagtatttcagacttgtttgcttataccaaaaaagggaaaaagatagtttcactgggtaaccggttttcatttgtaagttatggtgcagagaagtaggtatcctgcctcttatggcttaggtaattaagtttgcagggtcagcgtgacacgcatgacaaagttccaaaaagtccccggtaaatcagtctcaaggttctgcgtgaacaccatcagcacaattgtttacacttcctgtctgagaatcagatttcagacgttgcagttaatcctggaattttactctaaccttcatactcggaaaaaaaaatcacaaaggcaatagacagtggctattctgcctatcccgaatgtattctcggaaaatatacattgactttaacaaggtttccattttcaaaggggcaaagcatagggttgcccctggataaatctagtagttattaggcgctggctggatcctactgagggatgctctgagctagccttccacctaaaatccctgactttttgagttgcgaacattctctttagccacatcagatacagggacacttggaattttcataacctttcattctagagtttataaatgtggacacccaccctttcctccccctaaccagtatgattacgccctggaaggaagggatgggaagtgtgtgcatgcgcagcccgccaatgactcaagagtcagaatttccgagagaaaatatttgataggttttgccaggctttggtgggaaggaaaagaagagttttcatcagggcaactcacacaacagaacaatgtaaagcatagtgagagctaatatataaaaagcatctggtacacccagcgcactctcaccttgtaaccttgtaattatttagcacagcaggaagaaattcagaacaaaacaaaactatgtactcaggatactgtatgtgaatgtaacttggatcctacgggatgacattttggccatgatattcatggcagaaagttgctataggactcagcttggagtaagggttgaaacagttgttaacagtaagcttaataatatattaagcaagctaacttcccaaaagaaaagaataataatctattttaaagattattaatcttgaatactgtcgccacatctttgctggtttgatgggttgatgtaccttgctgattaagcaacaagaaaataaattgtcacatttgtctccaatttttaagttggcaaatgagggatatatctagaataaatttaaagaacagatttttttcaaatgtctaaaaaatcaagactcagaatgaaaaatgagatagaatgagtttccagtgcatttatttaaaaatatttcactcttataaaataaaaactagttagaaggtttctcatttcactttatgagctttcggctcatagcgaatatattcagttaaagttactaccaacctacagctctgagttcttttattcctcatgtgaactattaaatgtgatctttattgcattttcattaataagtaatatttagcaggagacctcagatttgggggtaattctaaattagcaaaatttttatcagagtcataatgaagaccctcaaattgcaacttaatatagcaaacaatattactttaaaatatatgggaacttatcaaatattagaatatttaagttttatttaactaaaagcatgtatctcaatattttattaattaacttcctgaggcactgaagatacctactttggtgaacatgtttttttaaaaaaatagatttaaattattgttttagcctaaaaatgtataaactagaacatttattataattacagtacttaagactctaaaactaagaatgttaatgtccaaccatatcttttatttttcatttgctttttggtggaggtggttttgtcatgtgctcaccataaaaaacctacaggcaccaggatatttactgaagcaataaaaaactggatacattataaatgaccatcaacagaagactagttaaataattaggatatagccatataatagaattctatgcatactttaaaagaaattgagtacatttatacaccgatatggagacattcgctttaaaaaaaaaaaaaagcagcgcaagttgtagaaagtttgcatagaaattagtgaagaaaaagggtgtgtttaaatacaagtatatacgttacagaatgagaatgcctaggatatgacagtaattgcatagaaaatgatttgaatgatactacctcatatacgaaagtttcacttttgagtttattcaattccatattatttgaattttaaaaacataagttttttaaatttataaaaaacagtgattgctataataggattcccttatctacctatcaaaattttaatagcgcttatttctaagtgaaaaattgagtcgtttttctattttttcttccttgatcatctatataatctattgtttacattaaatatgagtgtgcaataaagtattgagaggtgacaacatgctagcagccctcgctcgctctcggcgcctcctcaggcctcagcgtccactctggccccgcttgaccagcccttcagcccgctgctgcactgtgggagcccctctctgggctggctgagaccagagccagctccctctgcttgccgggaggtgtggagggagaggcgccagcaggaaccggggctgcgcactggcactcgtgggccagcacgagttccggatgggctcgggctcggcaggccccgcactcggagcagctggccggcaccgccggccctgggcagtaaggggcttagcacgcaggccagcagctgcggagggggcgccgggtcccccagcactgctggcccgcaggcgccatgctccaattctcactgggcctcagccacctcccagcagggcagggctcccgacctgcagccggccattcctgagcccccaccgcagcgggctcccgcaggcccgagtctccctgatgggtgcctcccgctgctccatggtgaccacccgagggctgaggagcgcaagcacctggtgcggccctggcacgggatccactaggggaagccagctgggcttctgggtctgctggggacttggagaacctttatgtctagctaaaggattgtaaacacaccaatcaccaccctgagtctagctcagggtttgtaaatgcaccaatcagcactctgtatctagctaatctggtggggacttggagaacctttgtgtctagctaaaggattataaacacaccaatcaccaccctgtgtctagctcaaggtttgtaaacacaccaatcagtgctcttgtctagctaatctagtggggacttggagaacctttatgtctagctaaaggactgtaaatacaccaatcagcactctgtgtctagctcaaggtttgtaaacacaccaatcagcactctgtgtagctcagggattgtaaacgcaccgatcggcattctgtgtctacctctaggtttgtaaacacaccaatcagtgccttgtgtctagctaatctagtggggacttggagaacttttacctctagctaaaggatggtaaatgcaccaatcagcactctgtgtctagctcagggattgtaaacgcaccaatcagcaccctgtcaaaacaaaccaatcagctctctgtaaaatggaccaatcagcaggatgtgggtgggaccacataagggaataagagcaggctgctggagccagcagtggcgacctgtttgggtcgttttccacactgtggaagctttggtgtttttaagtttctgcattaaatcttgctgctgctcgctctttgggtccacactgcgtttatgagctgtaacagtcactgtgaaggtttgcagcttcactcctgaggccagtgagatcgcaaactcacggagaggaatggagagctctggccgggaggagagaacaactccagacgcgccaccttaagggctgtaacactcacagcgaagatcagcagcttcactccagaagcctgcgagaccacgaacccaccagaaggaaaaaaaccctgaacacgtcagaacaccagaaggaacaaactccagacacaccatctttaagatctgtaacactcactgcgcgggtccgcggcttcgttcttgaagtcagtgagaccaacaacccaccaattccaggcacagtatgaatgttaaaaattttaaggaagagcatagggtatttccacaaagcgaaaatgaaaatatgcggaggcaacatgctaagaagaaaatataccttaaagtctgttatggtcaaagtagttacaaagtttcattaagtcataaacttaaattcttctaaccaactaattctctaaggcaaaaatggcagcagcttttcagataattgaccaagttatggttggttgctttttttttttttttcttccccagagacagggtctcagtctgtcacccaggctagagtgcagtggcaagatcatggtttgcttcagccttgacctccccagactctggtgctgttcccatcttagctaccaacccacccccagtagctgggactatgggcccaagccactgtccctggctaattttattattattattattattggtagaggtggtgtttctccacgttgcccatgcttccatttgttaagcataaagaaaatacaacattcatttttaaaaacttatatttgaatggcattagcacaccttcggaaaggttgcctcaatatttcatggaaattaaaaccactgcttcattaactaagaataattcataatccactaaataaagacgctttaattaaagctttattgagataccattgacattattcaaacatattgagtcatttttttgggttatataaactcagaattacagagtttaatccaaaatctttgcaggtgaaccaaaaagaatgatttgtgtctatcaagagaagcatgcaaagttgttaaccaccattagcaatgactagatggtaacttctgggtcatttcagaacacttcttacggactttggaaaacctggcactgctgccactttttgaaggctctggactttgtctaaagaaccaacctgtgccccacaaagcatgcctaaacttacaagtacagttgtgcactcaaagcaaccctgagactgtatttagtaaacatggaggggaagttcatactgtccaattaatatgaaactataaaaaatgggcaatccataatatgacacagcaatagatagaacacaaccatatttttctgggatggaataaatcgcagagatctgttcctgcaggaacagggtctgaatgcaacagcatttattcataacatacattatgcagccttaccactttctttttttaaaaaaaataacttttaccgacaataaatgtaaatggtataaaattttaaaggtgtaatatagtatggaataaaaagtctttccccaacccctgtccttcagacactcaggttttcttcacatcattttcattttgttttctacttttaaatctttgatacatttgaaaaatacttgggtgcaaagagtaggctggggtcaacttctttagtttctggatggcaatcaaggtagctcaagctcagatactgattaatcatttctcttttcttccgttgatatgcaaagctacagtcaattaaatctaaattcttttttctttttcagtccatttctagactgactaattccattgatttgaaaatgcagattacacttaagcacacacagaggctttagagcctgaatccctgggttggagtctcagttctactgtttaccacctgtatgaccttaggcaagttgttcaaattctgcctaaattcctcatccataaaacggtgatattaataatcataagattgttgtggggactaatagttgaaaacacttcaaaagtgcatacatagtactgaatgtgtattatcattatgctgaaaattcgctgttggtgtttttactggtaattcattaaattgacagagtgaggaagactgacatctgtaaatgctgagtcttcccatgtaaacatcatatgttttatgttttcgagtccactttcttcagacatctgcccacagatctttacccgtgttttataaggattcacattctcctcttgtaattcaacttccccagatatttcatcatcatatggttccaattcctgtaattcctagttattacctcccaactaccctgttccatctgtagacatctcttatccaagacacttcactgagggccttgactacaacctgtccctaatagaatgtagcaagttgtatttctttaaaacatctgagcttcactattacttatgaaggctcatgcatttttaaggccagtattttctccagggaagaaagttctctgttgaaatatttttctggatgtgaagtctgtttgtagaaagcatcttgagaaatcagacccctcagtgagattttatgcttgaagcctttatctgagtttttgtttcatgcacattaaactgttactgaaaagcacgggtcctttagagttcagggggaaagtgtttatgaagatctaagactgagttaaagacaaagccatagccagaggcctggtttcctgcaaaggaggaagtccccactaatatgtcatgcttctgtctaagaggatattaaagccatcgcaggcttctgtgtttactgccagtcatgtgtctcacaatccctgtctgtaccagggagtcacatgataagggttacacaccatggctcatccatagctccttgttaagggcaatacagtgagtaattacagtattggcgacaaagaaaaaaaaagagagacaatgaaacccttattattagttaccatctcccaatcactgtctaatgtaatttgaagaaaaaaaatacaccttgaaaggaataatgaagcctgctgggcaagccattgcaatacttaattttaaaagaaaacactcattaaacttttttcttataaaaaaagggcattacaaatagatgtaatgtgagaagccacagggcctccccagacgcaacccatagtgctgtctttcttctccatttcttttaagctgtctaagagggctggagaaacatatattcacccgcacatacacacatatatgcatcccagaccacaaaagacattcaagtggtgtcggttttatgggcaatacaacacccttcagagacaaatggctgatgtaatactggcccagagctgacagatcttgagaaacgcctattatttccttgagaagatttctttaaacaaagtatgtggttaccagcagaatgaagtctcagttttggattttgagagtaattcatttaggcaagtattccccaacccagtgcaaacaagaggcctgacgcccccaggagctgttcatggagctttggtctcacaatcacctgttttattccagccttaaccagtggggactaaagtttgtttatagctcattctttcttaggtacagatgttcttccaactgctcctaaggctggccaagtacacaggttctctttgcctttctgaagatagggggaatgtcatcaactataaaagagaacgtgaaaaatattaatgttggtcatgcttgggcaggaagagtgaaggtacagatgggtcgggatagagccaggaagaaggaccctaatcagattttatagactgagatgaggaatagacacagagagggcaaatactatatttttatgacctgacaattagcaggggattggctcaatacagggctagggagcaacaaaagatgttgagttaaatagtttgtccgagggaaagacacagactgcttcagagcaagttctgggggtaggaaatgagaagaatattaatgcccagaatacaatgaggcaccagagttgccgttttaaaatttcagagaaattgaaggaaaagaacagagctcatatatgaacaaggagctaggaaaaagagcttgattccagggtgggatgtgaactaggaagggcaaatggaggagttttgaaagtttacttgagttaagctctctcaggataatagaattgagattgtgccttctgtattttgattgattctgctgagagatttccaaacagtatcataaaaatattattggctgggcgcagtggctcacacctgtaatcccagcactttgggaggccgaggtgggcagatcacgaggtcaggagatcgagaccgtcctggctaacacggagaaaccctgtctctactaaaaatacaaaaaattagccgggcgtggtgacgggcagctgtagtcccagctactcggcaggctgaggctggagaatggtgtgaacctgggaggcggagcttgcagtgagccaagatcgcgccactgcactccagcctgggagacagagcaagactccatctcataaaaaataaaaaagaaaaaattatcacctcattactggccagctaggtgtttgctgtcaagtaaatgcatagaagaatgagaagggagagcatagagcctaagaactttaggttaggcttttagacagaaaacaacaacaacaacaaaaacaaccctctcaagcctgcagatgttaccaaggaggaaatgccagcatgcctgtgtcccatttgtgtaaaagacacacacacatacacaggatttagttggtcagcttctccttacaggccctgcatagctgttagtggccacgaaatcaaaattgtgtgtgctccatggaatactatgcagccacaaaaacgaacagaaccctgtcttttgcgggaatgtggatggagctggaggctattatcctcagcaaactaacaggaacagaaaaccaaatactgcatgttctcacttgtaagtgggagctaaatgatgagaacttatggacacaaagaagggaacaagagacactgaggtctacttgagggtggaggtaggaggagggagaggagcagaaaagatcactattgggtactggacttaattcctgggtgatgaaataatctgtacaacaaacccctgtgaatatgagtttacctatgtaacaagtttacctatgtcacctgcacatgtaccccagacctaaaattaaaaaaaaaaatcaaacatcttatcacacacatgcaacacacagcacaacacaaaacagtacatcatttctatagagaggaagaatacaacaatggtttgttgtcaaatctcaggttagtaataaatgcttttcttctttttttgagatggagtcttgctctgttgcccaggctggagtgcagtagtgcgatctctgccactgcaacctccgcctcccgggttcaagccattctcctgcctcagtctcccgagtagctggaactacaggcgcctgccaccacgcccagctaatttttgtctttttagtagagacggggtttcaccatgttggccaggatggtctcaatctcttgacctcatgatccgcccgcctaggcctcccagagtgctgggattacaagcgtgagccaccatgcccagccaataaatgcttttctgtggctagccaaaaaaaaaataataataataagtatgctgtaccttgagatcccacactctcaagctcagagcatgctggacagtactgttcgaaccttggtcctggttggagtagaactgcttcattatacacttaaattccagataagagtgcctgcccgctccagaactgtgaaatatgcagattcacatggtcagtatcagccacagatctgaaaatcagtatgaaagaactttcttttccagttttcagattcgaaatgagtgagagaaggaacacaagctactgggatagaagaatgtgaccccaatgctgttagcacagagaaatactcaattcacttgaaaaggggaaaaagaaatccacacatactaatttagggaagttcactggtgcttcattcatcattcatcttcagttttgtagtggagatttatttaggtcagagttttgggtgagatccctcgctcccccaggagactggcagtcttacttagaaactaggttctaaggaagaatctaaatgatacagctgatagattcagttctataatggcctagcaaggacaaagaatatttttttgttactgatgaatggttcctaggtacagttagacaaaccagggcaaatgaagaaaaatatatatacattgtgagctgattgatttcattttcaacacggtttagagaagcttttgtcttccacttgcctaaatttagattgatcatcccagagagatttaaaatttatactacattagtcagcattccttcattcttcctaaatgccatgcagatgtcaaagcattatttagaaacagagctctattcgggcccagtcaagtcaacactaaccagaagtgtcctttggtttctaaattaaatttcctggtttgcttttccttgtgactttctgtgaagaatattataaaccttgccataactcttatcttggactttatcctctcaactttaagcattctaatagcacaagcaatagtaatgatgtcaactttttaaaaacacagaactgaaataaatatggaagctccctgtgtaagatgccatataataataaagttgatattaatattggaaagtagctattcctttacagatcaaattactatgactactattattattaataatattaatattatttggctttgacaatacaaagaagaaaatagggccaatttggtgattatttctaataacttacaaatttagatattaaaaagttattatttttagtatcactagctcactagttatggaacttttcaataataacactacaatagagggtaactagtactgattaaaaaaaaagagtccttttaaaacataagcaaaatatcagtgtgatattactacaactattacgtattacagtgtattttttttttttttgagatggagtcttgctctgttgcccaggctgcagtgcagtggcacagtctagtctcacttcggcctccacctcccgggttcaagtgattctcctgcctcagcctcccgagtagctgggactacatgcacacacgactatgtccggctaatttttttgtgtttttggtagagacgatgtttcacaatgttggccaggctggtctcgatctaccttgtgatccacccgcctcagcctcccaaagtgctgggattacaggtatgagccactgcgcccggccctacagtatattttaagagactatgatatatacattatgaggcacaataatacaacaccattaacccaccacgcaatgaagaactagaatattctttcctgttaaagttacccccatgctcttccctaaccagtttccttggcttgcgtcagaggaaatcataatcctgaatattgatcttatattcccttcatattttattaaattgaaaattatgtaagctctttatttttagcttttatatttcattcaacattgtttcaaagatttatccacgttgttgcatgtagctatgctcatttattttcactgctgtgtaatattccactgtgaaaatatacaatttttaaagatctattcttcagttgatggacatttggattatttccagtttttcctaatataatgctgctgtagatatttttagttgtttggagtttctctaaagaaacagtttccctagtacatcccttagagtagaattgctagatcatagcataattagtgtttagctttaatgtgaatgtaaaatttttcttaagaagttgtagtaacacacctttctatgagaaatatacacgagttctcatggagaacttagcattttaaagtataaacttagtatacgtttattcactgtatgttttctatgcccagttatatcttttgtctaattttatttatgttcttttatttttaaattctttgttttgcttttttattcttttgtgctttttctgaactgggtgcttagtttttagactttcttctttgctaatataagcaattaagcttatatgtttcatcagatactggctctgctatctctcataagtttaaataggtactactttcactatcatttggaattttaaaattttcagtatgatttctcctcagttcatgagatatttagtactttttcaaattataaatgaaagtatttataatttataaatacttttgtttttgatttttaatttattgcatttggtcagagaatgtggccgttctaattatctgttgctgcataacaaaatacttcaaggcaatggcttaaaacaatagcaatcagttattttgctcatggatctgagtgtttactggacatggctaggcagttcttccttaggggtctgtattagtcaaggttctccagaaaaacagaaccagtaggacagataaatagatagatggatgagagagaatttatttttatttaatttgtttatgaggcagagtatcgctctgttgcccaggctggagtgcagtggtgcaatctcggctcactgcaagctctgcctctctggttcacaccattctcctgcctcagcctcccgagtagctgggactacaggcacccaccaccacgcctggctaattttttgtatttttagtagaagcgggatttcactgtgttagccaggatgttctcgatctcctgatctcgtgatctgcctgcctcggcctcccaaagtgctgatattacaggcatgagccactgtgctgggcccgagagataatttattaagggaattgtctcacgtgattacggaggctgagaagtcccataatacaccatccgcaaggtggagaaccaaggaagctgatagcacggctcagttcaagtccagaacctcagaaccaaggaatctgacagtggtaactctcagtctgaggttgaaggcctaagatcctgcaggggcactggttcaagtctgaaggccagagaagctggagttctgatgtccaaggacatgacaagatggtgacccaaccccagaagagaacaaatttgctttcctctgtcttgtgttctatctgggtgctcagttgattggacagtgcctgtccaaattgggtgagagatctttcttagtccactgattcagtcctaagtctctttcagaaccaccctcataaagatacccagaaatgatactttgccagctatctgttcagccctttttacccagtcaagttgccaccaaaaattaaccatcacagggtctctccggccgctgcagtcagatgatagctggggtcagcctctcttaaagccttctccattcacatgtgcctgcccggggaaaactcaaacagctctgggctgaaacggctggaaaaccttggcatgtctatgtctctctctctctctctctctctctctctctctctctctcagcttttcatttggtctttcaacatcagggcctcagggcaaccaaacttcttacattgtagccaaagacgccagaatgattatcccaagaaaaagtcactgatgctgggtgtggtggctcaggcctggaatcccagcactttaagaggctaaggtgagaggacaccaatttagcaggaaaaaaaaaaaaaaatcaaccagggtgatggtgcacacctgtaattctagctacttgggaggcggaggaggaaggatcacttgagcccaggagtacaaggctgcagtgaaccgtgatcacacctttgcacttcagcttaggcaacagattgagaccctgtctcaaaaagaaaaactcactgaagttacctgaccttttctaacctacctaggaagtaacacaaaatcacatatgtcatattttgtttattaaaagtcaaaaagcatcacctgggttcaggggaaggggacattgactccaccttttgatgaaagggttgccaaagattttctgcacatgttttcagagcacaacagcggtcagtatcataccacctatttgaaatttgctgagatttaattgatggtttagtatatggtcagtgcttttgttttttgtttgttcttaatatcagtagctttgaaaatgtgtatgttctaactgatggatacagatatctatacatgatcattaaaacgtttttattgggcttgcacccaccaatatgatattggttagtttctccctctaattctgcctttttttttttttttgagacggagtttcacttttgttgcccaggctggagcgcaacggcacaatcttggctcaccgcaacctctggtgttcaagtgattctcctgcctcagcctccaaagtagctgggattacaggaatgtgccaccacacccagctaattttgtatttttagtacagatggagtttctccatgttggtcaggctggcctcgaactcccaacctcaggtgatccacctgcctcggcctcccaaagtgctgggattacaggcgtgagccaccttgcctggcatgccagttttactctgtatattttgaggttttgttaggggtacatgggttcagaatagttttctttccctattttagttaaataaactttttagtgttgtgtaataaccctctttaccacttaaagtcttttttgaattaaaaacttttatttctcataaatatgtagttatcctaattttccttttacttttaaccttcttatatcatagtgttatgatgtagcctaagtaagcactatatagctagatttttatttttattattagagattcagatatctggagaactcggttatgaaatttagcagacttttctaatcctctgtgttgtttttgccttaatatatttattttgttaaccgtctaaaagatgacaaccagtagagaaatagctgtttgttcaggaacagaaaatctgtataatagagatcagatctaatcctttctctactgataaatcctcaaatattagtctttcacaactagtaagttgtattagtccgttcttcacactgctataaagaaatacccaagactgggtaatttataaaggaaagtggtttaattgactcacagttcgccaccgctggggaaggctcaggaaacttacaatcatggcggaagctgaagcagaagcaagtaacttcttcacaaggcggcaggagcgactgtgtatgtatgagtgtgggaaaaagctaccatttataaaaccatcagatctcgtgagaattcactcactatcacgagaacagcatggagaaaccacccccgtaatccaatcatttcccagtaggtgcctccctaaatacctggggattacagttcaagatgagatttgggtggggacacaaaatctaaccatatcataagccttgttgctaggtctattttttaaaatgtgtaattcgttgccttgcagttcccccaaagtccagcttaattcaactgaatcaataagagataattgagttagttacacatgaaaagccaatcttggaagatagacggcagctccattctcctgctgactattaaagtaagttaatgatctggagctgtgtaggggtttccagaaatagctctagaatggccatcatgctgtagttagcagcgaagaaagggaactgtgctttattttccaggcaattgcccgaacccaccccatagcatcttattttaggaccaatccaccagaaagaaagagcaacatacagttcaaatgagcacaaaacgtctccttagtggaaataaactcatgagtgagtccattcttttttactgacaaggtgaaaggctgaaaatagccatcttagcattgtacgtagctcttgaaaacctcacagattttccaggattgatttattagtattaatggatatatatctgcacacatacatatattgcacttacagaaaatgtaagtcaaaacatttcttaaaaactcggtgcccttagatctctgctagctttttagcagctggcttttttttttttttttttttttttttttgagacagactcttgcactgtgtcacccaggctggagtgcaatggcgcaatctcggctcaccgcaaactccacctcccagattcaagtgattctcctgcctcagcttcccgagtagctggaattacaggcatgcgccaccatgcccagctaattttgtatttttagtagtgatggggattcctccatgttggtcaggctggtctcgaactcccgaccccacgtgatccacacgcctcggcctcccaaagtgctgggattacaggcgtgagccaccgcacccagccacagcaggcttttatagaggcctcactctaagcaaggcatctatatgtgatactaggggagagagaaaaataagacagctagaatattttttgagtacataataaaatgtataactaaaaataaagccaaaaaccctatctagtaaatgacctgttttgtaaattaaatttgtgtcttcgcctttctggggtcaagccctataggaaaaactacttaagtaaactcctagttaataattgaaaagaacaaataagtaagacctttaaattttgtttgaagcttgttaatttttatcataaattaataagcttgaaaggcagatgacatactagtaaaaatatttgtataagaaatggcacatggttaatatccctaatatacataatacttacagatcaacaagcaaagacaaaaatgcttcattgaaaaaaaaaaaagttggccaggcactgtggctcaacctgtaatcccagcactttggaaggcagaggcaggcgaatcgcttgagcccaggagttcaagaagagcctgggcaacatgacgacactccatctctacaaataatacaaacgttagccaggcatgatgatgcccatttgtactcctagttactccagaggctgaggtgggaggatcacttgagcccaggagtttgaggctgcagtgagttatggtcacaccactgcactctagcctgggtaacagagcaagatcgtgtctggaaaaatatatagatagatatagatatagatataaacttgttaagaaaaagaaagaaagaaaatatttaaccattataagccagacacaaaggggcaactgttgtatgattctgcctataggacatacctaaaatagtcaaattcctagggacagcaagtgaaataatggttaccaggggctgggggaaggggagaaagaggagtttattgttgagcttcaggtggggatgatgaaaaagttctggagatggataacggtgatcgtcacacaataacgtgaatgcactgtacttaatgctactagactggacatttaaaaatggttaaaatggtaaattttatattatgtatatttgaccatgccatttaaattagctaattcaatgggaaagtagcctagttgcttttatgaaataaaaagtgatcacaatgttttactttccacttgtttgatttttgtgtagtcaggggacacacgaaagaatcagagctgtccttggtaaagaccaaatggatgttggggctggaagccagaacttttgggttcattttctggcagggaggccttgagctgatgactttaaataaaatagcctttaaaaggaattcctactgtcaatatagtaagtatctcaggaaagcatgctggttgatttatcaaatcaggactaagaattcagtacgtccaagccctccatggagctccttacagagcgctattaacagagctgtctccaccaagtgccctcttcatgtttattttagttttgcccaataccctgacttttctagggtttagtaaatatttgttgaatgatgaaagtactatgctgggctggttcatagttggggtttaaaagattatctgaaaattagatcacattttcccaggcacaacagaatctcagactctcattttttttcttttcctttttttttttttttttttttttttttttttgagacagggtctcactctgtggcccaggctggagtgcagtggcacattctcagcttaatccagcctcgactacccggctcaagcaatcctccttcctcagcctcccaagtagctgggaacacaggcgagcagcatgcccagctaattgtttttttatttttaatgttgtgtagagatggggtctccttgtgttgcccaggctggtctcaaactcgtgggcttgtgattttcccaccttagcctctcaaaatgctgggattacaggcatgaactactgtgcccagcttctctctcttaaaaatatcactggacaactaaattaaacttccctatattttgaacttgcattattcaaaagttgtaatcaatagaaggtctgagtgaagaagagacacactccagttaaaattaaatggtggtgaattaattttgctgcctaagccccttattattctcctctttcttcatcctacactccagcatttgggttttgacaaattctgaaaaggctaaataccaggtagggtagagagtgggggtagggggagaacccagattggggtcacgaaagcttaacaataaatgaatgttttaaggacagccattcaatttctaacttagttactttccttaattgaataccatttaaaattattttcaaaacattctattctttgtcgtatgtcctttgaacattacaaataaaaattatcccccctgtaattttgcaatgctgcattgaacacaaattataacattttccaagtgcagaggagtctgttatttcctcagggagagaaatcaatttccaaagagattgcctggctcatatcactagagcagaggtttaaactggttgccctagggctaagtaaagcccaaagttaaaattaagtggaatggatttccattttttaaaattagttgccagcatctaaaaattgagagatttcatatacaaatataaaattataggggttctggaaaaaatctttcagctcttgttaagacaggtcaacaagccactaagccctaatgatggctgtcttctcagaggggtcctgaaccccccagttctcaacatcccactagggtcaactttactcactatcattgcctgcctaagtgcctgtcagtgctttagtgttttttaacatattacagtgggaaaaatgcaagtgagtatccttggacagtatcaataataactaatatcaattattaaaatagagtaggaaccaaagccagtagtcactcaggcttctgtcatgcagtttaggagttaactacgtaatctttctttccatgctaataccacagttgaatgggaaaacatccaaatacagtggccacggatacccctgtgaacagtctccaagaaagtgatgtctggccaggtgcggtggctcacacctgtaatcccagcactttgggaggctgaggcgggcagatcagctgagatcaggagttcgagaccagtctggccaatgtggtgaaaccccattgcttctaaaaatataaaaggtagccaggcgtggtggcaggtgcctgtagtcccagctatgtgggaggctgaggcagaattgctttaaaccagaggcggaggttgtagggagctgagaacccaccactgcactccagtctgggtgacaagagtgaaactccatctcaaaaaaaaaaaaaaacaaaaccaaaaactgatgtccaagctgaagaaagagcaaaagagcatgacaggcagtgaacagcacaggtcttgttgccaaatcatgttttaaaaatctgccatggagaacaaataagtaacaacacccccatataacaaaatgataggttttcattttgatgtattgaaacattttcagaggaccctaagctgttggcactgaaacaggctacattgaacaggtaattcctgcctcttagtttagcatctcaaaccaaaatctcactgaatgcagctcagctaaaaaatcccttctaacattatctaacgttatctaacattaacttctaacgtatgacagagacagatgaaaccttgagtgatgagttgaaggttaaatgaagaggaaggacactgaggggcctggggaccctaagaggtaaagcgccactgtttgttgacactcttcatgattttttcactttccttcccccgcttgtaaaggttcctcagattcacaaagggtaatgccaaggtcttattttgttttaatcatctcttggatgatgatttaaataggatttcatgttttagttctaataatggtggctaacattaataaatggttattatgtgttaagcacttatgtacattattttattcaagcctcgtaaaaccctcatgaggtatgcactataacaaccttcttttttaaagatgaaactgaagttttgagaagctaaataacatattcaactacacagccatgaaaaaagagaatgaaatagaccaggtgtggtggctcacacctgtaatcccaacactttgggaggccaagactggcggactacttgagcccaggagttcaagagcagcctgagcaacatggcaaaaccctgtctctacaaaaaatacaaaaattagccagatgtggtggcacgcacctgtagtgccagctacttgggaggctaaggtgagaggatcgcttgagcctgggatcctcttgtcctcagtgggatgcacagacattcggctgcagtgatctgagatttcaccactgtgctgcagcctcggcaacagggcgagatgatctcaaaaacaagaatgaaatgatgtcctttgcagcaacatgaatgcagctggaggccattatgttaaccatattaacacaggaaccggaaaccaaatactccatgttctcacttataagtgggagctaaacactgagtactcatggacataaagatggcaacaagacacactgggaactactagagtggggagagagggaggaaggggagaaggagttgaaaaactgttaggtactatgattagtacctgggtgactgaaccaatcgtaccccaaacctcagcatcatgcaatgtatctgcacatgtaccccctgaatctaaaataaaagtttaaattataacataaacaaataacatattaatcataaacctagtaagtggcctgctctaaaagtcctgctttcaaccaccattctcttaagcgtagcagctttcaaaatgtagcatgtccatttctaagaagagtggaattaaagctatacaaattggggcttggcccttgtcacaggctgtgtcaatagaccaaagactgaaagaagatgagattcagggaaggtcaaacgcaaaccaatgcatcaccaaaagaaaggattttggagttattattagtattattatacaatgagcaaactacataacataatctccagagacatgtaatgaaattagaaaagatccagggacagtggcatccataatcaaggagagaggaatggggcttgaataagaagagaagttttgcctgttttactctggaaagatgaatgctaagtggaataaaaagactcctgggaacctaattaaattagaatacaactttaaccagcaaacaaaaaatattaagaacttattctgagaattggtgtatttggaggggagatatttagaatatatttttaaagtctgaatttttaataaataagataaattagtatgtttcgaaggtgcactcttattttttaagtttgaatattacactgcagcctgagcgatcttttcaaaatgcaaatccaatcacgggatgcgttcttccattaaaatggcttctcgaccgggcgcggtggctcacgcctgttatcccagcactttgggaggctgaggtaggcggatcacgaggtcaggagatcgagaccatcttggctaacacagtgaaaccctgtctctactaaaaatacaaaaaaattagctgggtgtggtggcgggcacctgtagtcccagctactcgggaggctgaggcaggagaatggcgtgaacccgagatcgtgtcactgcactccagcctgggcgacacagcgagactttgtctcaaaaaaaaaaaaaaaaaaggcttctcactgtttatcactcctaaggactttccttaacatagtcacgcaggggactgaaacttcttgcttttactttcctggcctcccgttgaatcacactcccccttgctggtgacggtgggctcttgggcagctcctccggctcccacactcatgagggcaactgcatcatcttgggccagatcagatctccatttcctgggccctcacagcaccgctttttcatacaaccctgttgcttcctcccaccaggctgtagcctttgcaccctcagcagttaccagtaggtaaaaagcctggaaacatctgttgaacggaggagtcccataccctttagagctgaattctgctttgggtaaattagggagccagtagtggaagttagcttatttatttatttatttttgtacagatggagtcttgctatattgccaaccctggtctcaagctcccgggatcaagcaatcctcccacctcggttcccaaaagcgctaggattacaggtgtgagccactgcattcacccagcatttttgttttatcaaaatttatgagggaaatgggagaagagtcttctgtatgtaaactaagatatcgctatgaaaccaataagttttaaactataattaagagactaaattctcctatttgtatttgccccatttaaaaacaaattgtgcccttccccagctccaatattacctccctgctttatgtatctccatcagacatactctatatatctcatttattttgtttgttatgcatttttcccacgagaaagtaacctccaggagggaagggatatttgtctcttttgctcacttctgtatctcccagtctacagctgtgtttggcacatagtaaatgctctttctgtatttgttgaatgaatgagtttagttcagtagtcttccttgcccagagatagcaggcaaaaacatcaattaaccccgaagtaaattttcatggaatccagttctggattttttaaaggctcttaatgcaactatatttagctgtgatcccttcacattaggcttcctaatacatcaggggtcctcaaactacaggccatcagaatcatctgagagcttgtaaaagttgcagattctcatcatcaaagattggaattatgcagtcagaccccagctaagggcagttccaggagctgcattcggactgtggcccaagggccagtttgagaaacacgggctgtgacccccagcacgtgccgagtgaaagctcaattcctctaaggcagtatttatcacctacattggctccgtacccatgcgggttttagcaataaataaccaatgtccaagggacaggtacccttcgctcgtttttacagatctggaaacactgaccatcccttcctctccgcttcccctccgttcccgcaaatttacgtggttcccgccaggataaaagacaggtaaaaagtacgcagagctaccaagaaaaagaagggacgctcaaggcacactagggtccaggccggacacctccgccaagtaaatgccttgtgacctttgcctttgcacccggggccaatagttggcgacttttcggcgcttcccgctgggaacgtggaggcccgtgggggaaacattccagccttcggcggaggaggcgcggggcggggcgggggggaggagggaaccgagggggcgggacagaggagaggcggggcctgggcggggcggggctagagggcggcctgaggctgcggccacgaggaagaggggcggggggcggagcctgggaatggggcggggccggagaacagcccgtcgctaaggcctgcgacccagacagcggggaggaggcggtgccgcccgctctggccccgcccctcggggggtgggcccagcgggagggcccggctggcggagcgcgcgggagacagttcgctccgactgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacgtaagctagacttgcgtcttgccgtcgggctggccgcgggagcgggctgcggaggggacccgccgcgagaaagtgtcaccccgccttgtcaagtcggtgcctgttctgtgctctttaaacgctttctgcagagtctccggattttcttggaggtggtgtggggatagcaggactcgcagtttggggagggagtttgaattttggaggagtgactcttgattaccttttgcctggggaccgcgggccagcgcaccaggcgggctccggatcggtcgcaacccgtgaagggaagccctggttcactttcctccttgagccgggcgggggctcgcggctctggctcgaggggcgcggcgacaccgccttctaccttcctttcctctggggactgctctgcgctcgtactgatctcctgtcattcaccagcttagtccaaaatcaaagtgaactccgggagagtttactgtttgggaacattttagaccctagtggcgcttggaaatttttttttttcatcactgcctgaaagttcaccaaaaacttgttttccttttcaaccatttttgggtaagatactttaagcgctgggaattaactcagacctggccagggaagtctcggtttggtggccgcaggtacctggagagtgttggggtagtttagcaagccccgtggcttgcaaacgtgcttcttgctaggaaacacacacacacacacacacacacacacacacacacagttttggtttttttcccggagatgggtcgctgaatcgtgtccctgaaatgcccccttggggatgcccacccccttgacccggacaaggaggccgaggagcgagttcctgggccggagagaggaaggaagctcgcctcccgacccgactattttcgtaacaaggcgacagcttcttggaagcctgcccccactccatgtcgctgtccccacctccagagtcctggggcgagcctttgatccctccgaaggaggtgcacccctcctctctgcagcaccctgctgcgtgtagtttgctgcgtccgcgagcgtccttcagcgcacagcccctggggcgaggaaagtgagaggggacacggggtcaggctggtggggtctcatcctggtcagcagcctgctagctgggcgaacttgggcagtgacaggacctcgctgtgcctccttcatctgcaccaaaggggtgataactgtattacctccgcgcggggaggttgtgaggatcaaatgagctcatgcaagtaaagtgattagcaggttgcctgttcccgatgttcaataaatacccagtgtgtgctaatcaccgcagaaggaaacccctgcttgcagtcattaatctgcacttaaagaaagcttcgtcccactccccaccttttcccatccccagtcttgttttgagtgagtctttttacacccaatatggatgagcaaatggattcattctcaggattcagaggttgtttcggcgattactggtgacatagaggaatgcagcctaggctggtggcattgatgatgtatttggaaaaaacattgcagctcgggagaaggcagaatactgagtctcagattacattttttttttcctccaaaattctgtttgctgaagggatgagggaaaataatagtccagcagactgcagccctctgaatgtaaatctatcagcagctccaagaggttgactaattcgccatccatctggactacagactggtcctcggtggaaataatttgcagactgtaagtgtggaattaatggagttgccatcttggcttgcagacggcagcagatggtcagaggggtgccctgtaaggcagcagcccctctaatcgaagaactaaagtcctggggaaccagtgtcaaatggttagcagatgtgtgcacaaaagttattttgagacattttctgagaaaatgttggcgattgcatgtattcacatttcttgtggcatgccagatttacagcgtggcctgagcgcagatgcatactttttgcattagtactactgttcagagtttaaaatgaagcacagcagactgagtttctctcctggctgttttgaaaagtttgcttttgacaaatacttattttattttaatttacacagagtagcaccagacaccaaacagcctggaagttcaaaaaggggactggggataaatagtttccaacttaaatctttccctggagtgggtgagaaaagtggttttggtgacttatgtcataacttcccaattgcagatttcatgagaaacaccactcattccttaaacagtgaatagatgagcaattaactattgctaactatgaaggcagtgtttcaaattttaatgcactggaaagattgaaggattttcttagggctctggagtaaaggtgaaaggcaggttacccttcaacctaaagcccttgtttgcatgtttttttgttgttctgtactgtagttgagagagcaaagactaagcaaagtttagagcatttctacattaaaagaggtgtttgggtgcttctggaaaatataccagaccagtagaaagacatgttgtgattcaacaagctattactgtgaagtgagtttaaaaatgtatatagtacttaaactcttatttgtagaactattatgggacttaaaggggatatgggaggccacagttgagatgccttccaatcagaggcttggtgagattccaagaggtggtttcaaatacagcaataagtacttgggtttcccttggtgtccccatggagattttaagccatgacgcaatgtttaaatcagagtggtatttttatgacttaagcgggtaaatatgcaattggaaaatattcagggaagggtgatttggtccagaagagtgggggcatccagagtacagtgggtgaaatggatcggactttttggaagagagccttgtgctggacaggatggtccagtattgtcaacacaagtttctcatgcttcactctccttcctagcaacaggaagacggaaatgaggccatgcaaaaataaaagaccctgaaagactccagacaatacctgatccaccctaccattcaccctgtatagccagaagacttttacaaaagtaaaaataacttcagatgtttccccttcctccctggctattgccaaatcattaaagaccgaattctcagtgctttacaacatcatagcaaaacctggccccatggtgtgactcgcatccagacccacatcatgccaagcctgttcttgagattataaagcagacctggggagaaaggtgattttcatttgtaatgtgtgcacagtccaatgatttgaattacatgagttgggatctagtgggagagaactaatttctttagtgtctagacagttgtatctctgacttttctcagaatgctcattttatcaggatctgctcctgaaattcttagtttggagctgtggggctctaatgcaaaggagtaatctgtacgtcattcaagacactaaaaaatacgttccttcatgttgcagtctgggtgaactaatgcccaaccatagagtgtaaatatccagtgtgtcctagaaagcacaattccaagatcctcttttccatggctatgaaattagaaggaacatgcttttctggagcactttcacaactgtctctatttctgactctgtggcctttgcatatggatgaatgcagagggaggtgaaggctgttcctctttgaaggaagacagtgctgtagggttgaagtatgttttataggaatgagttactgcgttgaatgagcgccatcagcggtgttttctttcagcttcaaattagttagagatccagttaatgtaaaagggtttagattcccagctgagaagggctccttctgtcctctggcccttttccttctgtgggaccttgtgttattagggattaccatgatcagtgataagaactgcggagtcctcctggggatcctctaattaggtctactctgtcttaacgttttgttcacttgccatcataattaatgttctgccttgccatcataattaatggagaacaggaagaaagccttcacattaagcttatatattttcttttttctcttttttttttttgagacggagtctctctctgtcgcccaggctggagtgcagtggcgcaatcttggctcactgcaagctccgcctcccgggttcacgccattctcctgccccagcctcccgagtagctgggactacagtaggcgccgccacaatgcccagctaattttttggtatttttagtagaaacagggtttcatcgtgttagccaggatggtctggatctcctgacctcgtgatccgcccgcctcggcctcccaaagtgctgggattacaggcgtgagccaccgcgtccagcaagcccatatgttttcttagtgtctcccaggcagcaacgagacttctctattgtggcccttacggagccttatagttactttgtaatttcctgggaggcttgtgtgcgtaggtaggcagctgtaatgttagagtgcaggaatgacaaattttttgtgagtcccctccatggggggagtctagtgagaggagacttggggctctgtctttaacatttgggggagtgttctgggataccattttctaaaactctggcccgcgttgactgtacgaaataatgttttcttcagtgaaagtactttcaaatattatttctaaaggaaacttttctcccaaatgtgactgaaaatatgtgaatgcctgcctataaggaaataaagttttgagcaccaaaaagtgaactattacatccttctaaagtgaagccaagacacagtggaaatcagtttctcttaatcattcatcagccttggggttttttggttgttgtttttttggggtttttttttttgttctactagacttactttcctcgtgaaaagtgtgcttattttcattttatacatttctctacttggtgccttttggtgtctaccccttcccccgtcggggaaaaatcaaaagctcattgaaggctgaggtcagtgaagctgagtcctcagatgcctttggcacctcccatccacattttgttctctgccctgccccacctttgagtgtcctgtggagaggactggaggtcacttcctgaagcttgtcagaaaggcgccttccttctcctcgcaggagtctctaaaggatgtttaagggacaaaagttttccacaccctggggtggtagcatttcccaggctggcagcactttaggaagccacggaagaagagacttcagaagtgaaatggcctgtggcccatgcacggtgctgccccacagccacgctgtgtccctcctcacactcaagtgacaaaatagaagatgctgaaactgaagtgatttttacctcctgattctggagaaaccataaactcataagggatccaatctccatacagttctctttttcaaattgtatagcacagaaagggcattttatgtaatgcttggacatctgtaaaagtcattttcatgggaagttccagaacttggcaaaggcagcctggaaaaccagtgccttttcccgactgaggggcggctgagatgcagagaggttcagtgaccagtccaagatcacatgtgagttgactggaacctcagaccccttccagtcaacatgtctaaacaaaatgaaggtcttaagttgtttgtaggaacctgaatcacaatttgaccattagattaatttctgttcattcattagtgttcatttagggggctgggtgtcccaagcaatactggtgaaaataattccttagctcacctagaacacagcaaatcttacttttttctcacactttttggcacaaaactgagaacgtctagttgaatagtgtttcctctttgaggtttgacatagaaatggctggaggtggcttatactcctaacaagtacctgccatattttcattgtcattggtctttgataagggaacttgatatttcattcattttcttttttctgttagaatggacgaaaatatgggtgagcagtttttttaatagacgttcctgctatcacctttatttctaatttaaggttttacagtgttgcaatttgcacactattttattttctcctgtgctatcgcagaactataaagcaaaagccaatgttgcgggagatgcccctcgtagaataagctttgctaacatatgtaaaagaaagagtttatttgtatgccaacttttaataatagagacagggttactctaggtttgtaaccagatattttgccttgaataataagtttaaagagggaatggattatataatcttaaaacacgtgcttcattttaccaaaaaaaaatgagactcagaaaaataaggacctttaaaactgtattaattagatacttttctttcttgaaattcttaatctatgcagttatcatcttcaaaggacttcgtactttatgagctattccaaattactgttgttagtgcatagtttgaactgcataaatatttgacgtggaatactagaaatacgtacacgtgtgtgtgtgtgtgtgtgtgtgtgtgtgtgtatggatagagagatatgtgtgtccctgtagcagcgatttatttttatcctgccccaggttgaaatgaaacagaaagatgtgatgattcagtatccatttccttcttagtttattttgatttcagtttgacctctttttgctgggtaataagtgccaatttttgattatttgggagatattttctgttcctggaaataactggatccgcacaagcctagagggcctgatggagccatgtccctcatgggctcaaattcatccagagctgttgcctttgccagggaagagcacatattttgatgtgagctgcttgccttttcctggtttatgtgttaaaaggagtactttgcaaactcttgtactagatgatccccaaagaggatttcaattggtttaaattctacatggctaaagtgtcacttgcagggcttcaccccaggtataggcttgcagggcctgtctcccagtgtttcctcctttcaaggcaaaaccatttattaagttgtcatcacatcacagggaaaatgggtcctttttcccctcctttctataatttctaggaatgttctttaatagaaagctgtatatgtatgtctccaaatctcaagcagaagaataagagaaaaaaaaatgaacaaaacttaaaaaggaagctccccaaagcttccattccttactaggactgaaaaccagtatggtgatttacaagtgagggcactgttgaaataggcaagaagggcctaacctggggatgagagctgggtagctttagccccttcagcaaatcacctcaattctgtaccagcttcctcatttgtaaagagaaaagatgaaaagcttcaagaggtatttcagcgcccaagtcacggattctttggaagacaacatgctgctgtaaacatgaaagatcaataaggaaagtaaaactcttaagagccttctatgcattgaagtgttttcttcctctcaagttgaaatttagagggctatagacacgcacagaagcaaacgtcattggttttgtgttgtctatgatatgaatacaggcttcatgggacaaatcaagaagtcgatctcttaaaaagcaaattaggccaggtttggtggctcatgcctgtaatcccagcactttgggaggccaaggcggatggctcacttgaggtcaggagtttgagaccagcctggccaacatggcgaaaccccgtctctactaaaaatacgaaaattacccgggtgtggtcgtgagcacctgtaatcccagctacttggaagggtgaggaaggagaatggcttgaacccaggaggcagaggttgctgtgagttgagattgtgctactgcactccagcgtgggtgacacagtgagactctgtctcaaaaaaaaaaaggaaaaaagaaaggcaaattggaaatgttagcttttaaaataaaagtaattaaaactttcgtaaatttacaaaactggggatctcttgtagcagtttctagtggtccagttttttgagggaagaagaatgtttccatgtaattgataagacatctggaaaattaacagcgggcatggaaccctttctagaggtggtcttagagagaaggtgaaatgggcataaaggaaatattagagtcaaaaacttagggaatttacaaagccactggcaagcgcaggttttatagatgaagcaacagggccagagaaattcttttcttaaggccacctatctaggcagtggattctttcctggagttgttttcctgacttgttacagtaatgctttgtcctctgtgatagagtatcagaaggactccagggcacccaggtgcaaagctgttttacatctgaggaaataatgttggttgctcattgtataaccaggctcagaaggtgcttccatctgatccatgagataacttcctttctgcttcatactcctgctttttggtctgtattgtagtaaatccagactgcattcctcccaacacttctgcttcccagcttacctcttacttcattcagggtcctttacaccgaatcccctctcctgcaatccagtttcatatccaagatcataatgcttccttaaataaaggagtacagactgggcccaggcagaccccacttgtccactagcgagaagggacacccctcccactctgatgtcacacatgtctttcctatgtcatatcacattcctcttcctactgtacacaagttcttcatgcttagaagaaaaactatgcatgagaatagtgcatttcaaattggtcacattggtatataacacagcatttaaaaatatataaaaatataagactgtatcacttattgtaggttttatttgaaacttcttttataatagttacatatacagacacgtgtttatatgcatgaatgtgtacttatatttatacacacatatatacatgtacatacatgtatatgtgtgtaccatgttacaatgtagaatgtatttcctattggggatcctggtcagaaaaattaagaccacttactagaacaaaaattgtatgagtggtttatttctttatgtaatatttattgagcaactactgtgtgctgttgtaggtgcttgggatatatcacagaataaaatggacaaagaagcttgcccttttggagcttacaaagaggaaagacagaaagtaaacataataagttttgtggaagaagaaaaaataaaacaggaaaagagggagagagggcccaggtgccacggcccacgccagtcatcccacactttgggagggaggccgaggcaggcagatcacttgaggtcaggaattcgaaaccagcctgaccaccacggtgaaaccatgtgtttacttaaaaaaaaaaaaaaaaaaattagctcattgtggtggcgggcgcctgtagccccagctactcaggaggctgaggcaggagaatcgcttgaacctgggagacagaggttgcagtgagccaagattgtgccactgcattccggcctgggagacagagttgagactccttgtcaacaaccaaaaaggtgcgggggcggggggtgcagggagcagggggacagggcatgagaggaggccggtgtggctggatcagtcagaggcaggcagggtcctgacaggggccaggacatgtgggacattgttaggagtttggctttcaccaatgaaaggggcactcactaacgtgacgtgtacagggtcacttcgggcttaacaaacacgtggaccttgcaatagcccttaggaaaccagttcgtttctaagtggaggatagagggtcctcatacgcgctgtactccactgtgaatttcctttccacttggcttcctgcttcaagtcaggagcttgtgtctttgattttccctgagagctgctggcagtacgcctagttggatcaataaatagtgaaagggaaaatgtaggatgattagctttagctaaacataggactgtactaaaatatacctaacagtagatttgagttagctattgttaagccagatagcctaagaaactgacttagtgactgaccagtctcccagaagcttcttgttttttttttttttttcagactatgcatagcagatgtttggaatttttttaggcacctgagggcaggaatgctgtcagttgctggtgaaaatctttactgtgattagataacattagagtttaataaatattaatatatgaagtctgctgtctgtcttaaccttactaggaatttattttacatagataactcctgataaccagtctttggcaactgcgtatgtttaacagttggttgttttttaattgcaaagagtaagagattcaagtcatcgttttcagtctgcctttaaagaaaggaaaatagtaatagatttttttttttcttttccttcttcacaccaacctctctgtaattcctttgtgcaaaaagttgtctttcgggatatacaaatgaattaaaaagtgagaagttggtggagtgaagaaggggtaattcatttgagagaactcagggcttaaggtatgagagcttggtacgtcctcagaactccaaggagtttggaaagcctggagcaagcttacatttggaggccttccaagagttgagtggataggcagatgccaaactgtgaaggctgtggtctttgctgaggagtttggattgtatttgaaaggcggtggaaagtcactaaagaattctaagcaggggagtgacataatgaaatatgtgtttcataaaaccagcccagtggctcggggatccttgaaggaggacggatttgttgggggcagggaggggtgaggcttatcagagttccgtgaggaggctgttaggataatccaagggtgaaaaagtccaggacgaaggaatacaaagaaatgttatctggcttagtggtcctcaatcctggctgcctttaaactgagggagcttttctgaaatacaatgtccaggccctacctagactgagtgaatcagaatacctggggaggggatggtcggtgtttttaaaaagctccctggccaggcacgggtggttcacgcctgtaatcccagcactttgggaggccgaggcaggaggattgcctgagcccaggagtttgagatcagcctgggcaacatagcgagactctgtctctataaaaaatagtataaaaacttagccaggcatggtggtacacacctgtagtcccagctactcaggaggctgaggcaggagggtttcttgagcccaagagttcaaggctacagagagctgtgatcatgccactagactccagcctaggtgacagagtaaaaccctgtctcaaaaaagaaaagaaaagaaaactccccagcgcaatgcctgcctacatccagggctgggagtcaccaagatttccttaccttactacaagtatttgtggtcgtgatttgcttctcccagtgaacgccctctggaacccacccatcaggtaaagatgggttgtaattaaaaccatcgtatccacctgcacaacattcctgccaaattggtcaccttgatgtcatcagaattgataagcagtatcttccttcccatttgaaggaatctttgtcaccacggggaggagaatgcatcttggtttggatcaaaaagcaccacctgcctgcacacagctgacacggttctctagcaataaaagcatcaacttttccatgaatctttgcccatatgtctatcaaattttagggaatccagggaatctgcaaagtgcttgaattttcttacattcctttaatttcttaaaattgcatttttaaaaaaaattcactgtaccatttgcatcgaagcctgattttggtggcatattatcacagaagagaggaaatccaaaagttccccctgtgaagctagagcgaatggtagattgaagtaatcatatcttgtttagacccaattactgttgctcaaccagctaagataacagagttccacagaatgatgctgggggtggggagtttttgttcagcttactgttgaggagtgatgggaagacaggatcatcccgtcatgccaggaaatgtgcaaatatggcctaatggttcccagccatacacaaaagggtgtccgggactcatccatctaatgtccagaactgctttgtgaaatgactttgactaaagctgtttccaataaaaatttcctgtttcctccttacggcatttgtctgttgtttgcttagagaaaacccaggtataaaagtttcattgtatttccattgtatttttagtttctagtggcatttttgttcagtggggaatgttttttaaaaaaatcatcctcgtaattttcacatcaccacccacatacattgaagggaaaatcacacattcagagctgtgttagaggccccccaaaacaagcatggggtagataaacgtgtccaaagtaatataatatatatgcggttttcagtaatattttagattttgttcattgttacataatatattatatgtatttgttacataatatacattttatatatatatatatttttttttttttttgcgacggagtctctttctgtcatccaggttggagtgcagtgacccaatctcagctcactgccacctccgcctccccggttcacgccattctcctgcctcagcctcctgcgtagctgggactacaggcacccgccaccacgcctggctaatttttgtatttttagtagggacggggtttcaccgtgttggccaggctggtctcgaactcctgagctcagatgatctgccttccttggcctcctaaagtgctggtattacaggcgtgagccaccatgcccaagctgttacatacagtatttttaaagggaagaacctgtcttgcaggaagaaccttgcatttttgtaagtaattgttccttctctcactatggcatttgaatgtagaaatctcatttttaaaaatttttttataagttttttttttttttagatagagtctcactgtattgcccaggctggtcttgaagtcctgggcccaagcaatcctcccacctcagcctcctgagtagctgcgaatacaggcagaaagctcttttttctttttatattttttgtagagatgaagtctcgcaattattgcccagagtggtcttgaactcctggcctcaaatgatactcccacctaggcctcccagaatgctggggttacaggtgtgagccacctcgcttggcctcagaaagctcatttttaaggagaggtggttacttctctatctgtttcctcatgtgtttatctcagagatattagtaatccacattttaggatcaatgtgaggtgtaaatgaactaatatgcactagcgcttagacagggccttatgcgtattaagcactcagtaaagtgacccattgatatagaactgttgagaggtaaatgggaagactgcatggaggaggtggcatttagttgggatcttgaaggatgagtgaaatttcatcttcagcatttcaggccagataattcactgaagtgcagtgtgtgtggagatgagcaccaaatttactttggctagagtgcttgggtacagggagctgaacaattaggttggatgccaagtggagagccttgaaaaccttgccagggtgtttagacctatttttttttttttttttttttagacagggtcttgccctgttgctcacgttggaatgcagtagtgtggtcacagctcactgcagcctccacctctggctcaagtaggtccttccacttcagcccctcaagtagctgagacaacaggcatgtgccaccatgcctggctaatttttgtattttatgtagagatggggtctccctatgttcttcaggcttgtcttgaactcctgggctcaaacagtccacccaactctccctcccaaagtgctgagactacaaacgtgagtcaccgcacagagctaagacctcattctttacacgtggagctccagcgaagtttgtgaaggagagagaagattaatactgtaactcagaaagtttgatgagccaggattgatggacagattctcttaagagagggttgtttacagacccagagttttattaatacttagattagagagaaagtaatggtgtgaatcggggaatgaaactgtgtgactcgcatgtagatataggttcatttcacattaaaaaaataaaaataattgatttttaaaaatcagtacgtacattggattgttagtactttctcttgacctatgaattggaaagtgtaggcgtgaggtcaacaagtattccattttctaaaaaatatgtgacaactttttacagttttccaattctgatttctacaaagcagtgggttagggtctcatttgaatgcagcctaagttttcagagtggactctttgtgttggtaaaatagtcatatgcttgtctatttcccatggtttcatatcaaaaggaaagacaaattgtcatttttttttagggtgaagaagagaaaggataagatgactagatctctgctgtttggggagtactgtgttttagccattgtataaactgttaattaaattatctgctgaagaagcaaacctttgcctgtttacattctttctaactaagtggccctaagagtgactattttgacacagcttttctgatcagtttatgatcatttggagtcattttatttgttagacagggccattagaaaataagagagacagccaggcacagtggctcctgcctctatctcagctacttgggaggcggaggtgggaggatcatttgagcccggaaggtcgatgctgcagtgagctaggatcataacactgccctttagcctaggtgactgagcaagactctgtctcaaaaaaaaaaaaaaaaaaaaaaagaaagagaacaagaagacaggaatatgcatttttgtgttgctgaaatcacatgggaccttaaataaatactttgtaaagttattatataaaaaatataaagattgcttaaaaaactagtatcttacatcttccatgcctcttggcatgaaactatttctcttagtaaagcaggagcatgctctggcaggattggctagtgaattggtatctaattaaggcttttgtatgtgggctcacctactgccgtgtctgactatcgtcaaaaaagggcgggcactgagaatttttggttactcaccacttattaagttaaatattaagaaagcaagcacatttactttttaacaatctattgttcaatgtctaacagtctgttcaatgaaaataacctctaagtagccaaatgaaatgagtttttaaaatatttttaaagacaaacagccttttttctttccatatctatgttttgtgggagggggcaggcacacagatagggcaaaagtaagttcctcttttttttttagcggttacagagtcttactctgttgcccaggctggtgtgtggtagtaccattgaggttaactgcagcctcagccttccaagctgaagcaatcctcccacctcagcctccagagtagctgggactacaggagcacaccaccacacctgactaatttttgtaatttttttctttggtagagacagggtttcgccatgttgcccaggctggtcttcaacttctgggctcaaatgatcctcccacctcagcctttcaaatgcagggattataggcgcaagccaccacacccagtctaatttccttgttttttaaaataaaatattgagcttgtatatgtttttccagcaatatagttttctaggaagtgtctattttataattttatttaaaacatctttatttccttgctgagacaaaatgtggatatacacatacgaaaaaaaagtaagctcaaataattgactttggacaattctacacttttattcagtgtaaacatcgaagttcttccacactgatgtcactatcattcgctcccatttcggtcctaagtcttgggttgaataatgctactttcactgctgcactgaaaagattcatgaagttaactttgccatgctatttatttccaggctactgccataatcgtttttagtttgggtattaagaactcatcaggagatggcaggttattttttttctctttcctgtgttcattgatcaaattcccacttgctttaatgaatttggatttgcttaattacctttcttcaaaggccaaggaactcaggaaataataggtgaaaaagtgctttgaaaacataaagttactagacaaaaataagatgtgttacacttctgatatgaactattagtctcccacttgcttgagagagatgcttaatgaagatttgaatctggcataaattatgcaatgttgagacctttataaatgagtgaacagacttgtgtaactgagtactctcatggcctgaggaaggtgggaggaagagttgaaaggaatattctttgtgcaagcagagacactaactaatgttcccaggacctcctctgtgagtcagttttaacgggattgtaaatatgtgctccagtgagttttaacacagtgtgtcagttgctcttggcctttctgtttatcgattctatctacaagatgtgaaaccacagggaggtagaagctttattagccatttctgcctgccaagattgtgggatttactgacttcgtgccctccatgttccttgacagcctgggcctctcctactggattaatacctgatgagtacctgatcacgcaacagtgaaacaacacaaggtcaggggcttttgaaacacccaacccctgggtgtcagaaagcctgtgactttactcagataaattctattttagcgtggtggtggaggtactttgtggccttttgttgaagtgaaaagtagtacaataggccggccaggcttcaaatgagttattaaatctctcttcaactttctcatgatgccttattttcataaccgtttgtaatcagagcacttcagaagcagcacaaaatgagaaacttactctcaggaccccatttctattttttgtaaagggaaaatacatcctcatgtacacgtgaaaaaactggaaacgatgcatacaaaatgtaaaccattcgaattaagcgtgtatgtctgtttgcttatctgtattttctatggcagtcatgttttgcttgtatcataaaacgaaagcttattcaggaaaaataagcatggcgaggtacacatggctaattttgtctttcttctgttctgttctagaaattgaagccaaggaagcttgtgattggctacgggcaactggtttcccccagtatgcacagctttatgaaggtaagctgggaatgccactttttaaaagttggcataatcataatcccttgttcgcgagtattactgatctatgacttattttcagcagttttatcgtttaaatgttttatttttaaaaaaaatgttgtaagcatgcaagacccccaccgctgaaaacaaaagctagcaccttggtaacacgcccatgccactcccccatctgctgcctgccactccctacccaaagtaatcagcatgctgaagactatcattttcttgctttctttttgtataattctactccatttcctgaaaagtacatttttacaaagtaatttttacgtttataaaaagggtagtgtgtcgtatgtaatttcatggggtttttatttttcacttaatattgtattgttaagattcttctatactgtatgggcctgttatgcatttgctttggctgctgtgtaatacaccattgtgtattacacaagaaaccactgtttattcatatccacactctggttggtgggtattttggctttctctgttttgcttttataagctgtgctgttgtgaacattcttgcatctatcttttgtggtacatgcataatgattcatcttgcttctatccctaggaacagaattactgggtaataaagaatatgtatgttcaattttaaaatgcaagcttttcgaaagtgcccgtaccaattttcactcttaccaatctgtgtatccacattccctcaacgcttgatattgtcagactttaatttttgccaaccaaatggatataaaatgatatagagattttgactgccatttccctaatccttcatggtaatgagcatttattcatgtcactcggccacatttgtttgctcacattatgcttctcttaatgatttataagggctctttttattctaaatactaatctttcattggtcacgtgttgcagatatctttcccaccatttgtaattaggcatttcacttttctctaggttgtcttttaatgaatattatgttttctgtggcattcagtttttcaattgagaaaaatggttcaaaaaaaaaaataggatctgtgctgaattcttaacatctcattttcttatcagtgccctggggattgcttggatactgaggtcattctctcagcttctgcgtaccctggggagtgcttgtgctccctgcatgtcaagataaataggctgttcatttatttatttatttgttttgagacggagtctcgctctgtcgccctggctggagttcagtggtgtgattttggctcactgcaacctctgcctcccgggttcaagcgattcacctgcctcagcctcctgagtagctgggattatgggcatgtgccaccatgcccggccaatttttgtgtttttagtagagccggggttttaccatgttggccaagctggtcgtgaactcccgacctcaggtgatccacccaccttggcctcccaaagtgctgggattacagacatgagcaaccacgcctggcctaggcagttcatttaaatgggagtttcattatactctatatgaagtcaatttaaaataattacagctatgaactaatgcattccattttatgggtaactttcaaacagaggttgggtgaatagcaaagtgattcccaagttagaatacccggtcttccttatgtagcctagactgattgtgatattttttccaagaagatggattctgaattgttttattgttagaccgtgtaaaatatcttactgtttcttcattccagagaatatctccaatttcttttgattaacttgcatgcttattttggtggagttacttgtctttcctttagagagaagttttaacctgttaacatttagaagggctttggggaaagggggaccagcattctattggattttcaattcatagctctactggagataaggaaagacaactgcattggcagtaacaccaaagtggctgtccttttgttctcctatttagaaactaagttttcttcaattatgctcgtttttggcattgatttgctgccaggtagcactttcttgtgatatatatgtttgctaagacccaattccattccctgtgtctcctctttcctaatcctaaaatgcagggtgcatttgcacaagttacatttggggtcccttcatgttcccaagtcttttgaagcataagactacttttggggtacactgcgtattgttctgggccattgcctccccccgtttttcctgccactgtgtgctgggtgagtacatacactatacaccccataccaacccacacatgtccccctgttaagcttgatttgcgtacttggcaatttatacttcctgcctttcaacccacagtggaagttgagttcagagaacatcttctatacatcagtaaactatcatcttttaaaagccagtcctttcagaaaggagtccaggcaaataaaagaaaattactgatttaattcttacactcctcacttgcatttaatacctaccagattttttaaaaattgttaatttggattagaaaaggaatctaaaatatggctctgggtatactaacttagaattcctaaaataacatagttactttctcacatataggtaataggcatatgaaaatttcaatttacatttatagatctgatattatactctgtaaatattaaaaaatattccttaatatcagctctgttatttcatcttggtgtgtattcagagtcaaatattggccaggaatggtggctcatgcctgtaatcccaggactttgggaggctgaggtgggaggatgacttgaggccaggagttcaaggccaacctggccaacgtagtgagatcgcatctctatttaaaaaatttgaaaacaaacaaaaaaaagcaaaatacagtgtcacaaccttcaaacaatgttacaacctgtcttccctcatttactagtgctccagtttccattgactataagtctttctatttccattataatggttccatgaatcatttgtctaagagagacttggtctataaattagtgaagaaatgtcattctgtgatactaaattttatgtattcataaatctctggactatagccacttccttggtctgcttatattatcatttagggaacaatgtcagtaatccaactgtagccttcagaaaaaaaaggatagactataactttatactcattctgatatattatctctagaaaatagattactaagaataagaaattccatatcattccataaaaccagtaatcataagaaacaataaaaacataatgaacagttgtgcacccgcaggagctggagcaggactaattacctgcgtctccaaaactgctgacagccatgtctgttccactgtgtggcattagccattttgaaggccaaagggatttttttactttttatttatttttttcagatagggtctcactctgtcatccaggctgaagtgcaatggtataatcagagttcactgcagcctcaaactctggggctcaggtgatcttccacctcagcatcccatgtagctgagaccacagcccgcatgccaccatgcccagtaaaatttttttagattttttttgtagagacaaggtctcgccatgctgctcaggctggtctcaaactcctgagctcaaatgatcttctgtccttggggcctcccaaactgctgggattacagatgtgagccacagtgcccagccaaagagaattttttagcttgtggtgattctagtttcctgctgtgatgactgatttcacccaggtctggtccaaagggttaccctacaccgagacactcctcttcctggtattgtagtagcactctactgaggaggcccatgatttgccctcatagttgggactccaagagggtgataacttgcctttatccagtggcaatttcagagctgttgtaaatttccacagcggctacctccgctctccttttcttgggtatatttacttaccaagggatctttttatgtagtccagagaaaggaattcctccattgagtcgactgttttccccctctctggttttcagttctgatacagcttcttcattgtctcgagagaactgaatgaactcttctacagattaaaggatttgagattctgttgttctatagcaacttcatagctagccctttctttttaggggagttatatcaattcctgcaaggccatattgcagtgctaatatttgtttttaaaaagcatatcttgaattctccttagctcttgatgccatgtgagtggattacattccatttcctaccacttttcattgttctctagatctttctgtggctcagttttctttccgtgacctttccctgatcacacgtgagcaaagacacacacacatacacacagcccagccacattaaaacggagcattcttctgacagtctttgtggcttaaattataatttctactggggactcattgcctgctgatttgtttaaacatataacaatgttctgaaccacttctccttgaccagaagcaatattttgagtttcccccacattaaagccgaagctcctttaggacagtgatgcccgattggcttcaattgccttatagtcccatagaacttgacggggaatgaggtgtcctacagtaggtgcttagtatattgctgaagagttttatccctgctttggtaaactgggctatttggcaaattgggttttaggcgctcaacaaatacatctgtttatttttctcatagatttcctgttccccatcgatatttccttggtcaagagagagcatgattttttggacagagatgccattgaggctctatgcaggtaaatggacacgttttgagtgttttccttttttattttttaagaacacagtacttctcacaaagataggctttgtttgcttttgttcttgctaattgtgttaggtttttattggcaaaccatagagtgatcatagaccttttaattaaaaactaagtaaaatattgttatttagtattgccattaaaatagcatccacgctgtcctaggaagtactcacacaatagcattccatatttgatataattggtgtaacaagtaacaactctcaggtggtttggaaacgtggattaaggtttcctaaaagggtacgatggaaattaagcatgttcagaggaataaatggggggtggcatataaagacaggagcatcatttgaattccaagaacgctcctctcaacctcttcagtttcccctcgtataaaataatgataggacgaaataaggctataaaataactcagcatggtctttaacatataggcaacagacagttaaatgatgagaaattgaataaaaccgtcagaaattcttgatcattgtggttttgggtcttcaagctgagaggcagcttataggttttagtgaggtggaagtaataaaacctgtagcagtcgatgatgggacactgataatcctttcaagctcttcaagacatgtctactcattttaagtttttcatcctttctaatttttctcaaaagctaaaatccctaaaagctgaattctgggggaaaaaaattatacacagacaaaactcacataggttgatttgattatgaaactaagtattattttaatttcagggtttttttgtttttgttttttttgtttctgtttttgtttctgtttttttgagaaggagtttcgctcttgttgcccaggctggagtgcagtggcgtggtctcggctcactgcaacctccgcctcccaggttcaagtaaatctcctacctcagcctcccaagtagctaggattacaggcgcccaccatcacgcccagctaattttgtgtattttcagtagagactgggtttcaccatgttgccaggatggtctcaaattcctaacctcaggtgatccacccacctcggcctcccaaagtccagggattacaggcgtgagccaccgcacccagcctgttttttttttgttctgttttttattttatttttttttatttttaaagacaaggtctcactctgtcgctcaggctggagtgcagtggcacaatcatggttcactgcagccttgacctcccagctacaggtgatcctcccacttcagcctctggagtagctgggactgcaggtgcacaccaccatacccagctaatttttgtattttttgtagagatgcggtcttgctgtgttgctcaggctggtcttgaactcctgggctcaagcagtcatccatctcggcctcccaaagtgctgggattacaggagtgagccaccacaccccatctcagtatttttttcaacttggaaaaacatcatgaaggtagaatgacacccagtatttctttcctctttgtaggcaaggaaagcagtggtagttctgttttctgcctttctcatataatacagtgttatatgaagcagccaaagtaagcagtggtttggggcagatagatgggatatttagcatagtgtatggactagactagttctcatggtttaagagaggaaaaaacaaacagtcctcttaaccacagaaacgctgtcacttttgtagtccaattaaatgactgatagaaacgtacagggtgtgtacccattttctgaaagaaacctaattccaagaacttcactgtggagtgtaatatcattactatatcatcgggaatgaaaccagatgcagtttcgggaggggaaggagtctgcatctggaatatgaactactccagacatttttttaatgttttcatgcttagctgtggagcagaattaatctgttttcaatccatcactgctgatcatgcatatgcatgaggtcacttctgagatgcatcttaggaaatatttaagcattacatcatttcacgcagttagagagtgggcactctggacagcagcaatagcttaggaattcttgggtcataaaaatatcactgcagcatttcaggccaaagggtcatgattaaattcttgaatgctttttcagaatatcagtttgaaatgttgttttccatttctgggaaaaaaagtatcctctgtactttgcaatttacactggctctgagtaccttttgagaagccacctttctctgaagcgaataagtctgtgctgctagatctttggtgaaaagaaaagcctagaagaagcagactctgccacatatgctagttgggcttcagttttctctcctgcatagaataacatcttataggaaatgcagtgatggatgtcagagcgctttaaaaattaaattatcaggccccaatttgagtatgtgcagaaaggcctagggttggattttcttttttaaaaaaggaaattcttcagagttcacagtaatagtcatcaactggtttgtaatggaaaaccccagggctcttgtccacatgtccacataaatggacttttcatgaaaatgatgcccctttcgagaggcctaaacaaatgttcagaagaaaagggacctctatcgggtgtatttcaagcagcttcctttattttatttttttatttttttgagatggagtctcactctgtcgctcaggctggagtacagtggcgtgatctcggctcactgcaacctccgcctcccaggttcaagcaattctctgcctcagccccctgaatagctgggattacaggcacccaccaccacgcccagctaattttttgtatttttttagtagagatggggtttcaccatactggccaggctggtcttgaactcctgatccacctgccttgggctcccaaagggctggggattacaggcgtgagccaccgcgaccagccagcaactttctttaaaacgtagtacaagttctgagctgtcagctgcatagtgtagttgagatagttgttgtactgattatgtgatagtcacttcatttgctagacctgcctcttccaaataccttcttggcctatggaattcaagggccagcaaataacgaagctccagtattatttgaaattttgccctgtgatttagaagttctctctagactgacagactttttatagacttttgtctttgccttgttgatattttctgaacagttgattttaaatacatgtggtaatatggttgcagaaattcagcttaaacattttacaaaatctttcccacctacctcctccccttgtactggaccatattttatgcagggatcttataagtgatctcgtatttactctagcattattcttagtttagagtgttcatgtacctgtgacatttacagatcttacagctcctttggtcaagaagtaagtaggagcttctttttctactcagggcaagaagacttgtagagttagtgggttttatgagaacaatgacatagtcttaaatataaagtttggcaataaccaaaagttacaagtgtgggactatagattttttggatttagattgctaaccagcatttttacattcacactgcaaggggttcatgtgtctgttcccttggagaaacggctttggcctgatcttgctagctttactatataatgcaattccaatgataaggccaatattatgagagctatactcaatggtaatcctggaggagtgattcgctttgtcttgaagcatgtgcacgtagtattgtgaactgtgattcactacgaggatacctcttgtgaaatgttctttctattgcttgccttcctacagcttctgaaaactattccaaattgctattttcctttggaattaaaaatgactccttctataaacacagcaaagaagtatgtacatcaagtgacagttgtataatgaaaaatagatttccacactgtcacctgcagtattcactttgttgtaaagcagtccatcagatgcctgagccatgcaaagcagcccaccttagagcagattttaactttgtcacaatttctggtctgttaaaaggtaagcacgtagccgggcacagtggctcaacaatttgggaggccaagatgggaggatcccttgagcctccaggagttggagaccatcctgggaaacatggcaagaccccatttctataataaagaacaaaaattagccaggcatgatggtgcatacctgtagtcccagctacttgggaggctgaggcgggaggatcctgtgagcccaggaggtccaggctccaatgtgccatgatagcaccattgcattccaacctgagtgaccctgtctcaaaaagaaaagaaaaggctgggagtagcatgtaattttttaaagcaattgcacagattccaagaaaatatctttaagaattgtaaccatttttatttgtgagagtcttacttggaaaattgtatctttcccccttctccctcttctcttctttgtttttggcttgtttttacttttaatacaatggggcccaggtccccacctgctgtgcttttatctgggttcctgcagctccatgcagagaagctcttgaacctctgataggccagccttgcactcctccctcttcagagcagggtagaagttgcccaggagataagagggacacattcctgtggagcccagcctgggagggtccttagggggatgggaaaggcccaggcttctggacggatgggttacgcccagcatatcagccactgtgtgaggaatcccttaggatataagttgctttcatttattactaccattaatatttatattagaaaggaacacagattgccgggtgcagtggctcatgcctgtgatcctagcactttgggaggccgagatgagcggattgcctgagctcaggaggtcgagaccagccgggcaacatggcaaacccccacttctactaaaaatacaaaaaattagctgggcctggtggcgggcacctgtagtcccagctgctcaggaggctgaggcatgagaattgcttgaaacggggaggcggaggttgcagtgagccactgcactccagcctgggcaatagagcaagactgtctccaaaaaaaaaaaaaaagaagaaaaagaaaggaacctagaagttactgggtttgagagccaccatgttttaatcgtgtggacttagacaagatctgtgacctccctgagccccatttcctcatctgtaaaatctaggttaatcataatatctgtaccatagggtcgttgggaagatgaagtcatatataggaagtgcctagcatagtgcctggcccgcagtaggcctcgtttgtgtagctggaactatgatttgatatcagtactgtctctgtaaggaaataaggtcccagcagagtacattctttgggggtcctccaggacaaatgaaaaccacagaaaccctagggtataactctgggctttaggtctgtaatgccattagctgggtgctaccaacataaaaaggtaatgttgacctttatagaactggcctcctgggtctttttagtttgactaaaatctggagtttgtgaggctaaacccctctccagccccataggcctctggctagtaaatttggttataaacaccattcaaccattaaagcccaaatgaagtcaagtgactatttgattacaggtttgattaatggaacccagacctaagactaactgtaaccattccggattctttaaatcttgaaagcatttgagaactaaaacactgtgggtgtaagtcatttaagtaattgatacccccaatagagggaccttatatccactcattttaaagtgtgcagactttttcttagttatttgttttcttttcttccccatcaacagagagaacttttctgaacctaggcgctctgggctatctttatttattctataaacaggctaccacctaaggtatgaaggcaaaatcgggcttatcaggcaggcaaaaatgctttctattctgttgcatcaacattgttaggcaaacagcaagaacaggatcaggaagataaagccctgaggaggtctcacggttcccaggaatttgtgtgaattaaatgatctgatcttatgaaaatgtagaattgcaattcgtaggaaaaactagaaaactggtgatagcagatggcaaacagacacattacaggttcatttgaggaagactaagtgatgatcatctgggagatggcaggaaaattggggccttgaagggctgtcattcatagttgtacataccgtttagttcagcatatttaaagtgtttcttttttcaactgttgcattatttctccatgaggttttgggttttttttttttttgtaagtattttattttcaacgaaactaaatttccctaattttaaattgatattgctgtttggcagaggtgaaagtattggtatcaaaatgacaataggatggctgttgcaaaaagagtcttacctgagtgcttaattttgaacccggtaagatttggatccttgaagttacagtacgcaaattctttaaatgatcatttgccgtgactatagcacacattatattgtcctataacaggaagctgttctaaatattggatattaaagagggcttcaatttccattctgtgcaaggactctaaaattttagacaggctgtccaagattatgattcatcggagataactaaaactaattttttaaatttgagttttgatttcaaatacaagacactgtttattttgccaaaaactctacttggttctttgttgctgttttgctgtttctatttctatgaaaggagacatcacaaacttttcttttctttctttcttttttttttttttttttttgagatggagtctggctcttttgcccaggctggagtgcagtggcacaatctcagctcactacaaccttcacctcccaggttcaagcgattcttcctgccacagcctcccgagtagctggcattacaggcacccacgaccatgcccagctaatttttgcatttttagtagagttggggtttcgccatgttggacaggctggtctcaaactcctgacttcaggtgatctgcctgcctcggcctcccaaagtgctgggattacaggcatgagccaccgtgccgagtcacaaacttttctttcttggctccatgtgcggcagtccataatggctcaacctaagagttattggaagaatgatttttcttagtaagaacaactcattgagagttgaagaatcagagagacttgacagtatcatagctgtgtgccatttcacactaaaatataaaaattaaagtgaaaaacttacaaaacataaaggtatttatttatttatttatttatttatttatttatttatttatttattttgagaaggagtctcactctgtcgcccaggctggagtgcagtggcgctatcttggctcactgcaatctccgcctcccgggttcacgccattctcctgcctcagcctcctgagtagctgggactacaggcgcccaccaccaggcccggcttgtttttttgtatttttagtagagacggggtttcaccgtgttagccaggatggtctcgctctcctgacctcgtgatccacccgcctaggcctcccaaagtgctgggattacaggcgtgagccaccacgcccggccaaggtatttttaaatgactcactttttaaataagtttctaatactcctctaggtattaggtattactgagtttcaagaaactccttaaatatatgaattgtttaaaaacaggtgtttatccactcattagagagtggttgcctatctttgctaacgttatttctttgctctataggcgtctaaatactttaaacaaatgtgcggtgatgaagctagaaattagtcctcatcggaaacgagtgagtatacaaattgcataatagaatgagggggaaaaggggcaaacaaaaaagtgaatgatgtgttttgtaataggttttgtttctccaactcttagtttgttgttccgtaagcatctacatcttgaatgatatcgcctagacttgatagccttatgtagttgaagccaatagttgcaactagtccattacattattttatctattgtttttgacctgatcacatcagctattattttgcctaattactaactcaatgcctattacataataaagggatcatgcttaaggaatcccagtggatttttgcattgctcatagaggaaataaactgaggtttatttccaactcttctgtcttcccaaatataacaataactgtgcttcaaagctgtagagatgaaagcgaaggccgatttgtgcaatattgaagaataataagagatttggagggaggaaaggaattggaagaggaagaggagaaggcaggagatcccacacagtttagtcaaatggtggtacacaaccgagctggatggtattttcttctgcgtgtgagttgtgaagactttttatgagatcttaggagaagaggtgggtgtagtactgggagtaagtgtcacaaattagagtaaacaggaatgagtctggtcaaagaacatatttctgacttccgggttcaaattttaattatgccagaatccctgagctgcaaaaagttgccttcttggggagtcaaagcttttaaacaaatgaactggaacctcagcgcccactgagctatgcagaagagtcctagaagccagcgctccatgcttgccactcattgtcctgtgaaacttgggccacaggatattttccacaccagtggaaaagacatgtatcataccgaattgtgccctttgatatcctgccgaaaaggccaagatgcaatagtccgtgtgacagcttatccctgagtcctgtacataaatcgggcataatcagcaaagacgttccttagtgtttatgaatgccgcgagctgtcagggctgggtatttgtgaagccttgttcaattggctggagcatgactgaggttgaaacttcacaggtcagctgtggcctgagcgctagccttcatgtcttgtgggggaggggaagaaaaggtactggtaagagtctccaaagcactgatagtggactgaatctgcttgatgacccaccttgatccagggcccctttactccagtgggagaccttatacatttttagtgtctagagatttaagttgccactcttcttagtgtttgaaaactacctttttaattgcaagagggaatataaacatacaccaacaaaagacagcacaatggaaggcagcccagaggcagtcctgctcattgctgacttcagttcaaaatattttgcatgcctggaattttcaccatctcagaggtttcctctatgagcaattaaagaacagcctatggatcccagagtttccataaaatagttcttatttaacttgcaacatttggtcaggcactctcctgttaaattctttaaatacatctttgttatttaaagaacaaaacaaaacaccgggcactgtggctcatgcctgtaatcccaacactttgggaagcccacgtgggaggatcgcttgaggccaggagtttgagaccagcctaggcagcatagtaagactactgctctctacaaaaaatttaaaaaagaaaaagaatatgtaagtggggctgggcacagtagcttatccctgtcaccgcagcactttgggaggctcaggtgggaggatcacttgaggtcagcagttcagaatcagcctgggcaatacagcctgtacaacagagtgagaccctatttttaaaaaaaaaaaaaaaaaaactttaaaattaaaatcatgaagtacaagggggaaattgatactactggcatattatgagcagcctcctgctcatgccctgctccctgctggctgccagccccagtgtgtgaatggctcctttctgtctttgcagagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggtaagaacttttctcctgcctccgggtgtggggcactgggggtcagaaagacattgcctgtgcttgttctgtgggaagaaatgggattaagtctggcattcttagccatgtccattcctaaggaaggtgtcaaaccaggaagcaccaaaattcaaagaaatcgataggattgaatgggtatagagttccggttggggaagatgaaaaaagttctggagatggttggcagagatggtcacacaatgagaatgaacttggtgccactcaactgcacatttaaaaatggtgaaaatggtgcactttatattgtgtatattttcccataatggggattaaagcatgggatagaaatcaagtcctatcagttcctaagataagatgccagcaagcagcccattgctaatgttgcttctacctattaaaaagcctttgggccaggcacagtggctcacacttgtaatccaatactttgggaggccgaggtgggaggatcacttgaggccaagagtttgagaccaagctggacaacatagggagactctatctctacaaaaaattaaaaaatgagtcagatgtggtggcacaggcctacagtcctggctactcaggaggctgaggcaggaggatcacttgagctgaggagttcaaggctgcagtgagctgtgatggcaccactgcactccagcctgggcaacagagcaagaaaaaataaaataaataaaatcaaataaaaaggcttcacactcattttcctctcctcttctctcgcaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctggtaagagtttaaatgatcagtcaactgtcgttgaaaatgatatttttggtcagttccttgaggttgtccccacagtaaaaaatgacacttctctcctttattaatatatttcatctgtcatcctatggcaatcactctctgcatttttgtttgtttgtttgtttgttttgagacagggtcttgctctgttacgtaggctggagtgcggtgcagtggtgcgatctcggctcactgcagccttgaccttctgggctctagcgattctcccacctgaggctccagagtggctggactcctgagtaggtgggactacagttgctttccaccacacccggctagcttttttttttttttttttttttttcttttttcctttttgaagagatggggtttcaccgtgttaactaggctggtctggaattcctgggctcaagagatccacctgcctcggcctcccaagttgctggaattacaggcgtgagccaccacgccagccactctctatattcttgaggccacatttgatattgttgaagccagtggagtcttaggaaattatcagcgtgggtgggttgattgagttttcagctctttgagtgacagattgccagttgatggggtgagaatgcattactcttgcatcacgtggtataggcacctccttcccaatattaagaataatccactataagtaaatgtatgcacagtatcagatcgtatttttggatggaggaaaaggaaaacaataagatttaatgagaccatctttgaaattcttgatttacagtacctggtcttataaccgtattcatgcctgtttttagaaatcattttggggcgggtgtggtggctcatgcctgtaatcccagcattttgggaatctgacataggtggatcacatgacgccaggagtttgagaccagcctggccaacatggcgaaaccccatctctactaaaaatacaaaaattagctgagtgtggtggcatgcacctgtaatcccatctactcaggaagctgaggcatgagaatcccttgaacccagaagatggaggttgcagtgagccccaagataaggctactgcactccagcctgggtgacagagtaagactctatctcaaaaaataataataataataataataataaatttggatgtgaatatttgtagcatccacctgtgctaaagaattcaggttactttttttctagcaaagactgtctaacagtgaataattattttaaggaattcactactctaacatattatagactcaaatgtagagatgaaatgcattgtacaaattgttcataattactttgaaaaatatagctccttagtatatagaatgtgaggggtaggctgtaaggctagatgggtcatggatatcacctaatctgggtacatcttaatttttctgctatcagtgccaagcagagaaatgtttctagattgacatctcagtgcatttttcagtgtcatctgggaatccttaagtcttttcagtaatctgagtgtttattatccagtcgcacactaccatatttgataaaaatggagaagccgcccatttcattagtagcactctgtagcaaacccaagttgcttgagaaagtcggcaaagcaaggaaactgttctttttgtctccagctcctcctctccttaggactcatagcagatttaacttcagcatcaaagcacctcccgttcaaaggctgttattatgtgagccttgctaaatacagaagttgtttgttctgaatgacagaaataagtattgaccggtttatcctcacatgcttcagattctcggtggggatcgtaatgtgttcttttcacattccgccgtcgggcttttctcccccgacaaagcgagtattatgcacacttatagccatgataccacacacttaactgtatggaaatacaaacttaactttgctctttcgttttacctttcctggagctataaacagtaacatgccatggctgctggtgagcattcaaaaggcaaagcagtctgtcttctctggagttcctctgtgcttagagtaatattttccctgctggctatttaaaactgcatattttagattctcatttcggagtggcccacccccatcccaccaaaccctcaagaatctgaaagtccataatacttcttgagttctggtcagtgtttccagtgactcaaaaccaactgtaaaagcctcacatggtgggatctgtggagcagggaggaatcctacacaaggttcttttcctgtttggccttgccctttcgggtcctgttcagagaggtcatttggagagctggaatttctgcttgacagcctgaaatgcatgacatgggtttcctgctgttgcatatagtgctggggtggacctggtttcaggacaccagggagcctggggtcggctcacaaaacccccattgttccttttccatcttcctttagaaacctaaagatgtaatgttctccgggtcatcagcagcagattttattttgacttcaggtcattcactgttgagctctggagttggctcccattgtgttaggctctcattgctgttttcccatcatgtgttatctgcgccttttaaccctaaatgctttcgatctcatcaagaactcagaagtgattcttacccttttttcaagacaaaagggaccttgtttttcacactctatcagatgcacctaattagggtattacatgttgttttctgcttgttccttcctataccgccattctgtaaggaaatccatcagcttccttaagactgtagaccccaattctccaggttcaaggtggaaggacgctcctaactgaggaaacggacctgtcaacccccactcttagaagatctagaacagcactgtccaggagaactgtctggatgataggaatgttctttatctgcacaggccaatacagtaggtactgagcacaaaagatgaaggagcacctgaagtgtggccagtaccactggggaactgaatttgtcattttgtttaatttaaatttaagtagccaccgtattagcacagatctggagcccacagggtttgcctgcagaattggacaagtgtagacagacaagtgagcatgtctccgccaacaccaccatctctgtgttctttaacagggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggtgagagcgctgcctgcgggtccacgtactcaggggagctcggattacatgcagcttcttctagttgtgtggtgtaaacactgcgtccacgtgaatgtaccccacacttagtgttgctcttccgacaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatgtgagtgtcctttgatcttaagattgttggcattggggaaaaatgggaccaactgaagcttgtagcttccttgatagcattctttttttttttgagatggagtctcgctctgtcatccaggctggagtgcagtggcgtgacctcggctcactgcaacctctgcctcccaggttcaagcgattctcccacctcagcctcccaagtggctgggactacaggagggcgccaccacgtctggctaatttttgcatttgtagcagagatagggtttcaccatattggccaggatggtctcgaactcctgacctcaagtgatcctcccacctcggcctcccagagtgctaggattacaggtgtgagccaccacgcctggccttgatagcgttcttttgacaagagagtctgcatggtgacctcttggaaacccatgtcatcaccttcttccttgccgccttgtttgtggaacaggtttctgtgtaattattgaatgatgtgaaaataaatttcccagtctctaatgactgatgcaattgtacgtttttacgtgcaaaatgaaaagttagactttcattagtttctagaacagtgttatctgagctggtcagataaagatcaggtacgaagatctctttctgtctccaccttgtctacagaaatttcagttgcttcacacccctcttggagggccgttggatttaaaatttcacaggtgtctgtgtgttttatcttgctgtaaaatgaataaataatctttttctgttattcatctcagtctctgccagaaatacttgggagaacaatacccatgcccttcttacttttatgtaaagcttaaagaaaacagttgtcgaaattaatgatcaagatcaggattatggcttttacagccttgtgtttttcttggctcagtgtggtattacagcaacgtaatttaaaagcagcctctcttagcgctcaaattgtctctaggattggcacagtggactttattttatgagaaatggagctggtctggattatttcattggttgtttcatcctttcatattttataaaaacacaggtcacattttcctcaccgaggtatttgttatgtgctgtaaccatggagctgtttaatcagtttgtcctatggagctacatttgagtgacttgatttttccaccacatgctcttttaaagagttatgtattcaaggagacctgaagatcgggatcagcattttctacctgtagattgtttatgggtttatttgcatttttatatatttgcatattcatatgcatttttatagcctctcgagcatgctttctaaaacttaagaaattactaattcagtgtgttttatttattaattgaactgaactgaatattttcagttcagttcaattcagaactgaatattttagcagcttttcccacttcaagaaggaacaaatcagttaaactcatgcaaatctccagagatactgaacattttgtactcaaggctgagagatctctgttcttacgttcttgtacatatctcagataagatttttcatcaacactaaacaaaagtgtatagtgttttcagtaattgagattgataaattagggatttttttttttcatgcttaggaaagaaaaaactgttctgtaaactaaaagagcaggcatcctctagagccgaactctgaggtggatttaagagtgtttgggtattgtgggtgtttaaaaattttttcactccttcatgaggcaggaaatacttgaggatagtgacgccggtggcaattcataacttttaccgtattaacctctagtgcactttctacaagtgcttgttcagtactgggctgaggtatttgatgccgatatttgctctgggacatttccttgcaatgtccatgcaaattcaccaagctgatggagaaagtgctggtgtcgtgcagatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccaggtacgggctgcatgggaggtgcatgcacacagggggcagcctacattcttcctaggactctccgtagctgtggttttgtgggactctttcctgaaacaagcaagaaggttagaccgctatattagtccattctcacaccgctaataaagacatacctgagactggtctgttggcgtgcatgagaaaatagtctcactggacttaacccccacagacaaaatccatcgaactgatccttttcctcagctctaaaggaacttgaaaagtatttcttagctagaggcctggggcctagttatgctagtgcaggttaggttgcttctgaaagtcatataatgtttaaatgtatgtttaaatagttccttttgagacagagtcttgctctgttgcccaggctggagggcaatggcacgatctcagctcactgcaacctctgccttccaggttcaagccattctcctgcctcagcctcccgagtagctgggactataggtgcctgccaccacgcccagctaatttttatatttttagtagagacggggtttcaccatgttggccaggctggtctcgagctcctgaccttatgatccacccggcttagcctcccaaagtgctgggattacaggcgtgagccactgcgcccggccacatttaaatagttcttaaagttgactggggcattccaactgcaatgggatacagagctagagatgagtagaggagagagatcaaataagatgaagacaaaaggtcaaggaaacaatggacttagccctcacctgtgggagggggcctgtgtattcaggcagataaagatgatgacaccctttactccaactccctgggactcctttcccacactcctcagaagttgctcccccaccatgcaaacacagcccctacaagctgccctgttcccagtaggaacctatttaattaaatggtttgaatcacctggatttcatcaaaagcatatctctttaatgtttttttgtgtgttgttgacaaaactctgagatactctggtgaccaaagtaaaaacactcttaatccacttaacaataaacagattccagtgaaaatttttttttctctcttctttgggtttccttgaataataccttgaagaaaaatatataaatatttgaactgttcccctcctgtatttcttctacctagggtaatgcaaagaaaacaaagtttgggcaaaccagatcagaaagatttgaatgaaaacctagctgccactcaagggctggcccatatgatcgccgagtgcaagaagcttttccaggtaaggaattgagaagtttggctcctttattaaggataatgtgaataggtacaaaatcttaggcttgacccttgttcatgtcttacctgaagaccttttccacagctggagacggtataaatagcctgagaatgtcttatttacatatattataatgtatcagctagagttaatcatgtttaatgaaattgtccctttacttggaaaagcagccgggcgcagtggctcacgcctgtaattctaacactttgggaggctgaggtgggtggatcacttgagctccggagttcaagaccaacccgggcaacatggtgagacctcatctctacaaaaaaaaatttaaaaattagccgggtgtggtggtgcacacctgtagtctcaactacttgggaggctgaggtgggaggatcacctgagcccagggatgtggaggttgcaatgaaccaatattttgccactgcactccactaggtaacagaatgaaactctctctcaaaaaaaaaaaaaagaaagaaagaaagaaaaagcaacaaattatctggaattaaactgctgtatccacttccgtatctgagaaacctgctttgaccaatgtaattcactccccctactctaactttccaaagaccttacatggaaataagatttcagatacatttatggaggtgatctgttcatatcctcgtgataacacgtgcggtcagcatgatagcccacctccggcgggaagatgcctgcactgctttaaggaccaggccattgttcctacccagtcttttccactgatgggcattgagattgagtacaggtggactcacctcctttctgtctgtcatgttccgcacaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtaaggcttcaccctgttgtcggctagttgagtccaggagtcgaagcttgggtccatcagagataacacgcttttgccaactaatctgtctggggatctgtagcccacaacctcccttgtagagctgggcaccggggtgagtaagatccccgtggtgagagtggaaaccgggcaaagcaagagtaattttcttcctgtgtaacacttgggagaggatttcaactatttctaatgaactcctttggctctacagaatcacactagacttccctagaatgttttgctaatggcattgagatgcggaacatcctatgacacgcttcgatttttccataatttggtcagaatccctttgcactcttctctgttcttagttactgttctcttggccctttaatgagcggggatcccttagggggaaattaactccagttaggactggtaaacctcttgagggcagaggcatcttgtaaggctcagcaggataggtccatcggaggtatatgttgatgccgcctctaccatcttgaaaataaacaaacagtgggagtaggctgggtggccttgccggctttggaaatgagtgcaaatgtctgatgtttttgtttttatttatttatattttttgagatggagtcttgctctgtcacccaggctggagtgcagtggcatgatctcggctcactgcaacctctgcctcccggtttcaagctattctcttgcctcagcctcccgagtagctggcgctacaggtgcccaccaccacgccatgctaatttttgtatttttagtagagacggggtttcaccatattggccaggctggtctcgaactcctgaccttgtgactgcccaccttggcctcccaaagtgctgggattataggcgtgagccaccatgccctgccagtgactgatatttctttattgcatgcactctgatataggtcccagaaaaaaaaaaacaaatgtcatcatttttttcttttttcttttgagatggagtttcattctcatcacccaggctggagtgcagtggtgtgatctcagctcactgcaaagtgcctcctaggttcaagtgattctccttcctcagcctcctgagtagctggacttacaggtgcctgccaccacgcctggctaatttccatatttttagtagagacagggtttcaccatgttggccaggctggtcttgaactcctgacctcagatgatccacccgcctcggcttcccaaagtgctgggattacaggaatgagccactgcacccggctcaaatgtcatcattttgactcgagttgacaacagctttttttcactttctggcttgctcttaaatatgcttggggacagcagcctatttaagtcatagatttattagcccccaatatttctttatatactgattatatagtattatttatatcatttaatcaattaacgttgattatatgtaactaaaattgttagtctaactaacaattcgacttcaaaaactaggtgtgtatggattgccttggcactgaaaaatacatcctctttccaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaaggtgagcgcttcccagttgtttttttgtgacaaggatgactccatatatgaaccaagcctatatgtcactgatcttacaagatggtataattatttaaagtagaggccgggcatatggtggctcacacctgtaatcccagcactctgggaggccaaggtgggaggatcacttgaggccagcagttcaagaccagcctgggtaatatagcaagaccctatctctacaaaaaaattttaaaaatcagctagatgttgtggtgcatgcctgtagtcctagctactcgggaggccgaggcaggaggatcccttgagccaggagtttgaggccgcagtgagctgtgagcatgccactgtaccgcagcctgggcaacagagcaagaccttatttctgaataaacaaaacaaaacatatgcttccagaaaagtagtgaacaccttcaaatatggaaaacagatctacatttattctagcagtgtgttcctcgctgagaatggtctgaactctttggtaactgagctcagaaagagaggccccttccaatgaatatgctcattcgtagcagatttttgccccttttaggatagattttcttgtcagaaacagctagtgaatgaataagccaggaaataacatttgagtcccaagggagatgtggttaaggctgatgtatgtgtaattcataaattctctggagatattactgaaagaagaattccaaaaatctttgtggaaatgtcacattggaagtccagaccttttcaaacagccagcgctcctttaggtgtctgtgttccaagacatttgtgaaatagaaaaatggttttaagctacacttcaaatgggctcttttttcaaagaggagactgtctgagcacataaaccctctgtaacaacggctctgtacagagttcctcattcagcagtccttgtacagtgtcttcgtgcatgtaatgctgctctaacagaatctcacagaccaggcaattataatgaacagatatttatttggctcatggttctaaaggctgggaagttcaagatcaagtagttgcatctggttagttggttggttgtttgattgatttggggacatggtttcattctgtcaccaaggctagggtgcagtggcacactcatggctgctgaagccttcacctcccaggctcaagcaatcctcccccctcagcctcccaagtagttgggactgcaggcatgtgccatcacacctggctaatttttttgtttctggtagagacatggtgtcaccatattgtccaggctggtctcaaaactcctgggctcaagcgatcctcctacctcaacctcccaaagcgccgggattacaggcatgggccacccaccatgcctaatgagggtctttttgctgtgtcatcccatagtggaagggcaaagagagggcaagggagagcaaaagagcaaatgtgcagcctcaagccatttttatttttatatttatttattttgagatgggggggtatcactttgttgcccaagtttgagtacagtggcatgattacagcttaagcaatcctaccatctcagcccccggagtagctgagactacaggagcacaccaccatgcccggctaatattttttatttttagtagagatgaggtatcactatgttgtccaggctggtcttgaactcctgagctcaagcagtcctccctccccagcttcccaaagtgctgggattacaggcgtgagccatggaacccagccttaagctcttttataattggcattaatccagctcccattaggccccacctcccaacactgttgtattgggcattcactttccatcacatgctttttggggaacacatgtacaccatagcaagtagtttagaggatgccatttacctaggcctgggtcacacagcatggccactgagcctgacccgtcaccacactgcaaatagtgaagagtgaagcacgattttaaacttggcttctatgaaattccatcatttctgcctctggttttgtctctacagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggtatgttctgattctgatttttttatatggtgagggtcatgaaggaaattctgactttttgtctaatgcaaagaatgccttaaacaaacacgtcattttttcttggtgacttcatgaagaatggtgtttagaaagtagcatttcatgtttgttggtctttcagcgaccacttcgtaatttggttcccttagaaaatgtggttctaaagcaaagcaaatatggtagctcggccatgaattcaaaggcatgggaaatgatagattttatgcatttgaactagcaaacagatgtttctcattttatttccatgctttctaacttaaataattcatcagcttttctttcttttctctgataggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctctagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactg

SEQ ID NO: 37445 - DNA, 2937 bp, Homo sapiens; identical to SEQ ID NO: 35825

SEQ ID NO: 37446 - DNA, 2375 bp, Homo sapiens
gaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaaggtgagctctggagtgtcagggagctatgggtggtgaactgtgggtctgggagggggtattgcaaggttagggaaatggacaatgaggagcgattgggatagtctcagaggagtgggagggtgatgggctcagagacaggactcaggcagcagagaatgagttatgagttggaaaggggtgaatggggcatcttggtggcaggctggggctcaccacccctcccctgccccagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatccgtgagtaaccagaagccctcacccccaaactcctaggccgccgcggtcactttcgcaaaaatgaagggtcggttcactgccaagtggcctttcagttgtccattgcccagcccagagcccccacacccctaggagccccaggtccacggccatgcctcctaaaggcctgggccactcgaccctaccttccaggagtccggggtgccccccccaccgccaccccgccctcaggagccctagatcccagttctccaggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggtgagtccgcggcgcgcggggtggaaaaaaatgagactatctgggccaggaatgggactggttgagaaggtgaccctaggtgtccggggcgggagagttcgggagagctgctgtgtgctagcggacggggttagagagctgggaggctgaatgcagggagcgggtgggcactccagacccgcgcggacccgactggggcagcaccacgccccctacagtccagctcccaccgcctggccccgcccctggcggaccagactctccacctcctggctcccgcggttctgaccacgcctcctcccagccctccccatgagttcctggccccgcctccctccacccccggatgttttgtcctcgcccccttccagactctgaatgcatgaccccgcctccttctctacccggccccgcccacaggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatctcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcagtg

SEQ ID NO: 37447 - DNA, 60615 bp, Homo sapiens
gagcctggggaggtcgagggtgcagcgagccgtgatcgtgctactgcactccagcctgggcaacacagagagaccctgtctcaaaacaaacaaacaaacaaacaaacaaacaaacaaaaaaaacaaagaaaaaaaaatgggagtgggccgggcgcggtgactcacacctgtaatcccagcactttcggaggccaaggcgggtggatcacgaggtcaggaattcaagattagcctggacaacatggtgaaaccccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtaagtgccaaaaaggggagaatgggaagaatatgctgtatttcacaaaaagcatctaagtagccatctggaaaagccagaatgaacttcaatggtgcatccaggtgggctggggatgggagaggaacgccttcccccagcctttagggccggccctgagcaagtggtcagtcggcaggcagctgcggaagggggctcccccgagtcggtggtggcccaaagtccaggccgcatccaccgcccggcgcctagcgcaggggcagcagccgggtcgccacaggaggggccccgggtgttcttgccggcttgggggaactttcccagggtcagcccggaggcgccctgcagccccggcatttggctaaacaaagcaagcgctgccggcgcggcccgcccgagggcgccgcgggaagaacctgggcaggtgcgcgccgcgggcgagcgggtacaaagttgcggcgccacctcctgcgctccgcgcccctccaggctctcctcccagccgcctccgatcctcccggccgggcctctcttcccccgttcttcgcctcctccctttctgctccttgcccttcgcctcttcgctactttcgtctttgcaggctcccgcctccccacccctccccggcgcagggccgagccggcgggggcgcgcagggggcggtgcgcggcgggcgcgggcggttccgctttcgggtttcccgccgccgtggccaatccccgcgctgcccggggcggcgacgcgcccaagccgagccgggcggctcctcccgcccccgccccccgcgcgcccgccgcccgggcggaggagaggagcgcgcggccgcgcagagcaagctgagccgagccgagccgagctgggggcgcagagcgcgggaggcggcggcggcgcggagcccaggtgagctggcggtagccgggcccggggcaagggacgcagccgccgcggccccgggcgcccgctccgtttccctctcgaggcgggggaccgccgccggcatggcacacaaagcccggaggctggcctggggctcccaacacggagggaccccacgtgcgcctccccacgccccgccacgtggagggacacggtccccgacagcccttcccccgcgtcctctgggcgccctgggcctcgggatggcctcctcggctgggccgcgccctgtccgggtggcaggggcggtcctggagtttggaaccggggtcaccgggggccgggtccgtcagggttcgtggaggcggcctaggcccagcccctcgcgtttgacaggtggggaaatctggagcgttccggggaagagaggaccagcggacttggagcacccccaccccgcagcctgcctgtctcggggcaaacccaggccctggtggcttggacaccaggtggcaggaccctaggccagcagttgtggggacctaggggacctttggctgtcttcggtctgccctttgaccacccccaccgcacctcttctctcagccggagcctcacaggcttggtccttctgacctaaattcacctcggggttgcagtatgctgtgaatgcggagaggcgtccgcctgactctcagggacactggacccagcccctctcagcattggggctctgtgcctggggtgccacccgacccagccttgagcttttcctggctttcccccagcccctgcactgcctagctggggaagtgggtgctttcacagctctgccagcctgccctcctggccactctcacttagtgctggacaggatgcagctcagcccctccgatctccccgagaaggctgagctttggggagggcgtctcagtgctatcagcaagagagggatacctggcctccggatgggacctgcagcgtccatctccctacaggctacttttaccttccccagcctggtgtttggagtctccacgcaggggatagaaacttcaggtgccctagagctgtgctgccatttaccactccccctcccctagctctgcccccagaggagagagaagaggatggctttatgtccccataagctcctttgttccttggaggaggcgggggctgcaacaaggggagggctttgggggagttagccaccctcttccctaatcaccccacaaaaacatgcagtttcagaataaatagtgtgcatgccatgcaaatgcagctttagggcaagccccacataccccttccagactgctgctcatacacccttcctatggaggaagcaggcattggtgacacacacccttcctatggaggaagcaggcattggtgatgaggacgcaaaacatatttttgtaatgaagagtaatagccatcatttgatgagcccctaacttggataataataagaatacttatttatttattttgagacggagtctctgttgcccagggtggagtgcagtggcacaatcttggctcactgcaacctccgcctcccgggttcaagcgattctcatgcctcagcctctccagtagctgggattacaggcgcccaccaccatgcctggctaatttctgtatttttagtagagaaggggtttcaccatgttggtcaggctggtcttgaactccttacctcaagtgatccgcctacgtcagtctcccaagtgctaggattacaggcatgagctgccacctggccctggacaataataataataacagtattaaaaactaacatctattgagttcttgctgcctgccagattctgtgctatgtgttacatgcattatctcatttaatgcctaccaaatcctacaacgtagggaattttaaccccatagtagagattaggagactgaggtttacagaaatcctgcagtgttgctaggatttagccccattttatagaagggctcagagaagttaagtaacttgctcagggtcacacagccagtgcaggcatgtcaggccttagaacctttgtgcacctgttcaagagcagagaccctggcaaggctgccctgagcttcttgaggagcccaggagtttgttttgttttgtttattcactacatcagtgtttgccgatgcagctctatgcagggtctgtagtactgcccatccttagatatggctagtgggctggtagctaaatatagtcactaataacaatgcactagttctcatccgggggtggtcccaccctcctggcagggatttgggaaagtgtgggggcgacttttggttgtcaaaatgatgctaagcactcctggcttttagtgggcgggagtcagggatgcctactaaagtgtcctgtaggcaggccagggccacgacataaagaatcaccctcccctggctgggcgtggtggctcacgcttgtaatcccagcactttgggaggccgaggcaggaggatcacctgaggtcaggagttcgagaccagcctggccaacatggtgaaaccccatctctactaaaaatacaaaaattagctgggcgtggtggcacacacctgtaatcccagctacttgggaggctgaggcaggagaatcacttgaacctggaaggcggaggttgcagtgtgctgagatcgtgccattgcactccagcgtggggcacaagaaggagacttcctctcaaaaaacaaacaaaaaacaaaaaaaaatcaccctcccccaaatgccagcagtgccactgttgagaaacaccacaaggaatgagtgctgttgtgatcgaaggagcacagggcactgagggttctggagaaatctcctcagactggtgtgaatctgggaggctccctgaaggaggtgtcatttgtgcagagccttgaaggatgggccagaaatgggagatgggatgggagtaggaggggaaggggatagggtggggtgacctagcagggaactttgtgcagtagccgggggtttcctctttgagaacctcatcctagatggaagatgagtggccagacaccactctcaggggagaggaccaggccaagtggggcaggccaagcctgttttcaaggcattttggctcaaattttaacatgggccacagaatcaccattattctatcaactcattttatggaagcctctttatatgaagggctcagagaggctgagtaatttgctcagggtcacctgtgatcttcttcccgccccagcatactttcttctggtggttatgggaaacatttcatttcctgatcctggggatttggggcaaatgctatttcagattttcctttaaatcagagggtcttatattgcttattgctttgctttgtttcttttcttttctttgagatggagtttccctcttgttgcccgagccagagtacagtggtgtgatctcggttcactgcaacctctgcctcccaggttcaagcgattctcctgcctcagcctcccgagtggctgggattacaggtacacaccaccaggcctggctaattttttgtatttttagtagaaacggggtttcaccatgttagccaggctggtctcgaactcctgacctcagatgatccgcctgcctcggcctcccaaagtgctgggattacaggcgtgagccacggcgcccagctttttttttctttttttttttcttttgagatgggatcccactttgttgctcagggtggagggcagtggtgctatcatagctcactgtagtctccaactcctgggctcaagtgatccttctacctcaaccaccagagcagatgagactacaggtgcatgccaccatgcctggctaaaattttaatttctttatagaaacagggtcttactattttgcccaggctggtctcgaactcctggactcaagtgatcctctaggctcaggctcccaaagtgctgggattggattatagccattgtgtctggcctactgctatttttcttccatgttttgctttcccactcacttcttctctttggatggggttagagaacctggatatggggttcaggccggctggctgcatggtgctgctgcagcctcagccttgcgtctgtgtctctttcctaacagttgaggaaattgcatttcccttttgaaaccgatcttctttcaggctgtgcttgttgccttactgacctgttagtagagattcgtaagggcttctttttaaaaaaattgaggagggctgggcacggtggctcacgcctgtaatcccagcactttgggaggccgaggcgggtagatcacttgaggttaggagttcaagatcaggctggccaacatagcgaaaccccgtccccactaaaaatacaataaaaattagttgagcctggtagcttgtgcctgtaatcccagccactcgggagactgagacaggagaatcgcttgaacccgggaggtggatgttgcattgagccaagatcgtgccactgcactcctgcctgggcgacaaagcaagactccttctcaaaagaaaaaaaaaattgaggtgaaattcacataatataagcttaaccattttattttattttgttttattttatttatttatttttttgagacagagtctcactctgtcgccaggctggagtgcagtggcgtgatctcggctcactgcaacctccagctcctgggttcaagcgattctcctgcctcagcctcccaaggagctgggattacaggcatgtgacaccatgcccagctaatttttgtatttttagtagagacggggtttcaccatgttggctaggatggtcttgatctcttgacctcatgatctgcccgcctcggcctcccaaagtgctgggattacaggcgtgagccaccatgcccagcccaaacttaaccattttaaagtgaacaattcagtggcatttagtacatttataatgttgtacaaccactacttctgtctagttccagagcattttcatcacccccagaggaaaccttgtacccattaaactgtcactctctcttcccagtgcccctccctgcagcccctggcaaccaccagcctactttctgtctctctggatttgcttgttttggacatttcatataaatagaatcatgtaatatatgacttttgtgtctggcttctttcattcagcatcatgctttcaagactgatccatgccatagtggctgtcagtgcttcattcgcttctgcggcccagtactattccattgtgtggatggaccgcattttgtgtatacattcatccattgatagacatttgggttgtttccaccataaaggcgtcttaaggctactttgtccattcccgtgtctctgtagcccctcagttaatgaacttcttggcataagacatttttttgtcactctgtttggagggagcaggtgatggaagaaaggtttcttgaaatcactcaggaaccagtttcccaacccaaggttttcgggattcccttcatgcacccttacctaccccttgcaagaatcgtggctccccatttaaacccattgctggccaggcacagtggcttacgcctgtaatcccagcactttgggaggccaaggcgggtggatcacttaaggtcaggagttcaagaccagtctggccaacgtggtgaaaccccatctctactaaaaattcaaaaattagccgggtgtgttgacacgcgcctgtaatcccagctgctctggaggctgaggcaggagaatcgcttgaacccgggaggcagaggctgcagtgagccgaggtcagtgtgactgcactccagcctgggtgacagagcgagactccgtgtcaaaaagaaaaaaccacaaaacaataacaacaaaacaaacccattgcctcctggatcaattcatggtcatttcattacaattttcagggacagtcttggttttattcagttccattcttttcagttacgatgattttttgtgtgttttgagatgggatctcactcactcgcccaggctggagtgcagtgttgccatcatggcccaccgtagcctcaacctcccaggctcaagagatcctcctgcctcagcctcctgagtagctgggcctacagccctgcgccaccacgcctggctaatatttttaatttttttgtagagacagggtcttgctttgttgcccaggctagtctgaaactcttgggctcaagtgatcctcctgccttggcctccaaaagtgctgggattacagttgtcagccattacaaccagccctgttttgttaaatgaaggtccccatgtgattttattagtatatattttgtgagacttttttccaggtaagtaaatccacaaagtagagaaaagcagagagatagtgccacggccctgtggccgtgagtggagtcagcccattctgtcctgatagctttgccaggaatacccgcccagaaagcagaaatggaaagctggcctgagaggaaggccagcagagatcagctcctgaacccttccatgttccagacaagggaagcggagtacagaaaggaagggaggacgtgatctttgcggaacaattagcttgagccacgctgtgtactagggactgccatagagaagatcaactctatagccaccctcttaggtaggtctggcaccatttcacagatgagaaaatcaaggctcaaggtcctctgggatctgtatcctttcctgatgtaccttctcttcctgaggtcttaggcctcccttggctccccgccccgccttttttttttttttttttaaagacagggtcttgctctgtctctcaggctggagtgcagtagcatgatctcagctcaccgcaacctctgcctcctgggttcaggcgattgtcgtgcctcaaccttccaagtagctggaattacaggcacgtcccatcacgcctggctaatttttgtatttttagtggagacgaggtttcaccatgtaggccaggctggtctcgaactcctgacctcaggtgatccgcccgcctcagtctccgaaagtgctgggattacaggcatgagccatcgctcccaactttggctccttgtactggcaaattatgctcgttttctgatggagtggagtccaccttccctggcaggttatgggatggaaagcatttccgaatagttttgggctctgagaaataagatttagaattattatttgttttcttccctgattggacccctttctcaacaaaaccaagataataataataaaaaagacatctttaaaatgatgtgagttctgttagattttgtagggaagacccctggctgctgctttccccgttggggacgttagtgatccaaatgggaaagggattattttagctgccagtgtttcggtttcagtcatgtttgtagtattgccactgaagtttttttttttcaattatgaaacattttaagcatagagaaaagccaaagttttgctttgtttttttaaactggctcgctttttggaaagctggaaggaggcccaggaggtgacggaaacggggcagagtggggcgccctggctctgcaggctcgacccttcacccagcccgctcttttggttggggtggggtggggggattggtgctggtgacaggctataccctggggaactgagaaatactgggacttggttcctgtcccaggtgagtggtctcagagccttttggaaaagatgaacaattctgacatcctttcccttttgaaaaggaatgaaagaaaatgagaagattctgtagtgcccccacccccaccccaccccatcctgaaagctgctgagcaactatttttatgttgcctctttttatcctggtggcttctgtaaatagttgagagatggcagttgcagagataaaaatgctaatcccaacctggaaaagagagggatggtggtcctcggaggaaaggggggtgggagtcagtggggaggccaaggtgttgcccctctgcccacgtggcttaggcatgaggcaggaacccagcgggtggggtaggagcattgtgggtggtgcctgagagaagcttctgttagagaagtttaaatggggaaccagtgttttgcgggggccagggtgcagaagggagagcacactccctttttcatttttgaaatgtgctttggggtattgccttcaaggcttctggcagagaaatattttattcggttcatcctggacagttctgccctctaggtccaggtgtggggacgttgggccccgcagagctgcagagctggctccctgcactcttcttgtccctcagctgaggaggcttgcagctagatttagcatgatgtccaaaaggtggggaggagggagggagaggggccgtgggtagcccaggcaccgatgcctgtgggtttcgagctggccctctccatctctgatttgccaagagcatgctgggtagaagtctttttcttgttcattacaaactgaaattccagttgttttccaacctcttcctttggttcagtgaaagattgagagggatgcagtgggggaagaggaaggaaggaagatggtttctacactttatttccaaatacctccctcctctaaacacatacccaaactcacccacacattcgtaagctcctcacacttcaaggctggggccacccatgcacacctggttttatttttatttatattttttaaatttaaaaattttcgagacagagcctttctctgttgcacaggctggaatgcaatggtgcaatcatagctcagtacagccccaacctcctggcctcaagggatcctctcacctcagcctctgacggagctgggaccacaggtgtgcagcaccacacttggctaatgtaaacatttttttgtgtggtgatggggtcttgctgtgttgcccaagctggtctcgaatcctggcctcaagcgatcttcctgcttcggcctcccaaagcactagcattataggcgtgagccaccactgtacctggcccacagctggctttagatgtctgactgcgtgactggggccattctttcagtgatatttcattactgactaagtaatagctgcctaagaattcttaagacagttggccctggcaagcagcaagacaggggaactgcttactctgtgagtatccagggcctcaagggtcactgggctgcagggcaggccacctggatctcctcctggcccaactgcgagcctgctgggctgcctggatgaggtcatctcaacttctctgagtctcggtgactccatctgcagcctctgttgcgctgattgcaaaagccatgtgagaatgtgctcttatgacacatggaagcaaggatgtgaaatgatatgcatacgctatttttaattttgtaaaatgtgatgcatatggacaagggctagaggggaagatgaagagttagcacggcaggattagagatttaagagatttcgttttaaaataaattgaaaccagctaggcacagtggctcatgcctataatcccagcactttgggaggctgaggcaggtggatcacttgagcccaggagtttgagaacagcctgggcaacatggcaaaaccccatctctaccaaaaatacaaaaaattagccaagtgtggtggtgtatgcctgtagtcccagatacttgggaggtaaggtgggaggatcacctgagcccaggagttcgaggctgcagtgaactatgattgcaccactgcattccagcctgggcaatagagtgagaccctgtccccaaccgccccgccccccaaaaaaaggaagccaactgagggtcgtgaattcagtaactgccaaagttctttcttggcaatagcttctatatagtgagcattcacacttgtgccctcctgaagcactcagaagctggatgattgtgagcaagtcagccaggctctctgtgcctcagtttccccactggtggaacagggataatagcaggacctatttagccaggcgtagtggtgcgcacctgtagttgcagctacttggggggctgaggtgggaggaatgcttgagcccgggagatcaaggctgcagtgagccaagattgtgccactgtactccagcctgggtgacagagtgagaccctgcctcaaccaaaccaaatcaaaccaaaccaaaccaaacaaaacagtatctataactcataaggtggttgtgacagttaaatgagatgatgcaggattagaagagtgccaagcactcaagaaggctaaccattagtatcactgcatctgcagcaatgcgattcttgtgttgaaaatgccagtttcttctcctctccctgttcatcagcccttccctgccccatccttgatgttttaagattaaaagaaagagaaaagcagtgttggaagtcaagttgcctgtcaaggtgaaggctgtccaggttgccagaggccttgtagctgcctggcagtttggcctggatgagagccctggggtgtagggagacagcagcttccctgtcagtcagctctgtcatttgtaagtcagggcccttgactgtaaatgatggaaaactaatcacgaaatagcttaagcaaaaatggaaatatgttggctcatgtagttaaaaattgaggtacatgagcttcaggcatggctgaatccaggtgcctaaacagtgtcttcaacctcagctcttttccatccattacctctcttctctcttcttagacttcattctgaggcagggttctctccagcccctggtagctttaggaatatatcctctgagctctaggttcaacagaaaggacattctttcttttcaacacttccacaaaatcacagaataagacccaatagactgacttgggtcacacatctactctcttttttgagacagggtctcgctctgtcacccaggctagagtgcggtggcatgatcacggctcactgctgcatcaacctccccagctcaagcgatcctcccacctcagcctccctagtagctgggactacaggtgtacgccaccatgcccagctaggttttttttgtatttttgtagcgatgaggtctcgccatgttgcccaggctggtctcaaactcctgggctcaagggatctgcccacctcagacttccacagtgctaggagcacaggcgtgagccaccatgcctggcccacacatctactctgtttcttttttagataaggtcctgctctgttgcccaggctggagtgcagtggtgcaatcttggctcactgcaacctccccctcccgggttcaagtgattctcgtgcctcagcctcctgagtagctgggataacaggcatgcgccaccatacctggctaatttctgtatttatagtagaggtggagtttcaccatgttggctaggctggtctcgaactcctggcctcaagtgatctgtccgccttggcctcccaaagtgctgggattacaggcgtgaaccactgcgcccggcctcatatctattcttgagttacccacttgaccagagcaattgatagccagctggccaggcttgagtcacatgcaaatctctgaagctgatggtggggtcagccctgtagggccacctctcatatggagggatggcttcccagacataaattgggctgctgttatcagactaaagaaacttcaactctaggccagctaaagaaagcttctgaccttctgagtggccttgggacagaagaaataaacaacaacttctagtcagtatttactgagtgcgagcagtgtcctagaaagttctaggcccgggaattcagctgtaaacaaggaggccaaagccacagctctcatgagttagtcatgtccatgtccctgtgcccaaatcctgtgcatttctcctccaagcactttgagaccctgtgctttcgctctcatctctctcaaacacaggtcgaggtcccagcaaggcagaggaatgggctgcctgcccaaatcccttgttagagattttggtccagcctggactttattcaggacgcaatatgtggacatggcagggctatgcctgtaattgttggccccttcctgaaaaactcagcccggccgggtgcggtgactcatgcctgtaatcccagcactttgggaggccaaggcaggtggatcacttgaagtcagaagttcgagaccagcctgggcaacatggtgaaaccctgtctccaccaaaaaacacaaaaattagctgggcatggtggcgtgcctgtaatccccagctacttgggaagctgaagcaggagaattgcttaaacctgggaggcagaggttgcgctgagccgagatcacaccactgcattctagcctgggcaacagagcgagactccatctcaaaaataagtaaataaataaaaataaaaataaacaagaacaacaaaactcagcccaattgtcgccctgcctagaaccactgcgtgactttgggcaaatcagtaaatccttctgaaccttcattttcctcattggtggaatgaaatggtcagagcaggtgaccactgatgtgcacctgtctttgcactgacattcagtgacttgaaagcaggggctgcagactcagacacctgtagcggagaggcagggcatgagatgtgggccgaggggagggcgtgggccgtggcaggcagcctgtcctcagctttggagaggcactgggaagtggtgaggactgtggcgtgctggtgagtgtgtcccctgcccagagctgcagcgagtggttgccaggatagaacacaggcccagtgctatcagtgtgcagttcttcaagaaaatctgtaaatttgcacttttatctgaaatctcctggctctgaaatgttggcatctcattcaaatggttatttatttatttatttatttatttagcgaaaggatctcattctgccacccaggctggagtgcagtggtgcaatcatagttcactgcagcctccaactcctgggctcaagccatcctcccgcctcagcctcctgagtagctgggactacaggtgtgagtaccatgcccaactaatttaaaaaattttttttgtagagatggggtctcactatgttgcccaggctgatcttgaattcagcatcaagtcatcctcccacctcggtctcccagagtgctgggattacggccatgagccaccacttcttcagatagctttgaacctggtgtaaggccagtatatcggtggccagatgtcacacaggagtcatcatttgcaacgtttttgttctagggactatgatgaggatggggtctctgaggcctgagatatctctattgccatctgacaagggagggcctttgtttttgcggactcagttgtttcagtggccccaaattaaagagcgctgaaggagagagccagttgtaacagttggtgtcactggatctgataaccctgcttagctgggctagggccctgggtctgaaatattccagcaccgcctccgtggatgcagccgagcctctcaggtctcccgctagagctttgggaaatgcctcagagtctgtggcctccaaggcagccggcttctccgaaccccactggttgggtggggtgctgtattatcttcctagagaagccgtgaccaagtctcacactgggcggcttaaagaacagagatattaggcagggcgtggtggctcatgcctgtaatctcagcactttgggaggctgaggcgggtggatcatctgaggtcagtagtttgagaccagcctgaccaacatggtgaaaccctgtctccactaaaaatacaaaaattagccgggcatggtggtgggtgcctgtaatcccaactactcaggaggctgaggcaggagaagcacttgaacttgggaggcggaggttgcagtaagccgaaattgcgccattgcactccagcccgggggacagagcaagactctgtcaaaaagaaaagaaaagaaaagaaaaaaaagaacagagatatattctgtcatttctggaggccagaagtctgggatcaagccttggcagggttcgtcccttctgaaggctccgaggggagtctgttccaggcctctcctggctgctggtggttgttgataatctctgatgctccttggcctctagaaggagcatcgtctccgcctccatctccgtgtggccttccccctccgtgctggctggctgtgtgtctacctttcccatttattggactaggcctgttggactggggcccaccctaatgacctcattttaacttcataatctctgtaaagacctgtctccaaataaggccacattctgaggtcctgagggttagaactgccacataacatttttgggggacacagttcaactcacagcagggtctgagcccagtccctgtagcattgccctgggctgccctctcgtcatcatcatccacttcccacaaagctgtagcccttccagcccctccttccccactttgttcctgctcccgggctccagacccaggaaacttgtttctgttgcctccactctcccgcctcttttccacagagggccttctcagaagctgtttcctctgctgggaacaagttcctgctcctttagtatctactcaccctgtaggtctcagcctaatagacgttcaccaagaggggccttctttcacccaccgcctcccttcaaatctaaagtggtcccctctggtattctctttgatcatatcctggtcttctgccccagtctgtgcttatagattcacttgggacctactttttctttttcaagatggactctcgctttgtcacccaggctagagtgcaatggcccaatcttggctcaccacaacctctgcctcccaggctcaagcgattctcctgcctcagcctcccaagtagctgagattacaggcgcccgccaccacacctggctatttttgtatttttagtagagacggggtttcaccatttggccaggctagtcttgaactcctgacctcaggtgatccacccgtctcggcctcccaaagtgctgggattccaggcatgagccaccgcacccggccttgtgcacctacttttaaatgttggtccccctcattggactgtcagtcccctcgagggcaaaaaccacatctgttttgtttatccagcacgtgatcattgctttataattactacatgtaagaacaaatgaatgaatgaatgaatgaacgcatttccttgaggacctctgtgggcctcagtttccccatgtgagacagggtgtggctgagcccattttcccaaggaggacattgatgtcccgggcaggacatcatccgtagccttggcaggatcctcggagctgttttgggcctttttgttgtgcccgggatgaggcaacctcaggggagcctgcacaggtgtgtccgggcttgggagcacctctttggcacccactggcagcttgctgcgcgggaggtagcggatgcaggttggaaacagcccctaggaaatgagaatgtgtttcctggaggcccgcgtctagcgggggacctgccccgataatcacataggttcttttctattttcctaagcgtcggctggcttgagaaataaagggacagagtacaaaagagagaaattttaaagctgggcgtccgggggagacatcacatgtcggtaggttccgtgatgccccacaagccacaaaaaccagcaagtttttattagggattttcaaaaggggagggagtgtgcgaataggtgtgggtgacagacatcaagtacttaacagggtaatagaatatcacaaggcaagtggaggcagggtgagatcacaggaccacaggacccaggtgaaattaaaattgctaatgaagtttcgggcaacattgtcattgataacatcttatcaggagacagggttttgagatcaaccggtctgaccaaaatttatcaggtgggaatttccccttcctaataagcctgggagcgctatgggagatgggagcgctatgggagactggagtctatctcacctctgcaatctcgaccataagagacaggtacgccccggggggtgccagttcagagacctacccctaggtacgcattctctttctcagggacgttccatgctgagaaaaagaattcagcgatatttctcccatttgcttttgaaagaagagaaatatggctctgttctgcccggctcaccggcgatcagagtttaaggttatctctcttattccctgaacgattgctgttatcctgttcttttttcaaggtgctcagatttcatattgcacaaacacacatgctgtacaatttgtgcagttaatgcaattatcacagggtcctgagacgatatacatcctcctcaactgacaggattaagagattaaataagacaggcataagaaatcacgagggtattgactggggaagtgataagtgtccatgaaatctttacaatttatgtttagagattgcagtaaagacaggcataagaaattacaaaagtattaatttggggaactaataaatgtccataaaatcttcacaatccatgttcttctgccatggctttagccggtccctccgtttggggtccctgactttggctggctgagcccattttcccaaggaggacattgatgtcccgggcaggacatcgtccgtggccttggcaggatcctcggagctgttttgggcctttttgttgtgcccaggatgaggcaacctcgggggagcctgcacaggtgtgtccgggctcgggagcacctctttggcacccactggcagcttgctgcgcgggaggtagcggatgcaggttggaaacagcccctaggaaatgagaaggtgtttcctggaggcctgcgccactcagcttcctggcagaggaaggagcgtttccctcatcctggcccgggtcccgggtccatctgctccaggaaggctctggtggctcgtgatgagctgccctgtgagagggaacagggtagaggcaaggccttgggggatggcctctgcctggatttcatggggaaggatgcagggccagggctgacattttgtcaaatccaagcaactttgcaaaaaagtcctcctctcacgctccgccctctggaatcgaatgcttcactgtccttccctggcagagggcctggtcctgtgagggttacatggccaggcggttatctccgtgctgggtgcctgatgagagctcagttgaatgttagccgttgctgtttccaggctaaactattgtctttttgcatgatttcttctgcacagagtgttggtagctttcatcagatctttgtagggtctgtgacccccaaaccgttcaggacactggcctagactctaggtgtctgtgaggccagaagcccctggatgcatctcttcctgtcagggcctgcgtccctggggctcctctctgctgagctctggggtttcacgcttgccctgccagcgccgacgtccctgcccggggtctgagctgtctctcctctccatcctccaacagaccgcagaggccgagactccgtcagagctgtgagggaggcccgggccagatgccagcttgccaaggaggccgattaaaagcagccttgctgggggcggatggctcagtgcccttggcctggtgtagagttcgataagcaattgttttcctgttggtgagaaaaaaacaaatctccattgactttcccaggcactgctcagcctcattttcttctcaggaactcttgcagccctatcagaggcagctctaggataggggagagactgactgcctgccctgggggacgcaggccacacagccagggctgagggacacacttaagagcaggccagctcgcttggacattggtcctcgtgggaacattccagagcataggctacctaccagagcaggccatgggcatctgtattagtccgttttcacgctgctgataaagacatacccgagactgggcaatttacaacagaaaggtttaactggacttatagttccacttggctggggaagccccataatcatggcggaagtcaaggaggagcaagtccggtcttacatggacggcagcaggcagcgagaatgaggaagatgcaaaagcggaaccccctgataaaaccatcagatctcgtgaggcttaccaccatgagaacagtatgggggaacccgcccccgtgattcaattatctcccactgggtccctcccacaacacacgggaattatgggagtacaattcaaggtgagatttgggagaggacacagagtcaaaccatagcatccaacaggtgtttgttgaagtaatagtttttgagtacttaaccacttgcagggcatgattctgagtgcttggttcatctaatcctatgactatcagatgggcaccaactttacaggatgtcaatgaccttaagctgttgaacttcagggtatcttgagtttcctcttctgggacataaggaccatgagaaggagaagtaaagtagcagcagctagggccatagagaaatatcaaacttgagttgtattctctcattgatggggaaactgagacagggacagagttgatgatttctttctgagatacagtaagggggaatgggggacagagaaataggagataagaccaactgctcccctctcctgacctcctgccccgtctgatcccgtagcatcctaggccttatcatcataactccgatcatggttacaggtattttctttcctttaaaacactttttatttatttatttattttagatggagtcttgctctgttacccaggctggagtgcagtggcgcaatctcgcctcactgcaacctgtgcctcccgggttcaagtgattctcctgcttcagcctcctgagtagctgggatgacaggtgcccaacaccacgcctggctaatttttgtatttttagtagagatggggtttcaccatattggccgggcttatctggaactcctaacctcaagtgatctgcctgccttggcctcccaaggtgttgggattacaggtgcgaaccactgcatctggcctgaatttgactattctagatacttcatgtaactgaaatcttacaacacttgtcctttagtatctggcttgcttcacttagcgtatgtcttcacggttcgtctgtgttgtagtgtgagtcagagtttccttcttttttgtggctgtatagtattctgttgtatggctctgccacattttgtttattcattcgtctgttgatggacacttggttataccttttggctattgtgaatgatgttgctatgaacattagtgtacaagtatccgtttgaatccctaccttcaattcttttgggtctatacctaggagaggaattgctggttatatggcaactctacgtttaactttttggggagccaccaggctgcctgattgtagtttgaatttgcagttctcttactgtgaggttgaacatcttgccgcatgattggactctttggcgttctcttaccacacactctgtgtgcatgagtcaggcccgtgtcagggctggggcgttgggttttcccttttgcctttcctgttgggctttccctgccacgtgcctggcgtagtagctatttcatcagttcttctggaaggaccgttccgagagcgctgagggccattttctgcctctcagccagatcctccagggagctctggctttccgctgtctgtaccttcctctcttttaccccactacctcccaatgtcatcggagataccattttattcattcataaaatctctgctgagccctcactgttttcctgggacatctagagagaccccccccccaccccgccctttttttttgagatggagtctccctctgttggcaggctggtgtgcagtggtgcaacctcagctcactgcaacctccgcctcccaggttcaagcaattctcctgcctcagcctctccagtagctaggattataggcatgagccactacacctggcttattgttgtatttttagtagagacggggtttcaccatgttggccaggatggtccagagagaccctttgtgatgtgggtgattagcatggagtggccatcatccacaggtgtctgtccacaaatgtactccctgaattccagtggtacctgtgacatttgtccagcagaatttgtcaaacacgttaagcaaaggttaatgttctgtcccagagacggtaagaattgacagcctaaggggatgtgttaatcttttttatttttattttttgagatgagtcttgttcagtcacccaggctgcagtgcagtggtgcgatctcggctcagtcattgcaaccttcacctcccggattcaagtgattctcctgcctcagcctcccgagtagctgggattacaggtgcccaccaccatgcccaggtaatttttgtatttttagtagagatggggtttcaccaggttggccaggctggtcttgaactcctgacctcaggtgatccacctgccttggcctcccaaagtgctgggaggattacaggtatgaaccactgtgtccgacttctctctctttttttttttttttgagatggagtctcactctgtcatccaggctgaagtgcagtggcgtgatctcggctcattgcaacctccgcctcccgggttcaagtgattctcctgcctcagcctcctgagtagctgggactacaggtgtacatcaccacacttggctaatttttgtatttttagtagagatggggtttcaccatgttggtcaggctggccttgaactcctgacctcatgatccacccgccctgtcctcccaaagtgctgagattacaggcgtgagctgccgtgcctggccttttttaaaaaattgagatataagttcatgtaacataagttggccattttgaagtgtatagttcagtggcatttagtacgttcacaatgctgtgcaaccattacctctatctagtttcaaaacgttttgatcaccccaaaaggaaaacctgtgcccattaagcagccattccccacacccactaatgtcaccacccccatagtcctaggcaaccattagtctactttctgtctctgtggagttgcatattttaaaaatttcatataaatagaatcatatatatgtgaccttttgtgactggcttccttcagttagcataatattttagaggttcatccatattgtggcatatacttgattccccccgaccttttttttttttttttttttgagacagtcttggtctattgctgagttgctgaggctggagtgcagtggcatgatctcggctcactgcaacctccgcctcctggattccagcgattctcctgcctcagcctcctgagtagctgggattacaggcacacgccaccatgcccggctaatttttgtatttttagtagagatgaggtttcaccatgttggccaggctgatctggaattcctggcttcaagtaatctgcctgccttggcctcccaaaatgctaggattacaggtgtgagccaccgtgtccagccctgacctgcattgttaatgcccagcatttaaaaataaaaagtcaggcaaacttattaacctccttagggcttctcttgggaaaaacaaagggaagaccagcaatagtaggcccagattcctgccgagcaacaattggcttgagctggaagcagctgtcaattctgtaggggatatgtgtgctctatttgggggttttcttatacttgttcctataggaattgagttaggaattattgtcatggtatgtgagaagtggttccagctacttgggaggctgagatgggaggatcacttgagcctaggagttcaagggtacagtgagctatgatcgcaccactgtactccagcctgggcaacagagagagggagagaccttgtctcaaaaaaaaaaaaaagaaaaaaaaagaaaaaataataaaagaaaaaatataagaagatgcagactctgcttttctgtatagactcagagatcagatcacaccatgttttgcaagatttttttaggatgtcaactggaggcaggaattagacagcagcctgggccaggaggagaggggatcctttcctgtccctgcccgtaggagctgggccagctgaccctttctctttctgcaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggtgcgtgagccggtggtgagccaggtcctaggggtccctggtgcccttccctgcccccagcagggcctctgtggaaggttgggctcccccagaaggatctgagtgccacggttgacctaggagttgactccagggaaccttgggggcggctggggccaaaaaggggccctaggggggtcgtgaatcagcatggggaagggaaggcagtcagcaaagggtgggtcatggagccgattaccagtgtggagtgtgggccgctggggctttttccttccgtgggaccctggggaacagcacagagcagcagcctcagtcatcccaccaggggcaagggagctggggtatttatactcatgggtgagggctgctggggcaggtgtgtgtgaccccctgtgggtgtggacagagcagttgcagggccggagggagcctccagcaaagagactgaggtgtgggcgaaggtgtgatggaatgaggcgggtcactgagagcctggcgacgacccgcctggccgagcgtgtgttggcaccaggcactgggttcagcacttgctgtgcatttctcacaggacccttaccgtaaaccctgcggggatacagagaactcagatcctcaccagggttcacagggccctgtgtggtctgaccctttcccatccctcctgccattctgctgccagctccctaagctccctctgttcctgccttcacattcctcggaatccaagctcttgccttgggtctgtactctcgctgttccttctgcttggaaccacctcccccaccaccccatgccaactttgtaaggcctattccgataatgtccaagtctcaactccagtatcacctcctccaaaaggcttcccgggccaccatccctaaagcaccctccagcctctctctgccccatggccctatttgctttccttcataacgttaatcagcatctgattatctgtgcgttggtttagttgtttattgcctgtctccacccagccagaacgtaagctccataggatcatttcatccacctccacaccctatcccatccccagagcctagcacagtacctggtgcatagtaggagcgcaaaaatatttgttgaaggaacgaatgaatttaattggaagaagacccaacatcaggatgcctttctaaaggggcttttttttgttgttgttgttgagacagagggttgctgtgttgcccaggctggagtgcagttgcgtgattttggctcactgcaacctccacctcccaggttcaagctattctcctccctcagctcatgagtagctgggactacaggtgtgcaccaccatgcccagttaatttttttttttttttttttttttaagtagagatggggtaatgccatgttggccaggctggtctcgaactcctgacctcaggtgatccacctgcctcagcctcccaaagtgctgggattacaggcatgagccactgtgcactgccaaaggggctgattttgaaggggctatagggactacattttgaaggccaggaaaaactttcataattggagatgaaaattgggccctggagagttgagaggagggagaattcacagcatgagccaaaaacagagctaggacctatgagcaatggctcctttttagcttagcttctttcacagcatcatgattttgagatttatccatgttgtggcgtatatctgtagttcctttttattgctgaataatttcaattgtatggacgtaccacagtttgtttattcatttacctgttgaaggacatttggattgcttccaattttttattattacaactaaagctgttattaatatttatatgcaagtctttgtaaacacattttcacttctattgggtagagtggcctgtggtacggtagatgtttgttaagaaactgtcaaggcctggtacaatggcttatgcctgtaatcccagctacttgggagactgaggcgggaggatcacttaagaccaggagtttgagaccagcctgggcaacataggaagacccatctctacaaaaaacaaaataggctaggcccagtagctcacgcctgtaatcccagcattttgggaggccaaggcgggaggataacctgaggtcaggagttagagaccagcctggccaacatggagaaaccccatctctactaaaaatacaaagaatttagctgggcgtggtggtgggtgcctgtaatcccagctacttgggaggctgaggcaggagaattgcttgaatctgggaggcggaggttgcggtgagctgagattgtgccattgcactccagcctgggcaacaagagcaaaactccatctcaaaaagaaaaaaaagccaaagttttaattttggtgaagtccaatttatcatttgtttcttttgtctgtaccttttttgtattatctaagaaacccttgtctaccccaaggttgcacagacttgcttttcttgtatcactttatgtttttacaggacaatgtagccaaggattacttgtttgatttaaaatttactttttaaaagtaggaacaaccttctttaaaaaatgggttttacaagagtccacagtgtgtggttacattttgacaaagtacaacaagcaaaatcagcgttgttagaagtcaagagagtggccacctgggggagggcagaggtgcgagtggcttctgggagctggggatgttctctttcttgatttgggttctggttacctgtatgtgtttaatttggagaaatgtatctagttgcaaacttttttttttttttttttgagacacagttttactcttttgcccaggctggagtgcaatggtgcaatctccgctcaagcaacctccacctcctgggctcacgcgattctcgtgcctcagcctcctgagtagctgggattacaggtgcccaccaccacgcctggctaatttttatattattaatagagatgggatttcaccatgttggccaggctggtctggaactcctgaactcaagtgatcctcccaccttggtctcctgaagggcttgtaggtgtgagccaccgtgcctggcctctagttgcaaacttaaaattcattttgcacgtgtctctccttactctctaggactgtgtgcagctgaatcagtataccctgaaggatgaaattggaaaggtaaatatccctggggctaggctggctttctgcattcaccaggggcgttcagatactgtggagggaacggggtaaagctgggagcaggagaggagtctttgaaggcgaggttggtggagagggttttgtcattaatgatctaggtttttggtttagttttgttttcttgtatcttaaaattaaatatgtttctgcagaagctcagaaagcttccaacgaaattccatatcgccttggtgatagttacatccccaatacatttggggttttgtttcaccccgaggtactctgacatctagttttgcttttgttttagctaatggggggtatcatcaccatggtcaaaactccaaatgccagtagaaaacaagtaagtaatataaaggagtgaggcatgccagctgtaaggtagtagggagtggtaaggacagtggcaaaccattaacatatggaaatgagggctacatatagctagatctttccattttttcaaaataaactaggaatcttgatttttttttttttttttagacagggtgttgctctatcaccaaggctggagcgcagtggcgcaatctcggctcactgcaacctctgcctcctaggctcaagcgattctcctgcctcagcctcccaagtagttgggagtacaggtgtgcaccaccacacctggctaatttttgtaatttttgtagagacagggtttcactatgttgcccaggctgttctcaaacctgacctcaagtgatctgcccgcctcggcctcccaaagtgctgggattacaggtgtaagccaccttgcctggcaaggaatatagatttctatatcagacctttctgtttttttttgagactgaatttcactgtgtcgcccaggctggagtacagtgccgaaatcttggctcactgcagcctctgctttcgggtttaagtgattctcaagcctcagccccctgagtagctgggattacaggtgcctgctaccatgccccggctaatttttgtatttttagtagagacgcggtttcatcatgttggccaggctggtctcaaactccttaactcaagtgatccgcctgcctcggcctcccaaagtattgggattacaggtatgagccactgcgctccgcccagatctttctgtttttaaatcttggcaactaatccaaactttgtaaaaacctgggctccaacaaaatacagttgcgggacagatttgaccaatgggctgccggtttgcaacgtctgtattagggttctcattttgcagatcttaacttctggatagtatgtcatgggcatctccctttatccagggctcctatggtgtcgtcaagttggcctacaatgaaaatgacaatacctactatgtgagtatccgcattctcctccctgcccccatccttatccacagaagagcctcctttccagcactcagcttcctggaaagttttcctagctgttgtctcattttattcttaggtcatgtttattttgtgccttaggaaggaagtggtatgcccattttacagataggaaaatggggaggtgaggggattggcccagaaaaagttactcattcagcaaaaggcttttatgcccttcctctgagctgtcatctctgcatcctccatagtattgagaacaaggcagcagtgagacaggtgtctgtgtgggtggctttggagtcagtccagcgtagttttgaacctgaatctatcgtgtgccaaccatgtgaccttgacaagtgatatttctccatgtgtaaaacagctgagcctcagtttccccatgtgtaaaacagctgagcctcagtttccccatgtgtaaaacagctgagcctcagtttccccgtgtgtaaaacaaccagtcctgcccctcctttgcccattgctccagctcacttgtgttttgattcgatggcagcaagtcctgaggctcgtggtttcccagctgagagaggcgaccgtgagcctcaggaacacctcagagctggaggcaccccaggagtccagcctccctacaaccccatggctgcttgaccctctctggtaatgaggggctcactctgttgacctgagcctgccagggggccaggagcttgggccggctttggagtagaggaaccccgactgcgccctccttccccttttcctccctgctttaaacaggacctggctaaaggtgctgtccttcattttcctgcaggcaatgaaggtgctgtccaaaaagaagctgatccggcaggccggctttccacgtgagtttggcgggcctttgttgttaggtacaggggctgggacaagacagggcagagccccctgaatgggaaccattgcactgggcatggtgccacatgcctgtagttccagctacttgggaggctgaggcacaagaattgcttgaacctgggaggaggagtttgcagtgagccaagatcgcaccactgcactccagcctgggtgacagagcaagactctgtctcaaaaaataataaaataaaaatatttattaaagttatataggtatcaagtcaaaaaatccaatagaggaaaacactggcaattcctcaaaaagttaaacatggtgttaccgtatgactcagtaatttcactcctacttatatacccaagagaacaggacatccgtgttcacctaggagcttgtatgtgaatgttcatagcaggtttagccacaataactaaaaagtggaaacagcacacacggcttcagagaatgaatagagtatatatgcatccagtggaatattcatccattaaaagtaatatgaatagagtatatatatatatatatgcatccaatggaatattattcagccatgaaaagtaatgaagtaccaattcatgccccaacacagaggggtcttgaagacattatgctaagtgaaagaagcctaacacaaaagctcacatattatgtgattctgtttatgtgaaatacccagaataggccaatccataggaacaaaagtagatttgtgattgctgggggctctggggaacaggggaaatgaggggtgaatgctgatagatatcagatatgtatatagatatttagggaggcattgaaaatattctgcagttggccgggcacggtggctcacacctgtaatcccagcactctgggaggccgaggcgagtggatcacttgaggtcaggagttcaagaccagccaggcccaacatggtgaagccctatctttactaaaaatagaaaaactagctgagcgtagtggtgtgtgcctgtaatcccagctactcgggaggctgaggcaggagaattgcatgaaccaaggaggtggaggttgcagtgagccgagatcatgccactgcactccagcctgggtgacagagcaagactccatctcaaaaaaagaaaaaaaaatatgcaatagataatggtgatggttgcacaaccttgtcagcactaaaaaccattaaaatacacattttaaaatggtaaatttagcagggcacggtggctcatgcctataatcctagcactttgggaggccaaggtgggtggatcacgaggtcaggagtttgagatcattctggccaatatggtgaaaccctgcatctactaaaaaaatacaaaaattagccaggcatggtggcatgcatctgtaaatccctggctactcgagaggctgaggcaggagaatcgctggaacccaggaggcggaggttggagtgagctgagattgcgccactgcactccagcctggacgacagactgagactccatctctcaaaaaaaaaaaaaaaaaaaaaagataaattaaaaaaatttaaataccacgaggtatttgaattatatctaccaaaaaaaaaaaaaaaaaaaaaaaaaaaaaaaggccagagcacaggagggctcatcatggagaccagtttcttgctgacctctttccttctcctataggcagccttggcttttagcacttttagttgctggtagctcctgtgtgtggtcagatgataggctgcaggtgagagtatcagaggctgcttcaacataagctccctgccagcattgctgggcaaaatgtcagcttgggccaaaaagagaaattagataagaacaaacagccaggcatggtggctcatgcctgtaatcccagcactttgggaggccgaggcgggtggatcacgaggtcaggagttcaagatcagcctggtcaagatggtgaaaccctgtctctactaaatatacaaaaaagtagccaggcatggtgggtgcctgtaatcccagctactcgggaggctgaggcagagaattgcttgaacctgggaagcagaggttacactgagccgagatcgcgccactgcactccagcctaggcgacagagcgagactccatctcaaaaaaaaaaaaaaacccatcctaacagtaggaccctggtttatcctgcttatccaaacgctgcaccaggtcataatcctcacgtcactattatcaatttttgacatctgcttctggcttcttccagtgacaatagaggatttcgcttgcttaaacactccttcttacctcttgtcttaacaaaataacaaatggtgtcctgtaacaacgtacgagagactgggtggcttaacctaaccgatatttatttctcacacttctggaggctggttcatagttagcaccatctcaggccgggagcggtggctcacgccagcactttgggaggcagtggtgggcaaatcacttgagcccaggagtttgagaccagtgtgggcaatgtagtgagacccctgtctctaccaaaaatttaaaaattagctgggcatggtggtgtgcacctgtagtcctagctactcgggaggctgaggcgggaggatcccttgagcctgggagttcaaggctgcagtgattcttgattgcgccactgcactccagtctggtagacagaccctgtctcaaaacagacaaacaaacataggtagtgccttctgaccgcatccttacatggcagaggggctagacagctctttggggtcttttttttttttgagacggagtcacagagtctcactctgtcaccaggctggagtacagtggtgctatcttggttcactgcaaacttcacctcctgggttcaggcaattctcctgcctcaggctcccaagtagctggggctacaggcgtgcaccaccacacctggctaatttttgtatttttagtagagacggggtttggccaggatggtctcgatctcctgacctcatgatccacccacctcggcctcccaaagtgcttggattacaggcctgagccactgcgcccagcctgaggtctcttttataacagcactaatctcattcatgagagctgtatcctcgtgacctactcttctcccaaatgtcccatctcctaataccatcacgttggggattaggttttgacatatgaattttggaggagcacaaacatcctgaccgtagcacctccctttccccagcaggcagtggaacgctctcctgatggtcagctcctctgtggacacacactaccactttcccctctctccagctatatgacgcgtgtctcccacctccccacaccctcccttttcctttggactcagctttcctcctttcacatcctccctctgacacctgtacttctgcctttgcttttccaaggccgatcacatccctgttctattctgttagtcacactcagagccttacttacatgggatgtgtgccatcgtgagggttttcactgtgggtctgtacatccttgtgactgcctattgtttactgcaggatcaagcggtggcctgagtgcctctcctttctagatagccttttgtttttctctcccgatgcttgcttcttttcttctccctggcttcattttacatcagtgctatttagtttttgttttttttgttttttgttttgatagggtctcgctctgtcacccaggctgagtgcagtggcatgatcacttctcactgcaggcttgatcttcctgggcgcaggtgatcctcccaccccagcctcttgagtaactgggaccacaggcacgtgccaccatacctgactaattttttgtgattattattattattattattattattattattatttttgagactgagtcttgctgtgtcacccaggctcgagtgcagtggcgctatcttggctcactgcaagctccgcctcccaggttcacgccattctcctgcctcagcctccccagtagctgggactacaggcgcccaccaccacgcccggctaattttttgtatttttagtcgagacagtgtttcactgtgttagtcaggatggtctcaatctcctgaccttgtgatccacccgtctcggcctcccaaagtgctgggattacaggcatgaggcactgtgcccggccctaattttttgtgatttttatagagtcagggtttcgccgtgttgcccaggctggtcttgaactcctgggctcaagaaatccacccgcctcagccttccaaagtgctgggatcacaggcatgagccatagcgcccagccagccatctgtgctatgagttaaggagataagagttaatgtttatgtccattttatggactgcaaaaactgagcccagagaggggaagtgattgactcaccctgggtgttgagattgctgagctagactgcagttgcctcagcactcctgcctttcactgtggaccagggcatggactggggatgtgacgggaaggagggaattcacaggacggccgagggctccgccctcactcacttccagcagcagaggagacagaggagtagagggttagttaaagcccctggtggcagcagccactccagccctgcagagtggctttttggcatcccaccttttggcatcccacctgcagctgccctctgcggaggaaagtctctttgccctgaccctgggtctgtttttgtttccttcaggtcgccctccaccccgaggcacccggccagctcctggaggctgcatccagcccaggggccccattgagcaggtgtaccaggaaattgccatcctcaagaagctggaccaccccaatgtggtgaagctggtggaggtaaaagggtggaggcgcccaggagggagggaggccctggctttgttaatacccaaacaccccgccactggtttccagggagagccaggtcacaccagaccgctcactgcagggctgagttgtatttactgctccctaagagtatttgttactcacattaactattttttctcttctttcttttgcctgctttgtttttctgtcagatatttattactctcattttacggacaaaggaattgaggctcagagggatcccttcacccatttctgtctctttgaagctggttctctttctacttacacatatgggtagtcatagcgcaaaagcagccacacacatgatgtaaacaaatggcatggctgtgttctagtaaaactttatttacaaaaacaagtccgggtgcactggctcgcgcttataatgacagcactctgggaggccaaggtggacagatcacttgagatcaggagtttgagaccagcctggccaacatggtgaaaccctgtctttactaaaaatacaaaacaaacaaacaaacaaacaaaccagacagagggctgaatttggcccacatgctgtagtttgccagcccctgctctagatcagccgttctcatactttttggtctcaggatgcctttgtactcgattaaaaatacaaaaaaattagctgggcgtggtggcgggtgcctgtaatcccagccacttcaggaggctgaggcaggagaatcgcttgaactggggaggcagaggttgcagtgagctgagatcacgccattgcattccagcctgggcaacaagagtgaaactctgtctctaaaaaaaaaaactttttttgaagacccaaaagcactttcacttatatgagttatatttattaatatctaccacattataatttaaaactgagaaaatttaaactattaattatttaaaaacaataggctgggcacgatggctcacgcctataatcccagcactttgggaggctgaggtgggaggatcacctgaggacagcagtttgagaccagcctgagcaacatggtgaaaccttgtctctacaaaaaatttaaaaaattagcccggtatggtggtgcacgcctttggtcccagctattccgaaggccgaggtgggagaatcacttcagcccaggagttcgaggctacagtgagccatgattgtgccactgcactcgagcctgggagacagagtgagaccctgtttctaaaaaagaaaagaaaacaataagcttattgcgtattaacatgagtaatacatttttttttttttgagacggagtctcactctgttgcccaggctggagtgcagtggcacaatctcagctcactgcaacctctgcctgttgggttgaagtgattctcctgcgtcagcctcccaagtagctgggactccaggtgcccgctaccacgcctggctaattttttgtatttttaatggagatggggtttcaccgtgttagtcaggatggtcttgatctcctgaactcgtgatccagccgccttggcctcccaaagtgctgggattacaggagtgagccactgcacccggccgagtaatacatttttatgaaaaataaaaagtagaagagtggcttcatttttcatttttgcctttttttgggttactgtttggtttgataggagacatttggattctcatctctgcttttgcattcaatgttttgtgacatcacatatcatcaggtttctggaaaaccctgtagactagtggagaatgatagtcaaaaaggcaaatactgtcttcgttttaaagtgaaaatagtgaaccttgtaaactccatgaagcatcttggggatctgcagacatctccagattgtgtttggagcacctctggtctagacgacaaggacttgtcaccgtgctggatgttcagagtgccatgggagtacaaagcgggggcagccagctcactgggagaagctgggagaggcctcttagaggaagtgatgtttgagatggccgtggtggttcctggatgagaagtcacggaaaggcattgcagggcagggagctgcatgtggaaagggctggaagcctctgtttgggggagtacatggtgccttcgggagatgtgagggctagctaccactttgcctgggactcatctggtgcagaactctaggcggacaaggccctgggtgtgccttccccacagggcatggctcagggcttcaggctgctagcccaggctctgcctagggtgcctccctttcttggggcctgttgtcttattgatcttgggtgactggagaaagcggacgtgatgagggaagaatcagggggactagtctagccagggaggctgcatttgtttcttcccaaagaagagagatagcagttgcaggccatcaccaccggtcacactaagtgacacaatctcgactcactggtgctagagttggccattttccaggaagcccaagggcatttggttagcgaggggccctgggtcctggcagggtgtcttttctctccgctgccctatggcatttggccttttcacccaacaagactctttgccagcccatctgtttgttcattcatcagatattccctgggcaccttctgtatgccgtgccctgtacaggacgccaccgaggaaatcaaggtggatgtagcctgatgcctgccctttggagagagagaaagtgctgtggctgttctgggcagggagacatcatttcctgtggggttaggggcaatggggaggcttcgtggagtcacttgagcccagataggatttgaattttcaccctgaacaccgttgtctcctaggagctgggttggattcttttttttttttttttgagacagagtcttgctctgtcatccaggctgaagtgtaatggcgtgatcgtggctcactgcaacctctgcctcccaggttcaagcgattctcctgcctcagcctcctgagtaggtggattactcaggcatgcaccaccacaccggactaattttgtatttttagtagagatggggtttctccatgttggtcaggctggtattgaactcccgacctcaggtgatccgcccgcctcggcctcccaaagtgctgggatttcaggcatgagccactgcgcccagccggagataggctggattcttattcaagcatgagatatttccaggggagtattttggcccctcccttttgcgacctcctgagtgttcagatcctcgaggatcagacagagaggcatttattttccgaatagccattaggatctcacactctgggggttttccctatcttccatcttaactgggaaacacgctgccaaatgcagccctcctgttggcaaacgcagccacgtggatgctgcctcctccctgctcatatctattctctctttttctcccccgccatccgtctcctgcctattccatgtggctgtgccaaggtcctggatgaccccaatgaggaccatctgtacatgggtaaggaagcccttttcttctgccaccctcacccaggcaccacacctgccaatgcccaggggtcctctcgaggcagcctgtgccctggcaccttccaccaaagacagctttccctttcctggtccagctggccccaccggaggccacacccctggttgggatcagcaggtggaagggagttcttgctggaactttatctgatcctattcattcatttgcatgtatttattttttttgagtcagggtcttgctccgttgcccaggcttacagttcagtggtgtgaccacagctcactgcagccttgatctcccaggctcaagtgatcctcccacctcagcctcctgagtagctggattataggcatgggccaccatacccagctaatttttaaaatttttctagagacaaagtgtcactatgttgtccagcctggcctcaaatgcctgggcccaagagatcctcctgcattggcctcccaaagcatgtatatattgacaacctcctatatggtgggcactgttctaggtggtacacagaaaaaaggtagaaaaacaattttatatttaatttaacattgtataggaaaaactataaccagcaccccaaactcatagtttcatggatattatcatctaggacaaggctaaaaaattaaaaactgagtcaatttaaagaaaaacattcaataaataattgatgtggcatataggtatggccagattataaacatagtaggcaaataaatgaagtttggggagatacagcagaaatcacaatatgccaaaagtcattttagcccagaatggcattcttagcgtaattctctcacttgggaccccagatccaggtcagaatggctttgagctctttctgaggcgtgcctttgttcattcaacaaatgttacaatttgtcagaccctgctgtaggttcatcagggacaacattcaaaaacccctgtccttggggagcgcacctgagtgtgatgcgtgggttttgaaagcgacaacaccgtaacaaaacaaaaaccccgagcaggacacgaggggctgctagttttgggttgggggatggagaaatacagtggctccccagggaatgtctcaccaaggtgacatttgggcagaacagcagggaccaggtggcagaaggtattttacaacattgtaaagaacttggatcgggcacagtggctcacccctgtaatcccagcgctttgggagtccgagcgggtggatcacctgagctcaggagtttgagaccagcctgggcagcatagcgaaaccccgtctctactaaaaatacaaaaattagctgggcatgggggtgtgcacctataatcttggctactcgggaggctgaggcacgagaatcacttgaacctgagaggcggaggttgcagtgagccaagatggcgccactgcattccagcctgggcaacaaagtgagactgtctcaaaaaaaaaaaaaaaaaaaattggctttgactctgagagtgatggaagccattggggggtttgagctgacgggtggaatgagaataaagagaacatggtccaagcctcaaagaagagtttcgtgatctgcttgagctgggcagctgcagggatagtttttcacaactcgaggtggcagttgcagaaagccatgctaatttggggtatgtgattccagtggttttgaaaatcctgacacggttatattttactttccagccacagccgtgtgagactgagacagacagggcagtgcatgaggccgggtagtaggtatcagaaagggtctgcagctacaggcctgacatgcaaagggcagaaaactcagtccaggtgcggtggctcatgcctgtaaccccagcacttgggaggctgaggtgggaggattgcttgaggccaggagtttgaggctgcagtgagctatgattgtgccactgcactctagcctgggcgacagagtaagaccctgtctcaataaaacaaaaaaaggtggaggagggggctgggtgtggtggctcatgcctgtaatctcagcactttgggaggccaaggcaggtggatcccctgaggtcaggagttcgagaccaacctaaccaacatggtgaaaccatgtttctgctaaaaatacaaaattagccagatgtggtggcacatgcctgtaatctcagctacttgggagggtgaagcaggagaatcacttcaacctgggaagcggaggttgcagtgaaccgagatcgtgccattgcactccagtctgggtgacagagctagactttgtctcaaaaaaaaaaaaaaaaaaaagtagaaaactcgatctctatttctagaggttaaaaaattcccacccactgctcagccccaaaagtggttgaactgttagcgactgaaaatagacctgtttcaacaggccaccctccctcatgccacctgatttatggtgcttgggtgggtgggaggatggtgcagaaattcatgaagcttgcaagtgaagacttaaataaccaaggcaggaaaggccagagctgagggggccagcgctgggttgtctgtagaagctgtaccttagcagcattgcctttgtttttaactacagcctgaagcaatagcaaatctgccctaactcacactggttgatgaaactgaagatggggaaggcctgggagagttcagttcttttcctgatcagaacctttaagccttctttttgtctgagtagcttccctgttccccttggccacctcagcccttggagagctttgaaacaaccctttggtttcatttttaaaaaatttttttgcctgtaaccccagcactttgggaggccgaggtgggtggatcacctgatgtcagaagttcgagaccagcctgaccaatacggtgaaaccccatctttactaaaaatacaaaaaattagccgggtgtggtggcaggtgcctgtagtcccagctactcgggaggctgaggcagaagaatcgcttgaacccaggaggcagaggttgcagtgagccaagatcgtgccactgcactccagcctgggcaacagagcaagactccatttcaaaaaaaaaaaaaaagtttttttaatttttgtgggtacatggtaggtggatatagtcataggttacatgagatgttttaataccggcatgcagtgcataataatcccatcatggaaaatggggtatcccctctggtttctattacatgctcatctcattgtgggtgtatgattccagaacaacaagcaaccccagagtcatcctccactggattttgaaatcgactgtgctctttttttttttaacttcctaaagtacagccttgtattccaatttatgcttgtcatagcagaatcaaattaaataactataccacgtgacccagaaattccactcctaggtatatacccaaaagaaccaaaaacagatatccacacatgaacatatccatgtacacgaacgttcattgcagcacttcccaacagccaaagagtagaaacagtccatatgcccctcaacagatgaatggacaaagaaaatgtggtctatccatacaatggaatattattcagccattaaagggaatgaagcactgatccatgcaccagtgtggatgaaccttaaaaacgtgctaatgatgctaagtgaaagaagccagacacaaaaggccacatagtgtacaattccatttatatgaaatgtccagaacaggcaaatctatagagacaggaaacagattggtggtggccaggggattgagggagggaagaatagggagtgactgctaatgggtatgaggttttcttttgaggtgatgagaatgttctggaactagatagttgtgatgattgcccaaaattgtgaatatactaaatgccactcaattgcacgctttaaaatgggtaattttatgttacgtaaatttcatctcaaagaaattttttttttgggacattcttgctctgttgcccaggctagagtgcaggggtgcaatcttggctcactgcaacctccgctgtccaggttcaagtgattcttgtgcctcagcctcccaagtagctgggattacaggcacctgccaccacgcccggctgatttttgtatttttagtagagatagggttttgccacgttggccaggctggtctcgagctcttgacctcaggtgattcgcccacctcggcctcccagagtgttgggattacactggcgtgagccaccgtgcccagccccctgccgtgttttctttgaccagtggatcctgggccaatttgagcactagaagtcaagccagactgtgggcctggggacgtcagaaatccctggttctttgccttctgatggaaatttagcaaagcaggaccttggccagcttggttcagtggactgttcctctccccagctctaatactagtttctgtctttcttggtgtttctggaggtggttgggaggtggggaggacagagagagatggatgttcagtttcccatgtaacagtttcacccttttcttccctacagtgttcgaactggtcaaccaagggtgagtgtcccagctcccagcaggggtgatgcaagaagcttctgtagctgcatagctgagtgaggtgccactgggctctgctcatgagagagggcaagggctggcgggtctgctttgtgtttcacatgagtgtcgacctttcaggcccgtgatggaagtgcccaccctcaaaccactctctgaagaccaggcccgtttctacttccaggatctgatcaaaggcatcgagtactgtgagcagggcctgcgggagggctctcacccagtgggtagttagcattctgagcgtgggtgcaaagtggaaagtgtcttattttcttcctggagcacagggaggtgggcgggtggattggggtcctctagagggacagaactaataggagatacatatatatatataaaattatatatataaaattatatatataattatatatataaaattatatataattatatatatataaaattatatataaaattatatatataattatatatataattatatatatataaaattatatatataattatatatatataaaattatatatatataaaattatatatataattatatatataaaggggagtttattaagtattaacttacacgatcacaaggtcccacaatatagtctgtctgcaagcttgaggagcaaggagagcccatctaactctcaaaactaaagaacgtggagtctgacgtttgagggcaggaagcatccagataggaaaaaaacataggctgggaggctaggccagtctcacctttcacgtttttctgcctgctttatattcgctggcagctgattagattgtgggtctgccttccccagcccactgactcaaatgttaatctcctttggcaacacccacacagacacatccaggattaatactttgtatccttcagtccaatcaagttgacactcagtatcaaccatcatagtgggaaacagaattgtgtgaaatgcagaatcagggccagctgcagagagccaccctatggccatggtccaggcgagccaaaacccttcttcctgccacttggcaaaatgaagagcagtagcaatagtgactatttagcactttctatgtgcaccaggcactgtttggggctctattttttttgtctcttattcctcccagtgaccctgggatcagggtcctgttcacctcctggaaccttagcttcctcatctgtaaaatggggataacatatctctcaccagggctgagatcagccagtacacatcagtggtttgattggcaggtgtcctttctgcttctgcttgttaaacatcttagctctttttttcctttgagattcttgccctgttgcctgggctggagtgcagtggcgcgatctcaggtcactgcaacctctgcctcctgggttcaagcaattctcatgcctcagcctcccaagtagctgggactacaggtgtacgccaccatgcccggctaatttttgtattttttgtagagatggggtttcgctatgttggccaggctggtcttgaactcctgacctcaggtgatccccctgccttgcctcccaaagtgctgggatgacaggcgtgagccaccgtgcccggccaccacgttatctcttatccctgcctgtcacataggatggttgtgaggtttaattaaatgtaaaatgtgaatgtgaaacacaacgcagggccgggcccctcacttggtgctctgctgctgctttcactgaaatcgtcttcatcatcatcatcaccccagaaatggcagttgggtcttccaggccatagaactgtcctgtaccatgggctgatatccagccaggaggagttagccaagccccgagttctgtgtgtggttcacatttcaaatcggcctgctcaggtcattgtcggtttggtaaatcagttgagtattggctgttggtaaatgaaactatgtttcactgtcagtttcacaactagctgtgagccaagcccagcaaaaactttccatgcactgtcacttgtgacttaataaataacaggcgattacgaattgctattggcagtgttttatgtgtcattgttgagaaggggtggggtgatggtgggctgggacttccttgaagacacttttcccctcatcttttagagcatgtcagtgcccagcgggtttggggagtggaaggttggaaaaggcctggggctgtgggagacaaggcatcagaggggtgccatgcctgtgtctccaggccatgtggccgcatagaggtgctcacgaggttttcctgcccctatctcccacctgctgtctacgcctccccagtacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggtaagcttgggcctgcctcagccacagagttctgcctgtgttagtgtcttctggattgtaagcagcagaaacccaacgcacacaggcttaaacagtgaatcccctggatcaagatactgaggggtaggcttcaggcttggctagatccagggactcaaacagaaaccatctcccgccatctttcagttgtttttcttatttggtttcctccacaggtgggtcaggcacccagggaccaggttactttctatcatttgccaacctcagtggcaagagcattcctcattctgaatagtgcctgtgaaaaccctggggttggctctgattggcccaacatgggtcatgtgcccatgcttgaaccaatcactgtggctgggggtagtggtgctctcattggcctggcctggatcctgtgcctgccccagagcctaggagacaagattggtcccgccccaactccaagggctgaaagtcaagaggtggttccccaaaggaaaactggaggattggaggctggaccaccccttatgccctcacactaagctctttttcttgcaggccttggatgtttgggccatgggtgtgacactatactgctttgtctttggccaggtaagagggcggggtgtctgtcccctcagtactgctgggtggcccctgggttaatagtcacccttgcggggagacagtacttacttatttaagagttattttaggctgggcatggtggctcacgcctgtaaacccagcactttgggaggctgaggcagaggttaggagttggagaccagcttggccaacatggtgaaaccccgtctttactaaaaatacaaaaaattagccaggcgtgatggcgcatgcctatagtcccagctactctggaggctgaagcaggagaatcgcctgaacccaggaggcggagcttgcagtgagctgagattgcaccattgtattccagcctgggcaacaagagcgagactccgtctcaaaaaataaaataagagaagagttattttatttctacacctagatctcaatgtgaaaaaggatgccttcctaaatatacatgtgtatgtatgtcatgatcatatctatgaaaaaatgatctgttaaaacagaaggattggcagaggctctagagtttataaatagttgataaatttagggcaaggacagcagttctgccacctctcccatttctgagcccaaggcagacatcactaatcaataactgtgctcgttcctcctgagcctgatactgctctgatgttctttccgtcagggtattcctagaagcttttgtcagaggggtagcattggaatggaagttaaaagctgtttaccattattgatttagggagtgctgtttgggcttttctgttgttgttattttgttattattgatatctgggggcttctctctctattttttttttttttttttttgagatggagtcttgctctgtcacccaggctggagtgtagtggtgcgatctcggctcactgcaacctccgcctcccgggttcaagccattctcctgcctcagcctcctgagtagctgggactacagatgccagccaccacacccggctaatttttgtatttttgtagagatagtgttttgccatgttggccagactggtttcaaactcctgacctcaaatgatctgccagcctgggcctcccagagtgctgggatttgggattacaggtgtgagccaccacgcctggccttctcgttttaactctgaagttcagtttgattatgtgagcaataaaaacgtagatttttccctttcctgagcttgtgttcttattgaggaaagcctaagaaactggtcccatgaagaagtaaaggagtttataccgattgcctctcaatatttgattagaaaatttttcaatcatgtagcaaagctggaagaagtgtccagtgaacacccacatacccaccacctggattctactatattaaccttttcctgtgcttgtctgttcattccttacccatccctcagtccatctggtttcttaatgtatttcagagtaagttaccaccatctccactcttccttccaaatgccttagaaggcagtgattaggtagagctcaagtcactgctcttaatgaaatcgttttccttagacgggtggttcaggtacctctctgccaccttctccaacattttcagtgtcccgtgtaaggattccttttccagcacacatgaccaagctgctcttgagtcaggccctcagctgggtgaaagcatcgatttgtcacccagaaggtggtgcaaaaataggcttcagagtcagctgaatctaggcttaaatccctcttcgtacttcctgggacacattatttctctgaacttctgtttttctcttctgtaaaatgagaatactacttattatttctgatgacttctgagaggattgacagaaataattcaagtatccattaattcagcagatatttattgagcccttactttgtgcaggaacgctcctaggcacggagagtccgcagtgagcaagacagccagaaatccctgccttcttggagctaacgttcccgtgggaggggttaaacaataaacaaatctgtacgataacgtcagggataagtgctacgatgaggagtgatgtgggcggtggcggcattgggggttgtctgttttagacagggcttcaggaagtcctccctgagaaggtgagctttagtcagacacctgcatggtgggagagaccaagccacgtagatgttggtgagaagaacattccagggacggggaacagtgaatgaaaacctcagggcagggcgtggcgcgatccaggctaagcccttgaaaatcactgctgctgccacaaataacacaaagtcttttgtgttattcttgttgttcctgttgttcacctggcaagtaggtgacgagcagtgtttgctttggtgtaagtaggtaaactgaggcccagctacagagggagcctgcagtgtgcttgggaaaggctctagcccttcgagagggccattcctggctctgccctgcgtcggccaggccccacacccctgtgtcttggccattctcggggagaatgggaactgcttgccccctagcctgggccgcaattgttgatttctctgctgtatcctatgtggagtggcacagcacaggtggccctcgaagggcagatgtggccgccattgactgccactctgtccctggcctctttgcagtgcccattcatggacgagcggatcatgtgtttacacagtaagatcaagagtcaggccctggaatttccagaccagtgagtatctcccgccgtcccgcatctctcctgtccgagttcttggcggtcccgtgtctgccaccctgacgcctctccatccccaggcccgacatagctgaggacttgaaggacctgatcacccgtatgctggacaagaaccccgagtcgaggatcgtggtgccggaaatcaaggtacccttggctcagcctgtgccccgtgctcggaattgtttggctcagccatgcctcagccagaccccacacccttgtgtccacagcaccacaccctccttggcaccgctgttctcctatgccccagggcctctgagctgctgggggctgttgagggctgggtaggaagatttgggcattgtgtgcactgtgactgtgggagtgggatctatgacccgccagcctgcacttgctctgattggcgtgggctgatgggatccaccctctgcagaccggcatggggcctccgtgctccacaccctattcccagagctcaggtcctttccaaaggcccgtccctttgagaaactgcagtgaggatgggaggaaattaatgagcaattcgacctccccagcctgctgaatcccaccctcttgcagaaagcacttttaggaaagtgtattcccctacacatctccactaatgccacacacatatatctggccctctaggaaatctagagatttgccctgggacttcctaggcagctagctaactggcatttgaaggtcttaacagaaggcagcccaaaaaatcatggattggggcttggacccaagggggcagacccctgcctgggtcctctcctgatcctgtcctgccagctggtcccaccatgcctccaagcctctcctgctgtgagatggggagaatgctgcctgctgtgcactgagcctcccaggtgtcagggattgtggctgaggagtgatggatgctccttgggcagccaggcaaggcagatgccaaattcccatcacttcggccaagacccggggccggatggagaatcgccccacttccatttcagccttgtagctcctcccgtcctgtctctccgtcttcatgtttccgcccctttgctcacccctgccctctgctcgccagctgttttgcatgcctgaccacaggcccttgcctctccgtcctgcatgcccttgtggctccgctcgctggcagggccccccggtagccagccacacctgcccctcacccctcctgtcgttcgttgaagctgcacccctgggtcacgaggcatggggcggagccgttgccgtcggaggatgagaactgcacgctggtcgaagtgactgaagaggaggtcgagaactcagtcaaacacattcccagcttggcaaccgtggtaaggtggatggacccctgacccagagcagggacccaggagcctgaggtggggcctggccaggacaggccggacacaggcgggtgcccgggagtcagatgtccgggggccacccctaatccacagctgctggcctctgggccttggtcatgtatcaggccaggtgacccctgcatcttctgagccaggttccatgttaccataggaaggggaagattatccttctggaattcctgctttcagagctcatcaggggagaggaactaggagaagttccaggcaggggcaagggttgggagccggagcccaggtctctaagccaggattcccgcctagctggaattttaggctccagggtggatggcgtagcatatctcacgtctgctgtgtgggcagccaccaggggtaggggcagggacttccacgcacacactcagaaagttctgcccatctcctgagagtgagaattgcttaggagcaagtaggtccccttttatggccttgaatttggatcctgacccaggaagaaggagccagaatgtagagtcctcaggcctaaccttggaggctctgggaatcgccactgaccaagtccctgtccaggagggcagttagctccaagagagagaccaagagtcccagggatccaggttccaggcagcaggcttggggacagagaccagcaggttgtcccaccacagccacctcgaaaggcctggttgcagttggccagcactagtcccagtgggccggcgggcccctgggctctgggagggacccttgagactggctggaaaggcacagaaggtccagctgtgaaggattgcccctgtaggagcccagatgctgctcctgctcctccagctttgcacctctcttctctgcttccccacacacttcctctctcctcctcccaaagctgagccctggctggggcatccatccacatcttcctccactctttccccacctggggctgtgcaggaccttcactgttgaagacccacccacacccactcacccttcctcaaccaccccttgtgcctgtagacgaggagacagctggcgtcggactctgcacccaccgtgggttactgtgttccaggctcaggaggttctcagtcctgaatcagttgccctccctttccttcctgggtctctgggacgggttcttgggagaaagcgtctggccctggaggtctggagtaggcattcattatacgggaaacacttgttgaacaccgagtggtttctcaggcctgtgctgggagcaggggctgggtggagtgatgaacaaaacccccatggcctctgccatgcttgagaggcagatgctggtcaaaccaacaaatgtatgtacagtgcagtagagggaccacaggacatgcccctaatggaggcacacttggacccactgggaagaagtggatagacaccgagaggatggtagggtgttaactccgccgagagagggcggacgggctaacacactgggtggggccactgaagcagggcaaggaaggtggagggagggtgtggcgaggttttacatgtttactccaagagcatgggtttgaatcagggtttgaaccagggcagctggagcagggatgggcgggtagatactgggaagtggtctgacttgggacaagatggcaaggtccaggccccctgcatgtgttcatcatttagcaaacacggagcagccagtgtgtgccaggcataggtgtcaaagatgagcttagcccagtgcctgctctcaggggtagggggctggggggctgggggaggggctcctggccttataagaaagatggacctgggaagaatcagcctcctgtgtgatcagaggccagtgcagagagatgcaagggctgggggcttcacagaggaggagctcctgctctgggttgacaaggccacaggggaggcggcagggtgggctcacctggggagtgacatctgctcagacacagaggaaagaggggctggcatgtcccagtgactgtaagaacctcagtaggggaagaggccttcattctctctctcttttttttttgagatggagttttgctctcgttgcccaggctggagtgcagtggtgtggtcttggctcactgcaacctccgcctcccaggttcaagcaattcttctgcctcagcctcccatgtagctgggatgacaggtgcctaccaccatgcccagctaatttttgtatttttagtggagacgcggtttctccatgctggccaggctggtctcaaactcctgacctcaggtgatccacctgcctcagcctcccaaagtgctggtattacaagcatgagccaccacgcccgcctccccccccccgctccttcttttaaattgaggtagaattcacataacataaaattaaagtgaacaattcagtgacatttgggacattcacagtgacatgcaattatctcctcaatagttctgaacattttcattacttcacacccccgcccatcagcaatgactctccattcacctccccccagccctggcacccactcacctgccctctgtgtctatagatttgtgtattctggtggaatcctacactctgaggcctttcgggcctggctactttgacgtaggagaaggttttcagggtccgtttgtgttgtagcatggatcagtgcttcactccttatggctgaatcatgttccattgcacagacagaccgctttgagtttatcttcttcagttgatgggcatttgggtgtttgcatcttttggtaaatcagtgtttcttaaacacttatttttcttgttagcagcaaatgcttaaaaagtcagaagctctgtgaattcccaaaacagcttgaaggggcaccgtgccctggttggggtggggtgaggggcccagtgactcttatggggccctcaggccattcccttcatgggaaatggcagccaagagcatcaccaagaatgactggttcacgtccttgctccagaactttccggggctctctggctgaccacaggccaagttccagacccctctgggtggggatgctgagtcagggagtgaggggaccagatctgggttttggaagggatgggagggagggaggtggaaagcagggaggcctgggagagacgctgagcagtggctgagggtgtggtgcaggacagcaccttttcccagaggattctttcggcgggggttggttgcggggtggtgctgcccagtttctctcaaagtctgccatcggtcaccagccctgggagctggcaggggctggggagaaggaagagggaggatgttgcccagaatcgcccccacatggccaagcagttgcctgccacctcctcttttctccctcttcagatcctggtgaagaccatgatacgtaaacgctcctttgggaacccattcgagggcagccggcgggaggaacgctcactgtcagcgcctggaaacttgctcacgtgagtggccgcctgccttcttgggtgggggagtggtggctggaggctaggcttggggcagccctgcccagaccactctgcacaggtcctccctgaagtggtgccatctggagagactcagatgaaacccacctggtgcactgggacagtcagcaccccaacctgggctcagcccacctccttttgctgacagctaatccacctgaagtttacctttctcgggaacttgcactgtagctggggggctcttggtcagtcagaagaaaagcacttttgtggcccgggaccgtgagtgcctgatggggaggtttgaggctctgtgctgggcgagcagtgtggtctcactcaggaccctgtgtgtccatgcagagaggtgtccactcatctgctgtcaacgccaccctggctccagctctatgaagctggtgtttggggtctgagtgtctcagggtgggggaacgggcatcccgtggatcccaagggtcccttctcacttcccttttccctccctctggtgattccagcaaaaaaccaaccagggaatgtgagtccctgtctgagctcaaggtaacgcccgcctgcctgtgccgtagcctctgctggggcctgaggggggcgggtgggcagctgcagagcacgggggcatccccacccgggcagatgctccttccagcctgggctgctgtggcccggctcaccgcgggcctccagacccagtattagaatgaggggcctcgggggcttggacccaatggtgggtcatgcatgtgggctggggctgcgggtgcatggcgctccagctggaatgcctgagaatgcacccaggtctgaagatcctgtgtggcacccatgtcttctcagtgcacgtcaatggtgttgaagctctgtcacagggcccatgggtgcccccccgagtccgcatggtcagcacataggtcaggcatgctgcactgtgtggctcttcgctaggggctctccagcctccacttctctttctttgatgtgtttagacctagaaaataagtccccttcctgcctgttgcaaagtaacgtaagagttccctcacccgagtggatgcagaccttcttgctgtcagccacccttccttcatacacatagccagcccaggtgaccagaacctcccaggacagatgaggctttgtgtccttatgagactgggagaacctgctgggcacccctgctgcaggtgctgtggtgggtggggaccccactgcccttcccactgagcacatcatggctacctgacttggtgggagctccaggcagtcacttctgtttcttaaacatagctttactgaggtacaattcacataccatgtaattcacccacgggaagtgtatgattcagtggtttctaatacagacttctgcagccattaccaccgtcaactttacgacattttcatcagcccaagaagacaccctacactccttagctgtccccatccaactcccccaccccagtaaccactcagaataggtatggatttgcctattctggacgtttcgtataaatggcgtcatacactacgtggccttctgtgtctggcttctttctctcagcatcatgttttcaaggttcatccatgctctacatgtattagtgcttcattccttttcatggccaaataagattccattgtttggatgcacctcactttgttcatccattcctctgtggatggacttgtctccaccttttggctatcgaatgaagactgatgctatgaacatttgtgtacaaagtgttaggagttggcttacgagatgaaatggattgactagcaggctggatgcagtggctcacgcctgtaatcccagcactttgggaggccgaggcaggtggatcatgaggtcaggagtttgagaccagcctggccaatatggtgaaaccccgtctctactaaaaatacaaatattagccgggcatggtggcgcacacttgtagtcccagctactcgggaggtgaggcaggagaatcacttgaacccaggaggtggaggttgcggtgagctgagatcacgtcattgcactccagcctgggcaacaagagcaaaaatctgtctcaaaaaaaaaggctgggcgcggtggctcacgcctgtaatcccagcgctttgggaggccaaggcaggcgaatgacgaggtcaggagatcgagaccatcctggctaacacagtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccacagcactccagcctgggcgacagagcgagactccgtctcaaaaaaaaaagaaaagaaaaagaaatggattggccacccatcccgtgggagtcagggcttatatggtaatctaggaggaacacctgtttgggaattatttatgcttttgagagaaaccttgccctccagcatagagcagggaaaatggcagtccttcagaaccggtcttcagcagtctcagaaggcagacacagtccccagcttgtgcccagacagacgcctgggcagccccgccttgggtgtgagcctcacggatgatggagtggaaacccagcgggctggcctttcctcggccttcctcctctcaatctccattttagggtttgccaaaccggggctgcctcctgtctctgagcaagtctgctgttggtttctttcctattttctttctttctttctttctttcttttttttttttgagacagggtcttgcactgttgcccaggttggagtgttggagtgtagtggtgtgatctcggctcactgcaacctctgcctcctaggctcaagcgattctcctgcctcagcttcctgagtagctgggtttacagacatgtgccaccatgcccagctaatttttgtatttttttagtagagatgggggtttcaccatgttggccaggctggtcttgaactcctgacctcgggtgatctgcctgcctcagcctcccaaagtactgggattacaggcatgagccactgtgcccggccttcgtttcaatgagatcaaaattgcaagacaccagcagatggagactggccccaaagggctatgctgccccttcctttcttcacctgggatcccctgccctcagcccccagcaggtaggatgccttggtcatgggagctcacagagctgattcaggcactgggggtcttggactgggggcctgcctgccgtctgcagtaagacccaacccctaccaacaggcaactgcgagggcagagactgagggcctgacctaacgtctagttacagcgcccccctccccagggaccttacccacattctccatcagaaacatagcaagccagacatcacgcttcctttcccttgtgtaaggacagtctccctcctggacaggagacacggattgttgtgggggaaggacagacagtaacccatgtggcatgcccagtgacctccctaagaacaggggagctgtgtgatggtggtgaggggataggctcggggattcccctcgcacctgtcacgccatccacgctgtcacaccggcggctccagcctgggctcttcagggaaacaagggctctcctcctcccacttccaagagggaaggggcctcctcttctgtctgaggtgctcctccctcagggctggctgcaggagggctgaggcgggaggatccctggagcagttgtcatctgccctttcttgagggccagctgtgtgccaggccaggcaggggaggctctgatcacccccacacacaaggaactcaacatctggtgactgaggacaagcgtcacagtcccttccctgtaagggctcatagcctaagtgggggatcgaagtacctaaaaacctggtatgacaggcgccgtggggtggggggtgccttctacttgggatttgtgcagtgaattttggtgttacatagttttggaactgttgtacgggtccttgctatttttggcaaatgatgctggtctttcatttacagaggggctgcgtgcaaagtctcctttgaaaaatttatgtgagcaaggaaaaggggagaggatctcaaagactgggttacgtagatcacgttccagggggtgcgcgacggcccacttgggcagggggcccagatgtgggagcagctggctcagggcctcgctggcatttctcagagtcttaatgttggttttctgttcggtgagcaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggtgcc

SEQ ID NO: 37448 - DNA, 34889 bp, Homo sapiens
cagagagggagcgcgccttggctcgctggccttggcggcggctcctcaggagagctggggcgcccacgagaggatccctcacccggtgagtggttggccatccttgccgcaaaggatgtgcaaaaggaagacggcatccgcttctgggatgggctctgtcctcctggacatgccgagagcctgcctgatcctgggtcctgctgctggaggcggccacttcgcctggtccccgagcgtccgcaacaaaatttgtcagaaagaaaatcttgaggcacatttccctggggggaagtcagggctcctctctggagggtccagtccttaagggtgggctgggtggtagggacttcagttcagaggagcgggaggaatcagatggaactcctcttggattcgggtatacggcagtcactggggggcgaaccccggatttcctgtattagaagccgcctctagaatcgcgttaatagtgggagatatggcggcgatgccttctgcgtgccccatgaattagggggggaagcacccgaatagaagggtctcccgggcatatttgcctcgccagctgttggccaggtttttggtggatcgtgggcgggaggagtggaggttcctcttcgcgaggttttccgaatccaaatacacaggtttagtgcagtgtggaccccaggcaaaatgtggagtaaaatttctacccgatatcatctggttctgccctgatcagccactttcacagtggagagagatggcgcccaagtgcaaacctgccagtagccccctaggatcagtccttgccgaaggggggtcgtgggattgggggcactgggagaatagatgcagggggtgggttggggaggagagaaggccgtgtccttgggtctgggaagagggaggagagaaatgcagaaaagggggtgtgttgctggggtctggacgctgggagctggggatggggtgccgcgggggtcttcagagcgttgcgtggtggtcgctcgaaaatcctgacatgttgcagtcttggacttttggtcaaatcgccttttgccatttcctttgtcagagtcaagcccccccaggccgccccctcccaccctgggccggcgggcctggtgggggcgcaggcgggtggctacgtggcaggtttctggaaggtttcctggctggccgcgagagggcgctggcggcactgcggaattttggggggcggggtggggaggggaggtggcctttgttctcctgatggagggggtcgggcgcgggatctactggaggatcctggattcgtttacccaagagggaacagttttgagaccccccggattcactgcggagtggccgcagaggccggggtcggcctttgcgccgtggcttcgggtgttgtggaggcgcacagaggcacgttagttgatttccagtggtttttggtttcgggggtcttaggaaggtgtggctcatttgagcaggatggagagagaggctgtgacaaggtcagtgaggggccatcgtgcgggggctagaaattgttgttgtggcgaaggagggaggcacgactttggaggcgtgatgttgatgcctgggggcgaaggcggggagcggcgtggtggccccctttgcgttactttccagcgatgtcacaggttctgtctctcgttccgagaccacccacatgcgtgacagcggtgcctggaggactgggtctttctgactttagtgaacgtgtgtttaattggattgacgaaggtgggagtcgggatttctgcttttccctgtagcaggcggagcggcgctccagaggggcctggcgcaggtccgctgggtggcccaccttcctctggggctggggcccggtggctgggggcgcaggaggcgcctggtgcgggcgggaggcgctgcgccgcagccacaggtgggctctggctggtggtggctggagaggcgtccagggggcgtagcgacctggcgcggtggcctggggtgggctgtggagcccttcctagcctgagacctgttgggcaccccctgtccatccaggcccgccgggcgcgggccggggcgccgcaggtggctgctgcactcctgggttacgggtgcgggccgcgcgccccctagcggtgtgtgccagccccgctaccttgggttttgagttgcgcacacgcacacagctaacacttgtgacctgtcagtcaaatcatccttaccccctcccactcctctcctccacctcccatttctcctctccctccaccctttctcatttcctcgtccctcctccccctcctatttttcttctccctcctccctctttcctcttccctcctccctcttcccccctcattttcctcatctctcttttcccctccccttctctcctcccctctccctgcccccctccttcctccctccatacccctccctcttccctcccagcccctccctactgccttcctcagtcctcccctttgccactcctccctgcctttccctctgcctgcccccttttgctctctgctgttccggtgctggccgttagaggtcacgaagatggtttctaacctgcccccctcccatgccatagggtctctcctcagggatgacatcatccgtccacctccttgtcttcaaggaccacctcctctccatgctgagctgctgccaaggggcctgctgcccatctacacctcacggtacttcaaccctcctgctatcatttcataaccaacgtggcgggcagaatctcccaaccccaccaccatccttgcaccacccccagacccactagcaattaaaagacaattttaaattttaactaatcagctttaattgtaattaatgaacttaaactgtaattatgatctaggcttgggcttttaagcaggttctctaacctttgatcaattgcagagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgcccgacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacaccccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcttcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactccgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggtgggtgttgcccccgcctgcctttgcctccgccgtggccctgagagtcctgggctctgccccgcccggtcccttgctccccactcagttctggatttggggctgcccctaacccagcccgttgctgctttgcaccttttcctgtcattgggcatcccccagtagtcaccccactccaccgaaaagtaaactgcaggtgaggccgtgccccgagtctttcttcggtgtgtttggcttttccggggcgcttgccttgccatgattctaactctctgcccttccccaaggcacgtgggccgtggcccggctgggtcggctgaagaactgcggatggaagctgcggaagaggccctgatggggcccaccatcccggacccaagtcttcttcctggcgggcctctcgtctccttcctggtttggggtgagtttcttgctttcttgagacccaggattttattagggtcagctcatgtctctcctctctgatcaacaagagtgtcaacatttaatttggggaggaggcaccctgccaaggtgaattctcttcacatcagccccaggggtctgggggccggagagctgcctggagtggagacccttgctatacccagcaagcatgtgtgggggtccaccctggctgatggcatgctgtgggccggcgacggtaggtggggagtgtccacctccactctagacccccgagagcggctcgggccaggcactcaggagccctcagtacggctttgctgaacacattgcaaaagggatccagggggcacttgccctgcccacacccggcccagggaccccttcggagaggaggaaatgggaatgcttgcctgctcctcagctaggaagacatttctttccaccagccatggtagcgtcaccccctgtgagaaccgtggtttctcacacatgaggctttgataatgtcctttaatcaaatagtggtttttgagcaagttcttctctttcctcctttcctcacccctgaaattgcaatgagacgggaatgtttttgtttgtttaaataaaacagcaatggtagagaagaagaaagcgggattggagccacacaattcactcgaggacccatcatttgtttatttgtgttttactaattcaagatgcagccgggagccgtccagggctcgggcctggggttgttctggggcgcctaaggctgggctttgcactaaggaccagagggtctacttgggtgccgtggagcacccatgcagcaaggtggcttgcacagcagccaggcgaggtgtcgtcgagggcgggggctcagggtggcatgctggacggccatgccaggctgaagtttgggctggcaggaagagaggaggctcagctgaggccactttcctttctgggggtcccagggactgagtctgtggctcactcagggcgatggggtgtttttagagccactgccctgggaggcagtgtcaggatcctggcacccctcatatatgacgcccctggggtggccattgtggtgaatgagtgcagttagacttcccagagaagctgggtgggcgctgagaaaggtctgaaccgtggggtgaggctggctccattcccccagacatttatggaggcttgagggggccctagcactgtccttggcccagatgccaatactcccctctggacgcccacgaatggggtctctgagaaggaagtggatgaacacagctgcacgctgggtggggcccagcctctagtcctcagccatgtgcacgcatcagcccttgtgcaggcctccgccctccgccaccccccacccccggagtgtctctggtttccgacgcagcctcgtaatgctctttaatcaaacagaggatttggagacagctctcctgcagccctgcacttctcccctgaaattgaaatgggatggggatattatttttaaacaaaatctggcagcgtaggcagagggggcagaggcgctctaacctggggctgttgcctttgtctgcttgtttctgctctctggagagccccagagcctggagagacggggaggggagtgtgtgcccagggctaaacccagggagggggcccaggaaggctctgccccgtgacatttactccaaggctagcatttgctgagccacctgcaaacacagtgatgtggagaagaggcccgggaggggaggtttgcacaggggcaggctgctggggtcctggggggatcctgtcccaagcttactagaatgcattcgagtaactggtctgagccagatgccctcagctcttggactggtttctcacggacatctcaggactttcccaaggtggactaagcccagggacaaagtcaaagtgaaggccaggggcacacaggagaggcccagataggaccaagctttggcagcccctggctctcaggggttgaaatggaaccctctttgcactgagttgtatttcaggtactcatgagtgtttcggtctcaggcaaacacatatttggggttttgtgtgtcattaggtataaaataggtaaaatatgccacgttctcaatgaaagaagttgaaacgtgacttactacgtcagccttgctggtgatcttctcgggaactgccgaaaggccactagtaagtgctgaaagacatgatcattttcaggaaaattctattttgatggattggccaatgcctgagccatagcgggtggagatgagaccctgactgactaggcagtgagccacagaggaccctgtcacatcagcggagggcggtgaggggtctctggccatttgtcatcgtgctgattcctagggggctgcctctagtgggactcttctgggtgggtgcaagtgtcagggtaaagacggcggtctggtctggaaactggctctcctctcgcacctgcccgccctgggtggttgggaaaggaaaccaagagggtagctcaggcctgagctcgtggaaaggaagaacatgacccctcattcgctcactcgcccccacattctctcacctgcgagttgctcattgctgctttcagggcccctgacctcatgcctcctgagttgtgattcaaaccccaaatgaatttccaagtacatttctccaaataatgtcaaaacctggcaagacttaagggcaacaggatgcatgtgtttcttattcattcatttacataaaataacttaagtgtgttttttatgagcaatctgacttccaaaaagaatgaaaaggaaaatctacccatctttaatgaacttgctaatgaatttttccttgcaaagaggaagggagcttcctacagaagggggtgtggagggagacagattcaggtcccaaagggttaaagggcagtggacaatgcggaagccagcattgtgagctgcagtggaaaagccctgggtcgctgggagtggcttctttttaggagactggaattaatgagttgtgaagtgtcccaaggactggttccccctccctgctgtttctctgagccctgtcccctcttccaaaggaggaataaggaggtctagcttcgtctcccatccccgatttgagcagatggaagagtctagaaaagaggtgtaccttttgaaacgaggcctcagatgtggggttcctggtctggaaaggggaaggatgaatctggggtaggagagggtctcgtatggagccccattcagacagggcagtcccacacctgggctgcccacaggttcttgggggagtctaaggaaaggggagccacagaacaggcttgcctccttggcatggattgggtcagtgtttcagagccaggaaaggtgggagtgtggggggccctcggggctgatgagggcgtgcagaccctcccctcccacctcctgtcccaggagccctgcagacactgcagcaggagggcactctgccagaagaggggttccagctccagccggatccagcagacatggagagaccccttatctttgccaagacgagctctgcggtgcctgagaggcccgtaggtctggaattctagggccttctgggtttgagtcaggtcctgaggccagggcctgggccctgatcctcaccatggaaaactggtcactttactcaggataaactgtgatgaggacttgggacatatctctgtctgtcctctcagctcgcgtcacccctgagcccttggcgatcgtgggcggcccgtgtacagagcaggtgctgggtcactggggccgccgtgggcctcccaacatgagggactgtgtgtgagagaggagttcattaagggagaggatggtggtgaagggtgtagccatgactttcttaactgctctccaatttctttgagcttaaaaataaatccagatggagagttcttaagtcccctatcctgggagaaaggaaggctgcccaccaccttcggcttgcctcgactctgagcagtgaatagggtctttggcaggggcttaaggaggagactcttagcctgggagctcccagggctgtttcagatggaaacaaaggctcaggccgagaggaatgtgggggagccccccgtggggaacagccacctggggataattgggagggctgagcgcagatgagttttcccaggttctgtgaatgcgccctttcaatggaaggtgcctttttttccagatgaaaagaagaaaacgtcaattaccttcccctgaaacggagtgtgtgtgtgttccctcccaggggttgtgtggggccccttgcccttgtgtgtgtgtcgggagctccaaggctgcacaatgacgcacttaaccagccactgggttcgcgcgaccctgggatgctcacgctcttagattctagggcttgattttgaaagtttcttagcaaaggggaatcagagtgattgagcctgtaaacaaaaatttgatcaacctgggcctgatgcctgaaatatagccaaagagacagaatggggctgcggggagagaggtccaggatggaaagttggggaaggaggacagtcgggggccaaaggctgaccgcatgtctgcgccggcctccgcgctcacagctgggctgctccttctgccaccccagccctttctctgggccttcctggcagtggacatagagtgattccctactcaggaagttggcggtagggggctcagaaatccacagggctgttgtttcacagttagccaggagaggagggggtcatggtggcccgcagggatggtgggcagctgcgagagaggggacgcttcaggttagagcgaagctgtttgcaccaccactgccccagactgccgtaagggtagggccactccagaggcaccagggacaaagtccctgccgtgacaggaggggggcacaggtctcagtcttggctggtcactgactttgctgctgctggcttctgagcctcagagaggtcagcagtcttccagagacctggttagagcctgtgctcagccctgactatgggtgtgaccttggcccctgtctccagccccttaggcctcagttttcccgtctacgaaatgggcgagtgcaggcccatggtcgtccgagtggctcggggtttcttcaggcctccctggaggtcatctgtcgtttgtttgctgggtctttggagttgttgggactttgggggtcactggtccgctgccccctctgctttagaggtggggaaaccagcgatcccagaggcccggagccttgcccgaggttgcacggtgagccggcagcaggccctggaggtgaagcccctgccagttgccagctcctgtgtgacctgtgtggtcggggggggtcacagtcaccggtcattagtgtgggtcagagctcttgcccaaagaaggttccaaggggctgccccatgagctgggatgcagggatcgtgttttatggggcattattccaaacaggcaggctgctggtctggtctggaacacctttttggtctgtagagtgactcttgtttaatgagactggacttgtggcttcagaaccaggagatgttcgttcccccaacccccgtggctcaccttgtgccttttgggtcctgagaccctcgccagcgcctctgttggcacggtggcccagtcggctgagaacttcctgaaaaagccaacaggatgacaacttctggaaaagtgatcatcacccgcctgcactggctgcccatcttagactcagctttgccaacattcccagctatctctgtgtgctgcagtgtgtagtaatgaacagctcacaaaacctccggctgggcctgcacctggttattaccgtggtgggctgcagcttttgttttgtgaccttggttgctacaatacctgcgagctgaaatgaggaatcgaaaaattgccagcttcaattagacgggcagactgctttcccaaggctgcctccgccactccatccattaacggtaaacaggcaccaaataggccctaattctctctaattgcccactcctgaagcaaagaggtgaaattccaggaagaggcgtatgtaaacatcctctgtaacctgaccaagtaaaattagagggctgatgggggcctgcgagagagaggggacatgatttcaaaagatgtcccaattacctctcctattttcataaatgggtctgtaatgtccagggccccggcctcacaaaggtacaggaaattagctctgcaaagagcttgcatttgtcaggggaagttgtaagggggtggtgtttactcaacaggtaggaagtacgagatctgaggcaagactgattatttgtgtaacgacgggctctatttcttgagatcaacattttaataaaagtcatccttttaggtccttttgtgtttgaaacagccataagttgtttataccaaagacatgccagatcagttaggtgctgtttgcctccagaaaagaggaacttttaaaatcctaagatgcagagctagagttttctaatcccattaagctgtggaagatgtttttggagtgttcaccaatgctttctgcgtgggtcatgagctcactgcacgcacttatgaggtcttccatcaaatgcttgtgacaattactcctctggactctataaggaggcctcgtgtttttctttggttccagacagtgactcatctctgcagcttttctgacatttgttaagattctagcccagcactgcgttattaacacatcacagcaagcccagagctggcacacgcagcttttaaaccaaggcacgaatttgctggggcttctctgtagcagagcagcctgcggtctgcacacaagagttaattaaggacggtcagggactctgaggtttcatggggtccctggagcagaagcaggaaaaaacccagatgctccttcctgcttctgatttctccgctcctattaaaaacacaaaaaagaacaaaacaaaaacagccaaacaaagcacccgcctctgattcctgcgggaaatggcagtgcctttggtcgcgctgtgtgttcttggcctgagtctcgttgccaccttaggacgtggcgatggtgagaggccaccccagccacgcacagtctcggagggagggtgggaaacggtctcgagtggtggtcagtagataatgggtggtctggcagcctttaggtaaccgaagtcggcccctcagtcacccatgcactgatcattgcttcactaacacttattttaagacttgttgtttcttggttatcaaattaaccagttatggcagaacagggtttatgaagggcaaggccagggaaggagattttaggaagatttggaggcaagaagtgtccccagtgccctggccgggtcttggacatcctggctggagacatgactaggaatagagaggcagaggcagcaggggtggcccagatggcaggggtgggttggagagatccctgagaggcctgaggacaggcggcagtcttgggagcccctgaagacctgcagtggggcaggcagctggagtcaggtgtctcccgggacctgttttttttttttttttttttttttgagacagagtcttgttctgttgtccaggctggagggtagtggcgcaatcttggctcactgtaatctctgcctcccacgttcaagcgattctcctgtctcagcctcccgagtagctgagaccataggcacataccaccacgctgagctagtttttagtagagacggggtttcatcatgttggtcaggctggtctcgaactcctgacctcaggcgatccacctgcctcagcctcccaaagcgctgggatgacaggcatgagccacccccctggggctggtacctgtggtctgtggcttctgcctgccctggtgcccccacatctctctcatggcctttctgtttcctgggtggctttgtgggggtgtcccatggtctccccctggcttcctgtctccacctgtgcctaatccaggaaacggtccccagagatggtgttttcaaacagaccttggccctgtcctcctggcccagcccctggctgccctatcacctagcttgctgcgttggtgggacctcagctgtcacaggctacctttctatgacgcctcctcaccttaagtagactctgaacagattttaaaagccattcattcaacacattttttaaatgaataaactttttttctgtgtagttttcagtttacagaaacattggtgggaaagtacagagaattcccagatcccgtccccaccatctcccctgtcattcacacgttgcctccgtgtggtgtggtctgtttgttccgatcgatggaacgactctgatacatgattaactagaggccttggttcacatcattagggctcactctttgtggcgcacatcctgtgggtcttgacaaatgtgtcatgatacgtgtctgacattgctgaagtcaccttttcttaaagcttaacattttgggagtattctgaactatgtttggcccagcctgctgcccgatttttataaaaaagaaaaaacaaaacaaaacaaaaaaacaagttaaaacgtaaggcagatcttgacactgaagactcgatgtgcctggccatggtgcttcccggggcctactgcactgtgaacaaaattgccacagtggagttgtctgtccaggcacacaacgtgtgtgccatggttttgggaaacgctgcccattaatagccctgcagccctctgtgggctgccctcccggccacaccccgcttccctggtctcctccagggccagccatcctgctcgccgacctgggcaccttgcttctgccagagcacaggttcatgccctgtcttcagggcctgggccacccccgtttctcatctatgcagggtcctaagcctttgggtcccacagagcacgacttcgctccgtgaacagcaccaacccaagtctgttccatgtctccacacctgccccttccgctccataggcagctggtgggtgagtggagtcaggagagaaatgcgtggcttctccaattccacacttgctggaggttggggagtctctgctccaggccacccctgcccgccccccagagctgttgtcctcatccgccctcctcctcctcgccggcctgagtgaggttctactctgtgacctagtgccttcttgttacagcggaagccatcacctggatgcctacgtgggaagggacctcgaatgtgggaccccagcccctctccagctcgaaatcgtaagtggctggagtgtaaagaacacacatgtggccttgctgctgagggtggggccagctgcccggagcacaccgccaggcggacctcgtggaggggctggcgggcactggccgggggtctgtgcaccgggaggtgggtgcccatcgagtcaagccaagtgcagacctgggggctcctgttttctaagacaggagccccctgcctccttgtgttgtctctgtggcaaaagaattctataggcgggcttcaaatgtcggaccccaaaagaatttcttctttttcactcttctaaatgaatggctctttcattattgagtctccctttggctcttgtgccgcagggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaaaccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggccaaaaagtctacattgcgtgtgtggatggatgaatgagcagtgggagtgcagcgccaggtgacaagatgttgtgaggggttttgagtcatccagtcctgggcactgaggtctgttagatgaaaggatatgagaaaggtaatattggtaaataaagaaataggaaacaatgtaacaaatgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtacctaaatagacaaggatgaggtgaatgagaagacatggccccatgggtcctcctgatgagggtgttggggtcccccctgggcaccccagctgcatgaaaatgaaggacaggaggtatggaaagctatgacagaagagagaaaggaacggtaaaaagaaataacaaccaaatggataaatgggtagatccacgagaagagttaggctaggacttgtcataagggcacctgactccactaatagaggaataaatgcctaataaaaagagagcaagcaggaaggaaggatgctatgaatgcaggaaggaagtaatgagtgagacgtggaaccgcacggccaaggatggacgtttgcgggtggctttttgatgcgtacagccaagccactccatggcaatgagctccgaagacaaagtgcaagagagaatgagtgagagagtgagagagagagaaacaataaaaaatgggaagaaatgtaaaaaggaagaaaggaagagaggtaatatattaaggaataaatacatgcatgcagatttaagacagagccatgctagaacaggaatgaaaggctgtgtgaaccaagcagaccgcttaattggcaccagtgctgctggtatggtcaatcacctactcaactaaggaacggctcaaagcatacacatgggagggaggagtggggccacagagagagggcccattagttgcagattacgatgtatccagttaggtgcacctgccttcgagaagtgtaaaaataagtatttacatagaaagaaagactgaatggatgcacggtgaatgcatgaatgattgaacgacagaaaagatttgcattgaccgatgaggagggcattgtagacagggatgagggtcattgatcctgggtgcagatctccaaaagaatgacagaaagaaagagggagtggtggaaagaaacaataggatgggaaaaaatgaaaatagaaaaaaggaagtgaaagagataataaataattagatcaaataagttgatgaaaggggactggtttagcacaagccatccacattaattcaaacctgtggctctgaagtttgttttttaaatgaccacaagtgtaagactgaatgaaagaataaatgcgtgcattccataggatgcaagaaaaggagtgaggaatgggaaaattggaagaacgagagagggagagatgtaagaaaagaaaggaaaagtgaagtaggcatatgaaagaaaaggcacttcttggacaagcactgaaatataatgagacagttttacccattaaatataataaacagtaaacgttgaggttcatcaataaaagcacagatacctgaatagaggagtgacctgaatagaattcgttcagccgaacgaatgagaatggatgattttcactatcctgtgcactcaaggcccaaaagagaaagcaagagaggagagaatatggaaacgtatgacaggatgtatataagcaatacaaacatattgaatgaataaataaagacataaatatgtgggagagtggaccacgcaaggacaaaaagaggagagaaggcagcaagaattatgactaattcaaaactgggttcctgagatagttaaataaatcctgcaccaaatccccagggggagaaattaacaaacaaaagacagccccacacggaccagtgtgcagaaggctccaggaaccgcagattatggttaatccaattctgtgcacctgaggtccataaataaaagaataagtattgaaatgaaagaatgacagaaagaatgaatggacacatgaacgactgaattagaaatggaaatgcctggcacagccaggaaggagctgcccatgggattgtcattcatctcactctgggcacctgaggtccataagcgtgaaaagaggcaggaagagaagtgtcagggagtcaaagatagagctaaggaaaggcaaaaatgaaactaaatgaaagcgaaagggaaaataaagaaaaaccaataaaaaagagaacgaatacgtgggtgtatctgtaagagtaggatctgttaggattagtcataagactgtcagtaatcctgaagatggatgagataatccaggcccaggttcccagggggagggaaaatggagaaaatataaaaagatgtgaaaaaggaaaaaggaaaggtaataaacaaacaaccaaagtgataaatggatagttaagggaggttgtctgaacagggattataattagtttacatacatactccttaaacagataaatacattacacctttcaaagaataaatgaaaaatagagagacatacctggctccaaaacaaggctgtatcttctgccactgtaataaaatagatgcaattgaggttcataaataaaagaataaatacttaaacgtgaaaggtgactaaatgcggggaagaaagattgcaaataaatacatgggccaaagatgtttggtttgcccatggagttttaattaaaaaaattaataaggaaaacaaatacccaaaataaggaagactgacaaatgagtgagtggatgagagagtgaatggtgcttgacgtaggagcagtagtgctttagggaccagcatgaaggtggtgaccgggagccctgattcatgggattctgtccacctgactttataagaaccaagaatggctgggaatggtggctcacgcctgtaatcccagcactttgggaggccgaggtgggcggatcatgaggtcaggagtttgagaccagccagtttgagatcagcctggccaacatggtgaaattccatctctactaaaaaaatacaaaaattatgggcgtggtggcacctgtctgtaatcctagctactcgggaggctgagagaggagaattgcttgaacccgggaggtggaggttgtagtgagccaagattgcaccactgcactccagcctgggctacagagcaagacactatcttagatcaaaaaagaaaaaaaaaaaaagaaggagaaagaaccagagaaacataaggaagagtgagaggaagaaagaaagatgcaatttgggaagaaatgaaaaagaaatgaataaagaataaaataatgtaacggtcaataaataggacttgtgaatggaggcctttaggccaaaggctatgattaatttcaagctatgttactgaagtccataaacaaaggactcagatctaaatggatgaacgaatgactggaagaaagggtggtaggaaggtaggaagaaaggaaggagggaaaaagggaagagaggaaggaaccttctttccagtcctgtgttctagacagtggaatgaagtggtccccagggagggtggctgtaggcatgtcatgtgcttgtcacatgcacttgccctggcagggaggagctggctcaggaagaccctggtcttggggtgctgttgccctatcttggctgtgtgggccatttcactgcatctgtctcttcctcagtttccccatctgtaaacctggagtggcaccagctgcctactagagttgatcttatgtgtctctgttgatggtaccccatctatggcctggataggcaggaagggcttggaccctgagccccgcagaaggttgcatgaacgagtggtgtgaagcctgttgggtagcttggccactcccgcggcatgggtcacctgcacaggaggttttgcccaccagggggcagcagagggtcagggagcaataggccctgggtggagcatgggccccgcctgctgtgtgccaccctgggtgtggcacctactcacatccaggggttggtgcagggaaaggccagaaggtggccaggcgcacctgagaagggggacccagaagccccgggacccaggagccctgggcaagccaccagaaaccttgttcttgcaactctctgcagtgtgcccaggccaccctctggcctggtcttccatggggcagggcgcccacccttctcaactcaggtttccctgggcagcaggtgcacctcagcacccctggggttgcagaagtggtccggggaccctggcttccttgacatgccatccccagagcctggttcaaggcctctctgtcttctcggctgtttcacgacgtgttttgtaacttggcgggattgcgtttcgctgtgtcgaggttgtctcttctctgactcgccctccgggggactgccggggtaaatctggagagttgctcgtgctgacagtcctcccccagggcctccccggttctgttgagtctcctttctctgtagtggaggaaatgtgtgtagttttgtgttgtgtgcctgtgtttgtctgtaaaagcaaggaccaaagtctcccttgttgacctctcaattcctatttgggacatataaaaacactggattcttaacaagcgcccggagcagtaggagcacagcttggatggactcaggacttgtggcagggagcacgtgggaggcaggggagtggggtggggccaggccatctggagtgggaggcgtcatgctcagagtgactctgtagacgctgggtgggatggggagtgcgggcgcaggcatggatggggctgttagctagtgtgatgcttgaggtctgagctgatggcagcaaagtggggtgctcaggaatcaaagctatggggttatagacaggatatgaaggagggagggaggcaagaagaagggggtggttcccacgcttctagctccggccgagtggatggcaacagcatttggaaggcggaggacatggaattcatgtgtcaggagccaccttccgagcctccagtaccacgtgtcagggccacatgagctgggcctcgtgggcctgatgtggtgctggggcctcaggggtctgctcttcttctctttcagaatctggggctccaggctatgccttggctggactgaggtctgggggtgcacttattatccctggggacacctgctgaagcttctccctgacaagctgtgtcactgttggatgaggatggggcgggaggggttcagggcagaagaagaccgggagggtctttcaaaagaactcatgtacggctgttaaaaaaagtcagcagaggctcaggaagacttaaagtgtgcagaaggcggggaagggagggcccattgcatgcaccaagaggaaattggaaggaacaagcgacgttggctgctaggagagcctgctcccaacatctaggggctgtcctgacgggtcacagtgggtcgaactgagccaatgagagcagctctggggagacccactggtgccctggaggctgggtgggtttgggttggatgaattctgtgtgtccttttggaaatgtggaggccatgaggggggatcagggctcttagggttttgacccttaagagttttgtatctgtaattcaaaggttctttagttctgggatgctgagattcgggatagggttcctaatggcacaaaagccagagataaaacatccttcacgtgctccctacccggttctttctgtaccagacccacaaggtccgagttgggatcctagtgctcctgtctggtcagggcctatctttatgtgttcgttaaacttttaacaatgagaattaattctgtctcttgacattgtcatttgcatgctccccacacacaaatcctttcctggtgacaccaggagctacaactctccttggcctcctcttgtgactcccaactccctccttgggaagcttggcctcaggacctctgggatagacaggccacgaatcctgctgtgtcccgttgtgttcctaatataaatggtgtggatggcacttgacctagagcagtgggaaatgcatgcaccactcaacattctgacatgtcacccattttacattcttacaggcatactttttttaaaaaaagagtgtctattctttaatgagcatcccttctttaaaaaaacctaattgccattattcaccacatacacttttttttttttgtatcctgcctcttctatttaattttctgtcatcaacattttcccttgttccatgaatcttcataacctcacttgctgcgttgtgccttgttgagtggctatggcatcattcacagaaccattctgttattcttatgtataaccaccttttaaaaatattatgaataatgccacaactaactgcttaaaacaccctttttttcattcttaagaattatgttcttccacccagaaattatcattgcttcactacagatcagtttcccctgctagactgtgagccccataagggcaaggagcttattgaattggcctttgtatctctgatgcccaacatgttgtagactataaataaatgatgaatgagtggatggaagaatggaggaaggagcgagtgagtgagtgtttggctgatggataagagggtggaaggataggcggaaggatggattggtgaatgaatgaatgaatttcctttggttaagtctcttgaaagaaaggctatggatctttgtatggatgttgaataatttcagtaagcttacagcattttacaatgttcagcaatgtatgaccacttaattaagatatggctagtttgtctctgttataaagtacttttgcattactttaacttgcattgctttaattactaatgatgggtgaacactttgacctatgtttgttaacaaattgtattttatcttctgtgaactgtttgtccaagtcctttgggtcatggctttctgaagagactggtcccagatgtccttgggatgtagggagcccatagctcactggaggcattcaaggaaccagccaggcagccctcagagaaagtagtgtttaggagattctcatggtgtggggttggcctaggtggcctttcaggtctgtttgatgttaggatttgcttctccctgggaagtgggtgatggggaaaaagacaccttccattggcaggtgtagacactgcaggctggacctcctgggtgtgcttgtggactccgatcttgcccttgataaaacccctgtgggacaggaatagctctttgaacctccaaggtccagacagccacatcctagcaccctgtacaatcagttagtggccttcccaccagcgcagtcactcattcctattagatcccgatgaagccaggccctggggtttccattttcccacctcttaggggaattgggttccccgcgtcctgtgatatgtcagcaaatgtcctcagccctggcctgcacatgtggcctcagtggtggtctttggggtttaactgacgaatggaacattttggatcaggactgatgggagaatctcctttcatttttcttcacctggggcaattacattctaaggagcggaataaagggcatgttctgcccaaagcatcagggctcacaggtcagtcacagccatttagggagggcatgtcacccaaggagggctcgcccttctttccagagcatcctccgctctcagcagagctgcttctgcccacccatccctctactatagcactgagcactgtttgcccgtgtcagaatccctcacccacatgtttagcttggtatccgagtttgggaggccggcaatgactttcaacatgaattgctccatctacccatccatgcatttggcctacttatcttgaccccgtgcttttggccttttcttctcctgaaagcaaaccctttcattttgggtgggctgtgtagcgccatgggctgtggttatgaagcaaacaccctttcttgtagctgcctcctccggggttactgccctgagcacgtcccagctggatctcgtctgccactgtcacccatagcttcttccccatggtgctttccatgtgtcacacaccacgactgtgacccagggtcggggtcaagagtagcctggggccaagccctcccacccatgagcggagaagtcctccccaggcctcaccttgcctggcgcatggtccctcccatgagctttgctttcagcctttcagcttcctccacagggtggcagtggttgtaactcatccattcatcccttcatcccttcattcattcactcacagccaacagacgtttttaaaaaattagccagtgctatactagagctggctcccaaggacccgctgccgcattgccttttgaaacaaaacaatgaacacgttggtaaaggggccgtgcttgtgtgtcggtgacaaggcgagatccctgagtcaggtcaggcttgtagattcgagttctgttgcgagtttgattgcccctctgactttgtcccctgtacaactaggttgattaggaatcagccaactgtgttccctgggtgctcagaaatcacagcccatatcctcgagaggccaaaatgagagccagggggttccaagatgagtggctgcttctggccgggagcaggttttcaagtcattagaacactctggcctttcctggaggtgatcttggagccattcctgcccctttcaagaggagttaatgcccagctctgtttagagaaaattgggggagatgattgctcatgtgggtgataagaatcacctcccgtgcaggggtctgcatagaacactccataggcaaacctgggtgtccaaggcacgtggcattttgcaaactctgggtgcagctccgagctgtcctgcaggtcccagaccaggtgagaactccctgagttcctgctgcctgggtcgggggtgaggcataggtcttgggggttcaacctggaattctgaatgtcattcattgcattggagaggaaggagagtaggcaaagccaagaccctggaactggacaaactcgtgtggtttaaagtcactgtgagagctggagttgagtctgcctacgggggaggactgcggcacctacctcgcagggctgttgtgaggagcaatgtaaccgtgattttgaactgtgattctggaagggcggtgtgcgtgtccccgggggtgtgccaggggagtgaggagaaaaggccagggagacagcctcactcaggcagctgagtgggagagcatttatctctaaacctggaggggtatatggtgggacaggaggaatttgggcaggaactttcatgctaggggtttgggggactcgctggacaatgcccctggaccccccgggggtacgcgttcacgctcacctctgagaggctggaaacgcctggctgtgctttctgaatgctgtgtgcttcctgcctctgtgcctggcctgtgtgcagcacctacttgtgtccgccttcaaaaggcccttctgggtggcgtccttttccccaaaatattaggcaccagccatcaaagatactgcattgttgcctcccccacccctccccccaactgacaacatttgggctcaaatgcagcaggctgggtgcccaacacagtgcctggcgagtggtagcgcttacgtttcttttctgttgaatggatggatagctaatgaaattgtaaccaatgacaagccttgatgtttataacctttactaagagattattattttgctcttcatggacctgttaacaaccaccatattgtatcttacggacgtttgtatgccacgtttgaagagcaggagccttgtttcggcgtcatgttgatggaacttgagctgtctgatgcgaatctgtgttttatgttagaaagcgcgtagccttaggatctggcagacccaggggccacttaattaaccctttgcctctttgaccctcaatctccttttctctaagccataggtcacctgaaagcctacctcacagggctgttgtgagggccgagggtgggtgtgtttcaacagtgtgcagatgctggctttccctgggaatgggcatatgttgggatttgtcttgaaagcatgagtgatggctttactagtcctaagtgaataaaaagtcagccctgaccttacgctgggattgcatttcccacagtcagtggcatgtgcagaccactggcagagcagcctgcaggtgcttagcgatgtgggcccagagtaaatatttgtttgattgatgagtgatggctttttccttcctcagagtttgccctgccccccattccaacgtgggctgctgcttctccccagcgggttgtagctggcagggccgttgtgctttggggtttgctgtacctgtcgctgccgtgaggggacgatctgtctgcccggaggggtttctgcaaacattcatgtatgcccctgctttcgtttgttagggagaaggagtggggtgacctagagagaggatgaggaaggggttctgggtggcatccttggggtaccaaccctgcttccatcctgcgctctgaatttcctcacagcccttttctgtctctggtagaaggtgcagaaggtaggctttgccaccttccctgggcctggcaccaagctcgggggtcttgtacacactttcccttctctaactggggtgtgggcccatttcctagatgagcttgctgagaatcaggacagctggtatcagagccaggacttcccagtcttgcacaaacaacctgtgcatttttgagtccaccaaataaggcctcctgcctggtccggctcacccctgccagcccccagcaaatgcagcctggtgcgtccccacccctgccaagagcccaggagtgctctggcagagaagtgcagggatgaggaaggaggctgtgccctccaggggactcagctgcgttagaggaggtgctgctgcagtggcaggggtctccagacatcccacgcaggggtcctttcagatcaggcatctcttcaccagaccaccgtattcctttttcagccctcgtctcttgcacgtgggggtgcagtgtttggctctcacatccccacattccagctggtgggggtttgagctgggtgttccttctgctccccactccccactcacggcccccaccccacgcaagcctcccttgcccccactctttgtctccagctttcacagccttggcgggcaggctgctgcgcctgttgctgccccggctctcttccacccgcctcttctttctcagcctgagctttaccgtgaggtctgggcgccacaccttggcccctgccatgcctgctcccagaagcacccacgtgggtcccctgattctctcctcccctgggctttgctaaggagccctttcattgtggcctttggtgtctgcctcatgcccatcccctgttcttgagaacttggaagcagagggggcccctcctattgctcccaagaggctccacagtagggagcccctcccaggagattctgagtctgtgtttaggtgtcgattcctgggtgggccttggggtcccctcaggccaggcctgtgtgtgacctaaggctggggggctctgtcaggcacctagtgtcccttggaggtgggcggggctgggtcctggtctcctgaggacgggtggggagacaggctcagggagatttccacgaagctgcccttgaacccctcctctgaggcccacactgccctggccctttacaccctgcctcctgcactagtaggcacataatagatgctcgccacctgtggagggcagggtttaaatggctggaaagagctgagtgggctgtttggctagcgtacgcgcatttgtttaaaaggaaagggtgtgtttcttggcaaagactcttcggaggaaacgctgaactggggatgggtctctacctgttctggggcctcactgcccttcctgccggggacaggcagtcactggtgggtttccccccagtggaaacacaatattttggaaatatttgtatctaggataaaacttcatctggaccaacatgtctttgttggtgttgtggcccaggtgattttgagaatgtagaatacatttggcaatttccaaacggagtgatgacctgctcctccgccccccatgccctccctgaggctggaggcttcagaagcccctgccttgggaggaggctgttctacctgagaagtctttgtccccaccgttggtgacaatcagcattgacctgtgaggcacctgccaggttcgggacgcagctttagacatccagaaaaccgggggtggaggggtggggtgggggcttaagaccccagagcttgattccttttaactgtctcatccccaaagaatggtacatgggtaccaggtaggttacttgaatcaccctgagcctcgattttcccacccgttagaaacagggtaattcatgacagtgtccgcttgggagacggctgtgacccctgagaattctcgctgcatgccgtgggctggctcgtgagactcaaggtctgggttcgaggcccccgcaaccccttctgactgtgtggcctgggcgagtttgttgtttgtaacctggaaagcgtcacacctgcctggcacggttattgtgggcttcaatgagattgtttgtgtgaaataaacgctttgtgactggcacacaggcgctctcatcccggctctcctggtgggcccggaccgctgggtgctggctgcggaggccctgtgctccctggaactgtctgcgctggtcccagggactcttgggcagagtggagggcaagggggaaagcaccagcctgctctggggagacagtggcagagggaagtgtttgcttttaaatacactcagcaggttcagacaggagaggatccgaggggaaatgtttagagccctcaggaggaggaagagaccgagttttaggaaaaacatcaaagctggataggttgggcagaagagctggggatagcatttagagaggctgagagtcctgggttctgggttatcaaggtgagagaaaccagaggttgccagttgtaggtgggcgtcaggactagagtgatgcttccagaagtttctgcaagtgggccgagtctaaggtagggcagggtacgccagaagttgaggggcactaggtagacaggccgagctggtggctgggtgctcccctcaccctccatgctgctaggagcccgtgagcagggacttgctctcctctccctccctcctggggcctgcctgtctgtctgtgaactcttgtcggccagcgaggccgggagcaggtggccttcatctgcaactgtgtctctctcagcctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaac

SEQ ID NO: 37449 - DNA, 15378 bp, Homo sapiens
cccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggtgcggatccccgcgaggaagctggggtcggtcgggtcaggtcttccggcaggacctagcctggggtgcggaccaagacctgatcggcagaggccggtcaggacgcgctcccgtgagcgcggaaggcaggggtgggtccccgactcggccgcaggccctgcgcgtcgccgctgacttcctttccagctggaggatgaacttataaagagtttgtcagtcctggcgtgacgtttcgtggccctggttggcgcagaaatcttccccatacccatgcagctttcttctctggtactgcctaatatctaatctcagtaggaaaattaatgctgtttcgtattttcttacaggactcatgttcaacacggggattgggcagcacattttgaaaaatcctctcattattaacagcattatcgataaggtgggtgtggaagaggaaagggagagagttgttggtttattaattttattcctatgaatacataagcgcagaaagtctgcctgccgtaaattagatgctctgtaaatatttgttgaatgaatcaaataattgtctaggattcttgggctgtcttctgcatgataagcttcattttgtgggtctgagtttctcctggttcccaattctgtgtctttttgtggattatctactttatagctggacctttgtatttgttcaagataattattcttctatttctaatcacctttttgatcacttagtttttatgtactccatctatttatgtctaaactacacattagaaagtttgttccccagaaaaacatatagtactacatataaattatttggtgtatgctagtaccacatataaattgcttggagtattactgctttctgagttattgatgttctcttatggttatggatgattgggtgttaggaagtgaaatacacacggtgcagattacacttatggttaaaagcaaggaaagcatcctggagctgtagaaagagcattacatagttaaaggatcttgtcaggcttcgtgtcatttgaaaactgagaaaaaaagaaagaagggtcatgtactattttaacctttttagctcatagtttcctttgagcatctgatgaaagctatggccgtagaatattagagctgtgtgcagacattcaattttgtgtacagtttctgctcttctgcatccttgaaaccatacatgggttgaaaattgaaaaatcttcgcccaacacgtacagtcctttcccatttgaacttgttgatacgaacagagaaggtaacaagaggctattggaatatttccagatagaaagcagaatgccaatcccagaaatgctgttgctgcttttctgactcctaaagttgaacagtattcctccaagttaggagaggtcttagattttcatttgcaccaaatgttattgaggtaattttgttaaccacgtagatcatgaagaaatctaaaaatggagtcagattaagagctcttatcggagcacatatgagtaaagatgttcaggtgtaaattaacttctgtgttctgatgttgccagaagagctaaagtgtttgtgcttgcttttaggctgccttaagaccaactgatgtagtgctggaagttggacctggaactggcaacatgactgtaaagttgttagaaaaggcaaaaaaggtagaaaggggatttaatgtttggtatcacaaatgactatgttagcaagctcagttggtttacaatctaaatatgttttaactaattgctattattttagtagtaactcctgatcccttgttggaaattttgtcttagaaaatatgagatatttcagccaggcgcggtggctcacgcctgtaatcccagcactttgggaggccgaggcaggtggatcatgaggtcaagagattgagaccatcctgggcaatatggtgaaaccccatctcaactaaaaatacaaaaattagccgagtgtggtggcaggtgcctgtagtcccagctacttgggaggctggggcaggagaatcacttgaacccggaaggcagaggttgcagtgagccaggattgcaccactgcactccagcctggtgacagagtgagactctgtctcaaaaaaaaaaaaaaaaaaaaaggaaaatatgagatatttcagtgaggaaaacagaaaccacattaggtatttcaacagggaattttttttttttttttttttttttggagagggaatttcacactgttccccaggctggagtgcagagatgcagtcctggctcacagcaacctctgcctcctgggttcaagagattctcctgcctcagcctccccagtagctgagattataggcacctgcccccacaccagctaatttttgtatttttagtagagatgcggtttcaccatgttggccacactggtcttaaactcctgacctcaggtgatccgccaactttggcttcccaaagtgctgggattacaggcatgaaccaccatgcccagcctcaacagggagtttaattaggaaggaaatacccaacgcctcccctttgtaccctataatgctggtgcctttcactggccaattccaaccagaagttgaaaggtaagggagctgaactgcattatctgtaggatgcagagaaaagcggataatagatctgggagggcctttcatggtggctcacacctgtaatcccagcactttgggaggctaaggcgggtggatggcttgagcctaggagttgaagaccagcctgggcaacatggtgaaaccccatctctacaaaaaattggctgggcatggtggtgcctgactgtagccctggctagcagggaggctgaggtgggaggtttacctgagcctgggaagttgaggctccagtgagccatgatcctgccacttcactacagcctgggtgacacagtgagaccctgtctcaaaaaataaaaataaaactaaagatagatctgggagccaaacagagtaagaaacacattgtttaccatgtaaacagggtctatatagaagtagggccaggagctgtggcccacatctgtaatcccagcactttgggaggctgaggcaggaagattgcttaaagctatgagcttgagaccagcctgggcaacaaagcgagacccaatctctataaaaaataaaaaggctgggcatggtgcctcccgcctataatcccagcactttgggaggccaaggtgggaggattgtttgagcccaggagttttgagaccagcccgggcaacatagagagacccgtctctattaaaaataaagaaaggaaattagcctggtgtgctggtacacacctgtggtcccagctgcacaggaaggtgaggtgggaggatcccatgagcccaagacttcgaggcagcagtgagctatgatagcgccacttcactccagcctgggcaacagagtgagaccccatctcttaaaaaaaattattttttaataaaaataaagtcagtgaaacctcagctgaaattgcaataaaatttcaatttcggccttatttgacatccattttcatttacttgagaagttatctatgccatgtattgtgtatctcagtagatgtgacatactaacagtaagagcaattgcattgtacgctcttctctaacaacactgactgcagagacatgtagtgtatttttttcatcatctgttgaattacaaagcatggagacagatgaaacatgattctattgattatatgagtagaactctcacataatctggttgtctacttttctgggtggtggtgtttgtttgtttgtttgtttgtttttgagatggagtctcgctctgttgccaggctggagtgctgtggcgcgatctcggctcactgcaacctctgactccctggttcaaacaattctcctgcttcagcctcctgagtagctgggattacaggcacgtgccgccacgcccagataatttttgaatttgttagtagagacagagttttaccatgttggccaggctggtctcagtctcctgaactcatgatccgcccacctcagcctcacacccggcttttttttttttttgagatggagtctcactttgtcacccaggctggaatgcagtggcacagtcttggctcatggcaacctccgcctccagggttcaagcaattctcctgcctcagcctcctgagtagctgggattacaggcgcccaccactaggcccagctaatattttgtgttgtttttgtttttgttttgagacaagagtctctgtctcttgcccaagctggagtgcaatggtgcgatctcgactcactgcaacctctgcctcccagtttcaagcaattctcctgcctcagcctcccgagtagctgggattacagatgcccatcactgtacccagctaaatttgtatttttagtagagacggggtttcgccatgttggccaggctggtttcgaactcctgacctcaggtgatctgcctgtctcagcctcccaaagtgttgggattacaggcgtgagccactgcacctggcctaatattttgtatttttagtagagatggggtttcaccatgttggccaggctggcctttaactcctgacctcatgattcgcccaccccagccttccaaagtgctgggattacaggcgtgagccactgcacccggcccatttttgtttgttgtttgaagtatgcgagtataattaaaggaatattgatggtagaaatgggagaagaagtttgtcacataaatcatgtaagagttcctgttgggataacaataaaagatttatattccataattaacctaaataatttttattttttttaaattaggttgttgcttgtgaacttgacccaaggctagtagctgaacttcacaaaagagttcagggcacgtgagtatacataatagaattaaagtgcatttcaatctcatgaaacaacattctttttacatttcttcttttctcatcaggcctgtggccagcaaacttcaagtactggtgggtgatgtgctgaaaacagatttgccattctttgatacttgtgtggcaaatttgccttatcaggtatgtcctcacattttcaggaacatcatactaactgttcctctgatgtgtctttcccggaaataactagttaattctcttacagatctcttcaccttttgtcttcaagctgttgctacatcgaccttttttcaggtttgtgacaaaagactagagttactgccaaattttgaaagacttacagttcaggtggtgaacatagccaaaaatgagtcaggtcagttgaaaaactactgaagaatttttgtagaaaatgttgatttgtatggaggtctttctctctttaattgagaggttatttgggggtagtgtgctggaagtcctgcttctgagaccagacagcctttccctatttttgaatcttcctgccgttaagtctaggttagaatttttattaccttatgtctagacaattgcagtggtttcctaactggtctctagtataagaggtcttcaaaaagttcatggaaaatgtgtattatgaaaaaaacttgcatggatttcaaaatttttttgcaccaaaataaactctgtactaactgagcaggatctagtgtgaggcactgagaaggataagacatcagtttgaaaagagcccctatcagagcaacatgaactctgctaaaattcaagtaagaacaaacatccaatttatggtgaaacctggttggaagaatggtgaaatcattgatgctttacaaaaagtttatggagtcacacctgtaatcccagcactttgggaggccaaggcaggcggatcatgaggtcaggagatcgagaccatcctggctaacatggtgaaaccccacatctactaaaaatacaaaaaactagccgggcgtagtggcgggcgcctgtagtcccagccactcgggaggctgaggcaggagaatggcgtgaacccgggaggcggagcttgcagtgagccgagatcgcgccactgcactccagccttggcgactgagcgagactccgtctcaaaaaaaaaaaaaagtttatggggacaatatcccaaagaaatcagcagtttactaatggataactcattttaagaagggctgagacaatgttgaagatgaagcctacagtggcacactggccatatcaatttgtgggaaaacattcatcttgtttgttccctaagtgacgaggaacaacattcaacagcacaaacaatagccaacaccatagacatcacagttggtttagcttacacaattctgactgcaaaatcaaagttaaacaaactttgtacttgatagatgccaaaactgtcataccctcttttctgaaagattttatgaaaaaacaaaacaaaaaacattgtactcaaatcagctgcagataaaagcagagcttccagtggaaattttacataactgggatcaagatcctgaaacatggctgggtggagtggctcacacctataatcctagcactctgggaggccgaggcgggcagatcacttgaggtcaggagaccagcctggctaacatggtgaaaccccatctctactaaaaataaaaaaattagctgggcattgtggtgggcacctataatcccagctactcgggaggctgaggcaggggaatcgcttgaactcaggaggcggaggttgtagtgagccaagattgtgccactgcactccacactccagcctgggcaacagagcgagattgtcaaaaaagaaaacaagatcctgaaacatttcttcaaagaattacaaagaattgtaatggagatgaaatatggctttaccagtgtgatcctaaagacaaagcagagtgaaagtgatgcctaccaagaaacggagtggctccagtcaaagcaaaagcagaccagtcaagagcaaaggtcatagcaacagtttttttttgaatgctcagggcattttgcttgctgactttctttaggaccaaagaatgaaaacatctgcttattacaagagtgttttgagaaagttagctaagatgtagcagagtaactcctgggaaagcttccccagagattcctccaccataatacttctactccttcctctcatcagacgagggcaatttttcgagagtttcaatgggaaatggttaggtatccaccttacagtcctgattgggccccttctgacttctttttattttatgagacagtcttgctctggtgcccgggctggagagcagtggtatgatctgcactcactgcagcctccacttcctgggctcaagcattcctcccacctcagcctcccaagtagctgcgattacgggcatgtgccaccacacccagctaattgttgtattttttttagagatgggtcttgccatgttgcccaggctgtctccccctcctgagctcaagtgatctgcccacctcagcctccccaaatgctgggattattacaggcatgaaccatggtgcccagcccttctgatttattttcgtttcccagtcttaaaaaatcttgaaagggcactcttttttcttcagttaataatgtaaaaaaaaaaaacctgcagtgacatggctaaattccccagagcctcagtttttttgatatagactaaaatgctggtatcatcacttacaaaagtgtcttgaacttgatggagcttatgttgaataataaagtttatgttttttcttttttttctttttctgagacaggctggagtacagtggtgacatctcaggtcactgcaacctcagcctccctgggctgggctcagatgattctcctacctcagcctcttgagtagctgggactatgggggtgtaccagcatgcctagctaatttttgtgttttttttagagaaggggtctcaccatgttcagcccaggctggtcttgaactcctgagctcaagcgatctgtccgccttggcctcctaaagtgctgtggattataggtgtgtgccgccacaccagccttattttatcttttaattcaatatttccatgaactttgaagtcactttctatattatatactagtggctttcaaactgcaagtcaaaaactagtggttataaaattaatgagtcatgaccattctttttttttgtaatcacatggaatagaatatatcacagggcattgcatgtagtccaggtgattatggtttcatgaaacttttgttttgaaatacaatataaacacatatacatacagacatttgtggcttggcttgcaatgccaaatgtatttttagtgtgactcattgtcaaaagtttgaatgtcaaagtgtagctttgaagatactcttctgttcgttaacccctacaaagtcttccccattgcctgctgaataaaaagtctacatcttttggctgggtgtggtgactcatgcctgtaatcccagcactttgggaggctgaggtgggcggatcacctgaggtcaggagttccagaccagcctggccaacatggtgaaacactgtctctactaaaaatagaaaaattggccaggggtggtagtgtgcgcctgtaatcccagctactcgggaggctgaggaacgaggatcacttgaacctgggagacggaagttgtagtgagccgagattgcgccattgcactccagcctgggcgacaagagcgaaactccgtctcaaaaaaaaaaaaaaagtctacatcttttaacccgtcaaatcaaggaaacattgaacgtcacaatctgcctcttcagtctcacctcttccttaaaggtgtttgctaccccataaatatattactgctactgaaacaattttatttcactttgttttcatagaagaggtgatggactagtgctgatttgaaacatctcatccagtcattaaaggcttatatttgcaagctatcttgccatgaggagtacagcaattataaaaacaaagccagctctctcattctgtggcaataaaaaaaaggctgaatgtgttctcctaccttataatcagctgccaatgctttgctatttctctcccaagaaaattcattgcagttaaaattcatttatagttgacaatgaccattttccttattcctttctgctttcttttcaggtgtgctatacttatgtttcaaagagaatttgccctccgactggttgcaaaacctggagataagttatactgcagactctcaattaatacacagctgttggcacgtgtggaccatctaatgaaagtaagtgaattttgttttctttctcttttttctgagatagaatctcactctgtcacccaggctgcagtgcagtggctcactgcgatctctgcctcccatactcaagcaatcttctcgagtcccgagtagctgggactagaggtgtgcgtcaccacgcctgactaattttttggtattttttgtagacacagagttttgctatgttgcccaggttggtcttgaactcctgggctcaatgatccatctgccttggcctcccaaagtgttgggattacaggtgtgagccaaagcacccagccagtgatttttattattgaaataatctagcttaattcatccttgagcatccagttgtgccttctgtgaggatagcatatctggttactaaataaaagttgcctttgtgagtactacttaaatactttttcattaacaggtgggaaagaataacttcagaccaccgcccaaggtggaatccagtgttgtaaggatagaacctaagaatccaccaccacccatcaattttcaggtgaggttaaaatactagctcattcaataaaggaaaaaaaagtccaggcgggaagatgtgtgcctataacagcagaaaaatattgaatcaacctaaatattcaaacataggaaaatgttaattaggacacatccctgtgctgaagtagatggaataatttgatgcaaggtagttttgaagtgagacccagtctcaaaaaaaaaaaagaaaaaatggaataaaactaggaaaacaaggtaaaatgaaaatagttgttttaaagtagtattatgggtaacatcttttcattgtaattgttttttgagatttaaaaacaagaaagaagaccacttgatataaaaccttactacagccacattagagaaaaacgtgattgtgtgtgtggtcaactggtggtaaatggagtggtttgtcaataactccttcaaggaggtttaggtgtgttacacaggaagtatctgaagtcatgtctgttttgaatcttatttttgaaaatgatacttagatttaaataaacgccatgttctttgttcagatgtgggaccattttgtttttccttccctttctttttttaagatggggtttcactatgttgcctaggctggacttgaacttttggtctcaagcgatcctcccacctcagcctcctgagtagctggtactacaggcatgcagcactgtgcctggctttattttttcaaattaaaaaaaaaaattgtcatgctttgtcaaaaaaaaattctgaggaaaagacatattcagtgaaatgcgccaaagtgcaaaaatcaaatgtatgtcttacttttgcatgtgtgtgccagccagatcaagattacagaacattttcttcacttcagaaagtttccttcaattgtatatattaaaagacaaaataatacctagtgggcatagacaagaacaagaagtttgtaatttgaagaaaatgtctatcttctatttcaggaatgggatggtctagtaaggataacctttgttaggaaaaacaagacactctctgctgcatttaagtaagtattacactaatttctaatgtataaagggccagtgctccagatactatgctagaatttggtccttttcctgagcagctaccctaaagcataaagattatgggtccagacaaacttcaccttttaaactatctttagagcttgggaggctctaaagcaaacttaatgaagaaagtttgctggagttgagagtcagatcacattttttggcaaaacaggaaaacactcccaaactctgaccatatatctgctctagttttttgttggaaaaatgaggtgatgatggaccccttccacacttgtgaaggatatgtgtcatgtaattaacctgggaaaatgcagctcatcaatttggggttcaagggtaaaagagaggtgagacacagttttacagggcttggagatttttttttaggggattttttgtggagagtctagaacttctctaagaatttaagaggtattaggattttgcactttaaatatatttagtgtttgcttcataagtttaaatattcaacaacttttaaaattccttaatttcaccatacagaatatagatttaatttcatctaaaatgaaattattgcttaaatggcttatgtattagttaaaaaaaagtttaaaaaagtaagaaattactctgactttggaataataacagtggcatcacttctttatgctatagatcaagtgcagtgcaacaactcttggaaaaaaactacagaattcactgttcagtccataatattgtaagttagaaaatgttcctgcagtttcattgatttgttttcttttaaaatgtccatttttattcttgttgatctagcatgagattattttgtacattccataagatccttaaaagacaatatataatgtataactagcacaattttgacttgaattctgacaggtcagtgctgctgtgtatcctgtgaaacagatatgagcaactttgattactccaccctgtcctctaactactgacagttgtttttagccataacaagaatcagattcagcagttacaggttcctcaaagctgtagatatgtgtagcttgcacaacttaaaataattgtgtagtttactgtcctctgaattgtgaccacgtcttgtttcttgctcacatagcagttacaaatatagttattactttctttgtatagaaattgaaataaagttcatatggctcaatagcagatttctggttgtgagcctcatgcgtatcatttgtgtaacagtgtgtgcgatgtgatgtttgctatctttttagcttccagtttaattagaacagagagagaaaggccaattttctttttattttttatgactcagaacctatatggtttaatgtatcacaatactatctccattttctcttttatgggcaaaaagtcattagataatctgcctaagtataatagaaaaatattaagctagattaagaaaaatatttggataaaatatgtgaattaagtgtaaaatccttttggataaaatatgtgaattaagtgtaaaatccttaatattcccaaggcttgggcaggtcacctctttgagaaaaatgaggtggttaaggtcaaatctgtaggaagaaaatgcattattttgaaaggagtaacaattgctttaaaatttaatttacagttgtaattatttgtgaagtctgaaactaataactatttcagaattttaaagaagaaaatggctaatatagacaggattactaattcaaggtattccaagtttttgttaataaagatcagccacttttaattagagatccaagtcttaatgtaaaaatcaggctttccaaagtctcattaacagatatattaaaggtgactattttatgacttactgaactaaaaaaaagagtcaaggtgacctcattaaagatatgtcgttcatttattctgaatcttatattgatagataataccagaagatttcagcatagcagataaaatacagcaaatcctaaccagcacaggttttagtgacaaacgggcccgttccatggacatagatgacttcatcaggtaattacatttttgttttcctaagtgtttacatttctttactgtgacaccttcagattggagattttaaaggcttttaagcggtataaggtgctacctgggagagttattgcatagcacttccatggcatggaatagtatttggtgtagaagatggaggctagttagctgcagcagaatgaacattttctttaagaacagtagtaaagaacagtccgagccagaagattgcctttgtgttaatgtggtgtgcaggttccaatgtggtgtgcaggttcctcccttcctgctccttccccaactctcattcatagtcttagtcttaatagcttatccctccaaaatagtccataaggtagaaaaatcataatacatgtaactggatctgatttttaaaatttccttactgggaatagctgttgttaaatcaatcttaagcatacaataatgccagttagaatcctacctggttatccatttaggaataatacagttttgtagcctgaagcaagttctacacttctcaagtaaaaagctgtcataattatctaggtaatttagaccaaaatttgttttgcttgaattaagcaagtaagtcttatgaaaacagaataaggcttcaattaattacccaggtaattactaacctgtacttactgtttttaatcattaagatgttaactttcagaaggtcttgcctatttagccaattcacttttaaagcttccatgttctagaggctgaataaaaaatgagagtagattgttctaaaagtcattggtttgactttttctaagctggaaacacagttctatataactaagacaaatggagtttatattttattggctggctagcagtactactgagtcattttagatgttaatcctaggcattgaatactattcataaatatctactttgcttttttagaaatttatctggacctgtttctatgggccagcctaaacataacctcaggtctaaagagaaatattttctctttttcttcattttcactaaatttcctcaaagttattgggcatgtgcagtttactaactagaatctattaagtacataggtatctacagagagaaacaatgtgtatttaatttgaatataaacaacagctcaagagaggaagaaggggcatgtaagattggtttttcatctgacttctgccaattccaaacagcttcttgttcagttaccttgaaacaaatgccagtgagttcttaggcctgggataatgaaagtctaagataattttagtcaaattcattacgacataaaggctctaatgaaagaggcaccaacatggcatggttttaaccaatacatatcttataaatttagtcagacaataacatttcttttttttttttttttgagacagagtcttgctctgtcacccaggctggactccagtggcacaatctcagctcactgcaacctccgcctcctgggttcaggcaaatctcctgcctcaaccacccgagtagctgggattacaggcatgtgccaccatgccaggctaatttttgtatttttagtagagacggggtttcaccatgttggccagactgttctcgaactactgacctcaggtaatccacccgcctcagcctcccaaagtgctgggattacaggcataagccactgcgcccagccagtaacgtttctttaataactagtattaggagtgggtgggctctgtaagcatgctgtattcatgttttagtattaatggtatagaactatataccgttatgtgctacaaattagcttttcagtaccattccattttgatttcttttttcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatatgcttcactagtcacacattccccataccatttcgtgttattcacattccccgtaccatttcttgttattcacatgtacagtaaaacaattgtttcttaaatta

SEQ ID NO: 37450 - DNA, 12424 bp, Homo sapiens; identical to SEQ ID NO: 37310

SEQ ID NO: 37451 - DNA, 6786 bp, Homo sapiens
atgaccatggaggcttctttcagagccctggatgcattcatttctccttcggctgcaataacctatggacaggtgaaaggaggggttgaactggagaaaacctcatggggacacacagcactcttcaaccgggggtatgtatacctcaggtggtccacaaaactttctagggcgtatgccagagtagttttaagaaaatcaatttctacatactcagtttccatatgcttctttttctgaaactgacttgcctgactagtgcctggatcaagacattctcttttactatagcctttctcccattttccagggtaacaaacaaagggataattcaaaatactgtgcaggattgagaaagcaagtaactttaatgactgcaggcaaatccttttgcaagtcagcagcatttccaattctctgatgagtaccttactaaactgaaagctgacaggtcattataaatattttttgatgaaagactgtgatatgatttttttagcacataaattcaaagtgctaagaactgtatgatactactttaaacagaacttccatttccatctacttatttatgtaaataaggtttcaaagtccttatagctataaaaatgaaaaataggaataaaattgatgctgaatcgtgtctcattctagcattaaacaacagccatctatacatgtacgatttaattctcattcatcttataaagacaagcatttctagtaaaaattgacttctggtactgggtgcagtggctcacacctgtaatcccaaaactttgggaggccaaggcgggcagatcacttgaggtcaggagttcgagaccagcctggccaacatggcaaaaccctatctctactaaaagtacaaaaattagctgggcgttgtggcaagcacctgtaaacccagctacttgggaggctgagacaggagaattgctcgaacccgggaggttgcagtgagccgagatcatgccactgctgcactccagcttggctgacagaatgagaatctgtctcaaaaaaaaaaaaaaaaattgacttcttatttaggagaaattctgaaatgtttgtagaaccttgtttttagttacaggaaatttttaaaaattaattctaacttatggactaaatatgttgcagtatgttaataaaataattcatgacaaaatgtatgttaggaaaagaatctggcggaagtgaagatgcaataaaaaacttaggtttaagaagaagaagaaaaaaacaataaaaagctcctgactgttaagagtttacttacatatttttaatggataactaaatcattattatttctcattgggtacatttaaaagaatgatgttaacagttttatttaaaaatgtcaatatttacaacatgccaggaattatattcttggcaagtacataaattcaagatgaaaaatttttacatgccgatttaaaatgtttgatggactttatagtttttctaaattctgtaaggggtttcacaggcaaaaaagtttgaagatcactcgagtagtagacagaacaggagttctggagtcaaatggacttgagttcaaatcccaaatctaacatttaccagccgaatgtcctcagagaggttactgaacatcctgaacctcagtttcccattcttaaagcagactaacatgtacttcagaggaccacttgtgaggaagacagagaaagtatataaagtgttaaatgaataaagggggctattatagaggaatggcaagtgacaagacctgatttttgggtccaactatgctttaatgcacaaaagattcaaggtagttactttaattcataatcctagaagaaggaaaggtattaagacaccataattatcaagattaaaagtacaatttctccaggttattatcctcacttgaatcttgaataattaatggtccataatactccatgaatatcagaattggaggtgatggtcttatgcccagtgagatttcattcactcacacagcaaaatttgggggccttctagggttaataagccctgtgtaggaaaagctaaggatagagtggaatccctagccttcttcagctcctggtcaggtagggaaggcagacatggaagtagatcatttcattctagtgtgataaatgctgacagacatatgtacaaggcacagtgcaagcaaacagaagaaagcaacttttccagagggtgacgtggtgaggttatagaagttgaatattaaatgataaaatgtttgctgtttagaaaaagatgaggaagaatattttgggcagaacacatgaaacggtactgaggtataaaaatggtatattccagaaaactgtcaatggctgaatactatggcaggaagaggggaaaggtgggggatgaatggggccgggttctgaagggcagtgagggccagggtgtttggtcttcattctgtaggcaatgggaagctgcagaatgattttaagcaggtaagtaaactccatcagatctagtttgaaaaagctctctgacagatgtctgaggttagaagagaaggcagtgaaagctgctagtggaactgctttagagtggccggtgcgattcataggtggtggggacagagaatgaaatggtttggggagctattctccctccccgaaggagggcgaatcagtggaatttggagactaggtaggaggaggaaagggggacacaggctgagacccaggtttccaggttttggttgcatagattagtgccattaatggagataggatacagaatatagtactcactgagagaaaggatccagcttataggataaaaaccttaatttatcaaagccacacatcatgtcctgcctaggtctgtgagaagggacaagtgccagctttgctcaaagaaaaccacagaactgtattccaaggtaggcactacagagaatacatcagaaatcccctgctatgagagcagcaggctctcattttttccatatcatctcagatgtccaattaggcacttttttctttggacatggaccaactgaaaagatatctcatttcccaccaccaatcaatacacaatcgcttggctgagaagccagacccaccgggctgggcacacattttgttcatagaaaagccacactgagcaagctgccaaagatgtaaacaacaccaccggctttgtctaaatacaggccaagtacactccgttgataggatcttagagagcaaagcaagctatttgtgggtgtgcacggcttttgtcgaatgtgcagtaatctcatagcaatcaacatttcatatttatagaacatcattttaaagtctggcattttcatgtatgtgaaattggtgctacctgtcccttctgcagaccaggtggtctgggcagaggaaaaggcagagaaaggtgatctgtatttctgcactccatcctctcaattaatagacttctacacccagaaacatgagcccaaaagcatgtgccaggtgtttttctgagagttatgaaaaggaaataaaagctgatgcaaacacaaaagatattacatttcaggccactaagagctggtctaaacactttaaaaaccaaacctaacatacagagaaacacgtaggagaatctgtcctcttctgtgaccggcttctttcactcaaattatgtgtgtgagcacttacattcattctctttgctatgtagtatgcctacatgtgaataaaccagacttcattcattcagctaggaatggacatttgggtattctacagtttgggtcaatgtgctgctgtgaacattctagtacatgccttttggtaaacatatgagtgcatttctgttagattcatacttaggagttggagctgctggctcatagggtatacaaatgttcagtatgaatagacattgccagactgttttccacagtggttgtattaagttacactgccaccagcagaatatgagagttctagttcctctctcacccacacttggttcttttccgttcttttcaggccattctgatagctgtctagtgtgacatccgcttataatgtgaatttgcatttccccgatggctaattagcctaaggaatttttctataaagtctcttaatctttagattattccactctatctcacctttcctgtgcaatttatttgttgaagaaactgtgacccccctattttccatgagaatttcaatacaataagcctatggttgttgcagggttactgtattttacagaagggctaggctcattgtgattctatgtgtgaactccaagacagtcactgcccaggttcatgagactgcttctagactaaccctacagccccgtccaagtgggagcatggcaattcagaattctaagcggtttcttctatcttttcttactgttataaagggaagatagaaattttctttccaaactcttaagaatgctatggaagaggctcatagcccatcctgggaagtcagtactagaggaggcaatgaggagcagaggggaattctaatttccactgctactaatcaactgtgcgaccttgcggacgtcacttaacttttcagagcttcaatttttcctttgaatagtgggatggcaaacaagtttcatttttttttaagtttttattattattaattttttatttaatttaatttttttgagaagaagtcttgctctgtcgcctgggctgaagtgcagtggcgcaatctcagctcactgcaacctccacctccagggttcaagcaattctccttctcagcctccccagtagctgggattacaggcgcctaccaccacaccaggctactctttgtatttttagtaaggacggggtttcaccatggtggccaggctggtcttgaactcctcacctcaggtgatccacccacctcagcctcccaaagtgctgggattacagacgtgagccactgtgcttggcctcaagttttgttttttagagctaactctaagcagttgagggttgttacccagagtgctatagaagggttctgaggccaagtctaagctcagaggaaaacagtgctgtggttaattactagcatgggaatagcaggatggagtgctagcatctgggctaagtgtttgccacctatggaagataatctctgaggatcctttgggctctgacattctacgtagtatatgtatggtacattctactattcaatctggtttggaaatgaggcttttgcctaataacatattctagttaaaagcaattcctaattttcaaaataaggagatgatagggcacatttaataacatcgtaaacataatttaatcttctaaacgtaacagttttgaaagaaagcactagagggttctgtagtactaccaggttatcatcacaaagcaacaatcatcataccaggaaaacctaaacattttggttaatgcaaaattctgaagtcgcatgtcaaatgagctactatcctatttgatgctggctaagaaattatagtgaccagtttgtggcttaaagggcatcctaagaaaagaacagcgttctgtggtcagccagtgatgaccagctactactattttctaacaacaaattggtttgctccttgtgtcttgggagatttgtcaagtccacagcaactcctcctatgaaaactgctcttcttcttcagcccattcacaggcatagggctgtggaaccatattattatgctatctttgcactttgaccaaagttggaccaaaaagactgtctcttctgtgaatgtggaattagggctggtctgtgttctttagtgttcacctggcagacatctaaacctgggagctagacattctccaccacaagctatctacagtgagatgtggcacaggaaagggaatgactagttccctgaactgccttctggttccaattttggtgagacttgcccctacttcctacctttgggtttggtgagatatccctgaaattttacacattatcatctttaaagatactcttttctaggttaggttaacaaatatttcctcagtgcctcccagaggggccatgccacccatgcagggttaagacataggcagatgatgatgaaaagaaggaagaaaaaaggcagatgtcaaagtaagagaatataaacaagaggaaaagagagaatgaggaataggaaacagtaaaagggaaaaagagcctgagaaaagaaacagaacaaaaaagaagccaaaaataagtaagagatgggtggtatggatggaatgatgacccacttgctccgaagttggaactgttaatttgaccttaatatggaatcgggagaataagtatggtacacacagtcataaaagaatgaggtaactctacatgtactgatacgtccatagatattaatattaaatgaaaaaagcagagcgcagaacaacatgtgcagtataaccctacttttgtaaaacaaacaagccagtaatccaaaaacctggtcaaataaaatccaaatacactcaactgttaggagtggtgacctctgggggaatatgatttgaagttacggggagggttttcacttctaactttaccacttcaagattatttcaagtttttacagcaagcatgttttacgtttttttataattattaataaaagagaaaactcagtaagaaaaacaagtttaaaaaaaaagttaccttggcgcgggcctcgcgggacgcttctgcttctgcagccatagctctctggagctgcacaggtagtttcacatccttaatttccacacgctccacctttattccccaggcatcagtg

SEQ ID NO: 37452 - DNA, 331401 bp, Homo sapiens; identical to SEQ ID NO: 36483

SEQ ID NO: 37453 - DNA, 30121 bp, Homo sapiens
cggagcgaggcagcgcgcccggctcccgcgccatggggcggctggtggctgtgggcttgctggggatcgcgctggcgctcctgggcgagaggcttctggcactcaggtaggtgggactcccgcgcgcccctcctcggcggtccccaggctcggggtggccgcgtggtgcggggagggcgcaggctgggggagggattcctgcgggacctggccctgcggccgggggtggagaatttttgaatgctgtccctcccccagctagttgaacccccatcaccccgactctccgcttctagtgaaaaaactagcaaagtttggagtgaatcgcgacactttcttgaaagtttataagcccttgctgctaacaaagttctcttctgcttaggctgacaagagaatgctttgcaattacccaagggccaaactagtggtttaaattgaaaacaaaatgactactcatgcattgaaaccttaactatgaagatttatttcaggtcattggtgctgtttctccttgttgcccaaaccagacccgtctttaataaagttgttctccacccatttctgcatagtttgagaaactcttcagctgtagatcaaagacacttgaaatattcagctactgttcttacttcctatttattcaccagggaagcctgaagccagaatgccagacagcgcagacactattccatctcgcattttagttttaatgaaaatctctggtaggtagacatcatcgtttataaattaccaactcaacgtttgttttttgtttattttattttttgtagagatggggtcttgctgtattgcccaggctgttccctaactcttgcactcaagcaatcctccagcctaggcctccccacagtgctgggattacaggtgtgagctgttctgccctgcctcaaccaaaattttataggcctcatgcaaaagagttccagaaagactgagcacctgctatgtgtaatgttctctcttaggcttctatagtagagtacgacccttatggagtttgatacaggggaagagagaattaaaatacagtaaatgtataaattaggatgttctaaggacagacacaaatgaaccgcataggcttaaagaggaaagattccatcccctgagggtggagttctagagggaggaagagacattcgacctgaccttgaagggtgggtgcaacacatatgagcatgaaggggcccatgccaaatgtatagtgcagcaggagcaaaggggctaaggtgggaagttggaagactagcaaatgggccaatttgaagggagcataaagtcaggagatgagaatagtagggtggtgggaaggataggttttgaggccattaaatataagttgaaaaatggggccccactttcataggcccaatagtgcttcaaaagggaaatattggtgggttttgcttttcaacaagaacttaatataactagttgtgttttatagagataagcctggaaggggggattggaggagagcaatggttctctgtacattagaatctcctggagggctggtgtctgagtggcaccaccaaagattctgattcagctgttctggatcagaatctacagctcacacctgtaatcccagcactgttggaggcctaagccagaagattgcttgagcccaggagttagtgacaggcctgggcaacatagcaagatcccacctctacaaaatgaataaataaataaataaataaataaaaaacaaaatttgagttggtaatttataaactatggtgtctacctaccagagatttttcgttataattaaaatgtgatatggaataatgtattgtttggcaagctggcttcagggttcccaggtaaatagataaataaggaagtgcataatgtaagaacagtggctgacagtagcagtggcattttttatttttaaaaacattcctgataattctaatgagcagtcaaggtcgagaactactagaatagagagcagacatggggtaactggttaaggtattgcagtaggtcagagaggataacagggacccaaactctggaaccccagggatgagggagaagtcaaaggtgctaccagagtttgtgccacagctccactgtcccatggttgtagtttcatctactgataaagcagtgcaaagaggaagcgtgtggtggctgagatgggagtgagatttgaggaaagaacgcttatgggtaggaaatggacatgttgaccttaattttcatgttaggtaatgcccattgtgctctacagaacattcatgagttggatgactttgtatatgatctgtcctgctctccatttcaaaggcaagaccaccaaaattcacaagcttattatgttgtcactaatgtgtaagccaccagtttttctgcaagttggaagttttctcaacagtcaaatattcccccttctcactaatcttaaggttttaaagttatagctgcaaatctaaaaaaaaaagaaaaagtaaataaaacttattgacagaatgcctgatagtttatttacaggtttttgtttgtttgttttttgtttttctttgttttttattttgacacaaggtcttgctctgccgcccaagccagagtacagtggtacatcaaagctcactgcaatctcaaacacctaggcacaagcagtcctccctcctcagcctcctgagtagctgggactacagatgcatgctaccatgcccagctagtatttttatttcttgcagagacagggtctcactttgttgcccaggctaatctcaaactcccagcctcaagtgatgctcctgcctcagcctcccaaagtggtaggattatacacatgagccaccaccctcggcctactttacaatttgatgcaccttttctttacgtgactgtgatgcactttaatgggcagtgactttataaaatggtaactttattggatatgtggagccccaaatgggctgacgtgagaatgttggggtaggtggtgggtggctggatttagcaaagaaaaatgtaggctacccagttaactttgaatttcacatggatttttttttttttttttagtataagcatgaaatacttataccatacttttagcattaagcgtggaatttgggacataattatactaaaatatcattcattgtttatctcaaattaaaatatcactgggtaccctgtattttatcatatgttcgagtgccttctgtcagaatttggtgaccctttgagtctgttttaaaaaggagcatgtttggccggacacagtggctcacgtctgtaatcccagcactttgggaggctgaggcgggcagatcactagaggtcaggggttcaagaccagcctggccaacatggtgaaaccccgtctctaataaaaatacaaaaattagccaggtgtggtggtgcatccctgtaatcccagctacttgggaggctgagtcaggagaattgcttgaaccccagaggtagaggttgcagtgagccaagattgagccactggactccagcctggacaacagagaaagactccctcaaaaaaaaaagaaaaaaagcatgttcccacctccccataaggaaaggctcttcagaggaagttgaaggaacagaggctttatgtttgatttttgctttaatctgatgcctactgtttgattattcaatatttagagatggtactttggcaatcaagttatttctctccccaggttgcccacttcaatttttagtataaggatgtcccagagggataaatgccatcaaagttgtctttcttcttctgaactgtaactgggattccacaccctccttttccacccctccctagttgagcaataaaggggaaaataacagtatacaaatattcccaggccagttcctggtgtcaaggtacacagccatggatgaatcatgaggcttgagtgcatcagagacctaagcgtgggcaggaacccccagagtacccatgtgaatgttctgcttgctgcctcgcaccttttatgacaattcccacaagaagctatgtggtctgtttctacttctgaaagagcagcctttttcccttttttttttttttaaaccaccatcctttaaatcatttattatgtaactcttgtgtgctggtcagtcagtgtgtcaaaagtgtaaaaacttctttatttatttttttaatctatcttttaaaaaatattttctttctttttttcttttttcttcaaggcaggttcttgctctgtcacccaggctggagtgcagcagcacaatcatagctcattgtaacccagaacacctgggctcaagcaatcctcccacctcagcctcctaagcagtgaggactataggcatgcaccactacacctggctaattaaaaaaacatggccgggcacggtggctcattactataatcccagcactttgggaggctgaggcgggtggatacctgaggtcgggagttcaagaccagcctgaccaacatggtgaaaccccatctctactaaaaatacaaaattagccaggcacggtggcacatgcctgtaatcccagctactcaggaggctgaggcaggagaatcacttgaacccgggaggcggaggttgcagtgagccattgcactccagcctggcaacagagcgagactctgtctcaaaaaaaaaaaaacaaaaaaatttttttgtagagatgggggtcttgctgtgttgcccaggctgatctcaaacttctagccataagtgatcctaccgcatcaacttcccaaagcactgggattatgggtatgagctactgagccctgccaaatttctttatattaaaccaaaacgtacatttactgatatttggaaagaaagctcttttacttttatgccttcatccagtcttcatagatatcttcccttttacattataactgtaaatactgaggttagagaggttaactagttagttcaacagaataatataaatattgaataatataattaatgaataattagtgctgaacctgtcgcctcagccaggtctcctgattccaaatacagtttgccccagctccccacagtcttctagcttctctgccagtggagcaaattttccctaggtttacaggcctaagcacagattcttagttacttagtgcaagtattgccagagcccaaggggtgaattccaaagggtttttacaaggctatacataaaagataaagccctggcttgtatatcacttgcacataggagataaagccccagcagttgtatgtaaatttcaaaagcagagaagtatggcacaaagaaactcctgatagtaacactgtgttcccactttgcttaggggcatattggcaccgtagcatggtacacccttactgctacctgccatgaggccagataatagctagcagcccctggtctcattctactctggatgggtactgctgtttcctgaatgaaagacactgagattgatttcatgctaatgactgttggttaagagttcatgctttctattcacaatagcaaagacttggaaccaacccaaatgtccgtcaatgatagactggattaagaaaacgtggcacatatacaccatggaatactatgcagccataaaaaaggatgagttcatgtcctttgtagggacatggatgaagctggaaaccgtcattcttagcaaactattggaaggacagaaaaccaaacaccacatgttctcacttataggtgggaattgaacaatgagaacacttggatacaggaaggggaacatcacacaccggggcctcttgtggggtagggggaggggggagggatagcattaggagatatacctaatgtaaatgacgagttaatgggtgcagcagaccaacatggcacatgtatacatatgtaacaaacctgcacgttgtgcacatgtaccctagaacttaaagtataaaaaaaaaaaaaagttcatgctttgtggacaggtagcctgagttcattcatagctctactatttacctgaaaccttggactaattatttcacttttctgtgccccagtgttgtaatctgtaggatggggtactgcctgctccacagtgggactatgagaatgcttaaaataatgccaagcgcacagtcagctcaataaatgtcatctatgtagacaatgaaattcaagcataattccttaaacctttgtgccatacatccctttggcagtctggtaaagccttcattccttctcagcatcatgtttttaaatgagtaaaataaaatatataggattacacaggaaaccaattaaatactgctaccaagctatttaaaaatctatgatataatatgctttttaaattaaacccttaaatggatctagaggtaggtaaatgtctaacagcagatattttgaagttgcaatgaatgtaaatggcactttgagctatctacaactgaaatgcgatagaaaagtatctataatttctattagtgacagtcacaaatactactaatagtattgtggtttgttgcttatactcatcatcaaaggaaatactcaatttgagttaaaggtttaaataaagatgtatttttcccccatccaagttcatggatccctgaattctacccatggattccttggtcactggactccataggggtcacttggggaatgattgtgacaccaatgaaggaagccagcggatactgtttgctgtattatacctaccataggctcgtgatgaggaaataataaaataaataactgtaatgaaaaagaaaagaaaggaaaacaaaaggaacctaaaacagagaaggcaaatagctttccttttgagtgtcaattttaacagactccctgtggttgcgaaacaatgtgtctgaggctggctctgggttagagggagagtgctgttattgattagcaattcctgcatgacagcagagtggcaacagccatgcatctctgacctggcacagtcataagcatgttatagacataaagtgttagggaacaaataggctctagcaaaagtaaagagtgttcctcctctcatatcatcacttatatgtgtttataccatttatgttgtattttttacatgaatacttttagatttattaatctaatccaaaaaggtttgtatagctttctctatattaagagaaatatatgtatttcttaaatacacaaagttcttaaatctgatgccagcgaggattgcttccagccacaagtaacatatatcagattaatagtagttcattcaaagagggatttattttcctcacatgaaaaacagctctgtgggtgacccaatatagagcttgttcattgagccagtgattatatcaaggaactgggttcttcatatattttcattctttgatctccccctattgactttatagctgtatctttctcaaggatgcagaatggctgccgcagtctcaaacactgcgtgtgtgttcaaatcatgaagaaaggagattgagtgatgccagctagctctcttctcgtgactctcctttgtatctagaacacagtgtctttccccaaaacctgggtcatatgactacacctcaatacagcggagtctgggaaagcaaatatttgctttgcccaccactacaatagaaacgacaagggagaaagaaagggggttgggcatggcgttaattttgtcagccgctagggtctgccacccagaaaacagaagtccactaacaagcagggaactgattgttctgccagggaaaaagtctggcagtttcctactgaagaaatttggaagtcttgatggtccaggaaggataaaggcaaaaccttcattttcttttatcaaaaaggaaagccaagaaaaaaattagttaagtagaagttatgcacaaccctcatgtaactcttccatgttaatagcaggtaggctgcatatgaaaacatgatattatacaagaaaactagttgatgaagattgccctatttagcaccaattacttacgcaaacctaagttgactctgaaacaggaaccccatattaaacttttcaaacacatcagaatatgttactttgaacagattttatttaatccaaagagattatctttgaaaaaggtagatggtaaacatcgttatccctatttttgtatagtcaaataggcatagtagtaagttgtgtaaaattgacatccaaaccaatgcatgatactaaaacttggtgtacaaacagcagttacatcctattgctttgtatctacatctgtttctggagtcatataacatttgtagaatcttggaggtgttttaggctcatccttattttatccataaagaagactgacacctatagagattaactgacctgccaagggtcatggcagtttcactgctgagacaagaacacagatccctttacttctttctgagaaaagtacaaagtagtttaaagcaaaagcttccctgcttccagcacttctggctaagttgcgccgtgggaaaattgttttgtctgattcagttttctcatcttttaaactggaataatgctacctaatttacagggttgtttgaagaattaaatgaatgcatggaggtaaatcacttagaacagcggtaaattatacttttttattatttatttcctttgaccacccacaattatcatcagtgtcatcctcatcatcacaattaagattactaccacattaggctacataaactttttttttctctctctgttttataatttcaattttattttagattcaaggggtacatgtgcaggttttacatgggtatattgtctgatgctgaggtttggggaacaactgatgccatcacccaggtagtgagtatagtaccctatagtttttcagcccttgtctactcccttcccttccccttctagtagtccccagtgtctaccatcgtcatctttatgtccatgtgcaccattgtttagctcccagttaaagtgagaacatgcagtatttggttttctagcttatttttcctctcttaaatcacttctgtgacacgtaggccatgagatttattgtattttttaatgccttatttaaaaatttgtattatttaatacatttaatgcattattttttattatatttaaatattgatttatttgtactttttgccttattgctatattgtttcaaaaaatttaacattatttgagttacatgatttcaaatacatactgattaacattttaattagaaactttatgtctgatatgaattgccaaaatgtgtagttggtacaacctatgagtcattctgggttatctagaagaaactggtagcctgccccatactccagaagccttccccagtgtctagacctcagaagctgtcaggaatatgcacaggagaaggacacatggcaaatagctatttcgtctcttaaatgtatggtatgtgggaaccactgaaaaatgtaaagtttctacaaggtgctatttttattatttatggctctagagaacagagaaggtgaaaaatgtgagagagaagggaaagccaatagtatgtggccttcaaaacaaaagatcccacagatattgtcccaaactgcttcctggccctctagagtggagagggagggggaagacatcctattagagttcaacattctcttattatttccttcttttaattttctgggtatacaacagcaaatagttttgctgaagtagttacagaactagttggtgttctccaaccttcctattccaatacatactgtcatggatgggtacactaaaatctcagaattcactgctatatcactcatccatgtaaccaaaaaccacatgtacccccaaaagctattgaaataagataaatacattcttatttaaaaaaatactgtcatagggatgctaccttcttttcttttttgttagtaactatttgtgggatgtctttggtgtgtcaggctctgagcaatgccattttctcttggcttctttgcagtctctgtgtgaggcttacagtcatttttcacgtttgactcttcagaaggaagacagggctactggttctacatctggaactcttttcccacaacaccaacactgagaaatgtgacatggtgctgtgtttacatttgcataggaacttgcattataagttttatttgttgagttattggctttttttttttaataacccacatcagtatatagaactttgcaataggcatttttgttttaacttcatttctggtgcagttttattttcctacccttgtctttctattttctctttcatctgctttagacttaaactgtgttttatgtattgctgtaagcctctttaaaccctttctaaaacaaagcagggaatacataaacaaatagttttttgttttttgtttttttttctttgtaacagaaatcgacttaaagcctccagagaagtagaatctgtagaccttccacactgccacctgattaaaggaattggtatgtatatgaaaatgcttgttgggcacattgcattttttggccattaacattaaaacactcattaatggcattttagcatgaaattactgcttttcagtggataaatcacattagatcaacaaaaacctctttggtcaacctcttgatctgatgaaccctgtatttattcttctttcctaccctcactgtaaattattcttttttgtgtgtaattctatgtttagcatttgatttcttgcttgttttgtgacttctctgaactatttttgttgcgtctgtattgtttgtcaggtatggccgctgcagtctgtgttctgtgagccttgtggtcagctagtgaaggaagctttatgtaggcagtgacagcatttaccctgctcactactctataactaggatctgatcttatggctaacacgtaactgaccaatatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattgtaagtttcctgaagcctccccaaccacacggaacagtgagtcaattaaacctctttcctttataaattacccggtctcaggtatgtctttattagcagcctgagaacggactgatgtaccggcacttcacaatatgtattgtaaaaacttgtttttattttatcttctaagctatgactgcagagggggagtctccctcttcccttgactttatgtaggatgtattgtggagtctgagtctttgagtaggggttcctaagagcaagccccaattttgctatagataaggagggatctgtccagattcttctccagcactgagggtctctctggtgtgtttgcagtttttctccaaggtagagtctgtgtcttgctgtcttttaccctttatcatctactaagtacatgtccctagtacataatagactagtagttagattatcaatgaacaataaatattggctttccttttttttaaattttaattttttttttttttttttttgagaggtggcctcactttgtcacccaggccagaatgcagtagcgcaatcttggctcactgcagccctgatatcctgggctcaagcgatcctcccgcctcgtcctcccaggtagctgagactacaggcacatgcccccactcatggctagttttttatttttgtagagacagggtcttgttatgttgtccaggctggtcttgaactcctggcctcaagcaatcctcccagcttggtctcccaaagtgctgggattgcaggcatgaggcactgagcccagccaatattggctttccttagatatggttcatggtatgattagaaacaaaaagaattagcagtcaaaacacctagtttctagttctattctgccacaatgtaaccttaggcaaagttggtttttgtatttgtcacctataatgatgagtttgtgattagactaatggtttttagactttaaaaagcctgggaccatttatttataatcttactctgagagccacagtgtggaaataactagactgtcattgagtcacttctagtcctttacaacaacatccttctctagaggtaggagagacaatttaatattttgttttactctttagaaattaaaactcgggttacatggaaatgttctcttctctgaataggtaacattgttaaacaagttttgagtgtccttccatctttttctttttatgaatactcctgtacataatttttaaaaacataagtgaggtcaaattatgcataatatttcaaaactagctttttgtacttaatactaggttttggaaacttatgtttgtacataatgttaccttttcttcacaactgcacagtattttttgtgcaaagttcatataaacagtgtatgtgcaaacaatatagaaagatataaaatggaaagtaaataaaaataaaaatctctcatcaaactcttcatcacccccaacagaaataaccccaaagataaagctcccttttttatctttcctgatagtttcagtgcatttgcaaacaaatatattgactctttttttcacaaatagaattttagtgtaaatatttcacaaccttcttcattcctaaaacagtgtgagcagctttccacatcagcatatatagttactttgttctttttaatattttcacattccatgatttatttaaccattccccttttaatgtacatttgggttgttacagttttttgcaactatgaacaaatcagtgaacatcattgctgttgagtttgtgtgtctgtagaatatgtccttaacaatgggattgttgttcccttagaatatgtgtttagagttttgacagtcattgctaagttgctctcaatttggcaacagtaataaactcagtacctcatagttgtaaccacattcactccagacagagttctcagcactcttttagtaaaaataaaccatcagttgacagtgccaccttcagagtttctctacaaataccttgcttgcctccctttctttttttcttcttttaaatcagcttcctcaggttgatctgcctctcattccttaggcatctgtttcctatgtgttctttctcctttttttcattgatacttttgtatttccccagttctacctcccctcccctagactggttggctgtcctggaatttcccttccttctttcaattgcccaaacactaagtgggaggaggcaaactcatatcaaatagcagattgactacatctgtgctggatcatgcagacagttcaagagtcccaagtaacttagcagcttcatcttgccttccagctgcaatcaagaagagccctctcagaactggtcactcagcaaaagccagatggcattagtaaaagatgttgggcaagggtgggagtttgggccagtgatctcttaggttacttttgctgctgagttaataattgtcacattattaaacagcccttggccctgggaagcccaccttctgtgaatacaagtctcagagtagacaatagggcacaaccagccatgttacatgacagactgccaagtgcattcctcttacaactcactgggatggagcgctcctcagagaaaaacaagcccagcaacatttgtattctgaacaggcatctgtctatgtttgtgacctttatgttgtgatgtgtgtgagctgctgtctggaattggaaagaatgaggaaatatgtcacctatggcccctcttgtgaagtgttaaatgcctctgaggcacttcaaaaggcaacagagcggagaggatgagtgattagaagcacatttgggatacatttttagatctaattagaattgtccttttttttttcttttttgcttttgccctgtggttagcacacaccatatgaacgtttgtcgaatgctatgttagtgatgcataatggttaataataacttttggttatatatctttaacaacagttgcttattcacaggtctttgataagaagaaataacaatgtgctggacacacatttctatacaggcaaaagtgactttttatgatagagagggctgtttcttattttctgttttgaaaacagtagtagctatgcacttgaggccaactaatccctctaagaggtgaaccttccttcccccttgcccttgattcccatcaacacacacatacatatgcacacactaccgtgcttcagtcaccatcactggaagtgaactatgtgcaacttttgggtgctttatatatatcatatcatattgtgtctgctttaataaatcatagttattgactacatatcatacaggatgtgtgccttctgtgggtcagaaaataagttcactatttagtccttttcaaaaattccttcccgatctatcttatagacagaaactaagcttttatacacccaagatttggcagattaacatctgcatattaaaatgtcaagagctagttaactttatttgaggcttaaaagttaaaaaatctgattttctaaatgtctggccttcaaaatttgagtggactgtctttctcaagataactaacaattttatgcacttggcagtcaagacctttacaataactgctgcttgggagattgaggggaaaaaagcattaaagtttgtggcccttataatcaagtactttacagtctactgatgggagaaaaggaaaacaaaacaaaacaaaaaaccactgtgagatatagatatgtcttttctttctctagcagataagtacctgaggctcaaggaggttaagcaacttttgcaaattcactttccaatatagtgtcttttcccagggtgactaatgtatatacttgatgagtgaaccagaaaagtaggaaataatatgttacatatgggatgctctattgggtatagtaaaggatgcgttgctgttataaaattatagtcacttagaaaagagatgtttatttttatttttctctcatcagtcttaaggtaagtgaatggcctagggtagttaggtgactgtgttccatatggtcattcaggggcaaatgctgatgaagcaacacagctgtcttcatctaagactagaactctgcttgttgccatttcccagcaggaaggggttgaaagaaaatttatgtagatttttttttctacccagtagttgcatatatattgtattctcacatcctattgacccaaacttagacatatggccacatctgtcagccagaaagggtgggcaatgttatctatagctgtgttgctacgtgcctattgctaaaaaggctaaaaaggaagaaggggaacatggatgctggtgaacacttggccacctctgacacagataattgctaaagtaataagaagagatggaaattaaatgtgctaagctaggagactttctaaagaaagggtttgtcatgctacgctgtgccattcatgtgtttttttgctcatgctgttccttgtgcctggaaattctccccctaattcccctgagcagtggatgcagtggataccctccccagatcccccccaacttccctgagtgttggctaccaaaagctctgagtgcacccagggagctaagtcctcctgcccacaggcaataatggactgacacggggtagacttaaagaaataagaggcacatcaatcaattgaaatgtgtgggaccttacctggactctgaattaaacaaactgtaattttttaaagctacaccttttaaacatgattggctatttgaacactaactagatatttgatgatattgaggaattattgtgaatttttagtgtagtaatgatattgtggtttgtataaatatatttagggataatatgatgcctcagatttgctttaaaataacacaggatgaggataagtggtaggactgcaagggaaacaagactggccatgagctgataactgttgaaggtgggtactgggtatataagggctcaccacaccattctcttgatttgtgtctatttcccataataaaaagtttaaagagagagaaccgatgaaggggagggagagagtcaagcacacaataagagtgacaaacagtgccaaatcagcccacagtattaagttttcacatatttacataaatatcacctggaatgcaatattgaaattaatgtatatcactagaataaaaaaagtaaagatttaataaatttgttttgaaataaaataagttgaaatacgaaaaagacagaaaaggttttgaaagaggttttaaagaaaagtgcaggatattcattggtaaagatgttggtgagaggcttggaagcaaaacttcaggggaaaaagacaacatatggaattgaccacaattgaatttacaagtgaagtggctttacagaggaatcaggggatgtttctgagagaggaaattcattaaattctaacttgaatattttctgtttgcctttaagtcagagcaaaggctttgagtcccagcttcccagtttgtgaccttgagcaattgcttaacttttccaaagcctccaatagtcttcactctaaaataaaagataatcatatgagatattgtatgcagggtatttacaaggagcctggtacttggtgtacctaatgtatgttagttattattattaaattagaggagcaaaaatttctctagcattgactgctcctgacataatcacaccgaagaggggatacacgatgataaaaccttcctgcagtagtggctatagaaatgatgacggggagaagatctggaaaatattccaaagaaggctacagatagatacattttttccattggaattaggcaatggagttaaacagaagttacaatatggttgaaataaatgtatttttttaaaaaaagatttctctttccttaattattaaaaaatatacaattttgtagaaaattttaaacaaagtataaagaaaaaaataaaaatcattcataatcctatcaaagaagcattgttaattttttctatatatcttctttttccacgtgtatacttggaaattaaattttctaaaataattttcaggaaaaacaaattttaattaattgagcttctactaaataggactgaaaagcaaaacctggactagaattctctctcggtgtgtgtgtgtgtgtgtgtgtgtgtgtgtgtgtgtctgtgtgtacatgtgtatgtgctgtgtatacatgtgtatgtggtgtagcgttcccctgattcttaacttattaccagtggacaaccaccgtggaactagagtctagtcattcttaacctttttgggggaatcacagtctcttttttgaatctgatgaaaatcaaggaccgtttttacagaaacgttctcatctgtgcatacatgagacattttgcattgcatagaatttccgagggttcacagatactttgaagcccaaaagtgatccacagaccccagattgagaactcctccgctatgccatgcttaagcttatttctgtgtatcttctttctgaggagcaggcagatgggtcatctttacaatgtgaagttcttggcatttttattttgttttgtttttctgcactacgatggagcaagcaacactggaggcaactggctaaatgcaaactcatgaagcaagaccaaaatggctggatagatagatgctgtttggttttgacaacctagaaataaccttgaagaaatcctatggagaagtcttaaagaggaagattggattttgtagactcaaagaatgtgtcatggtttggcttaatctaagccatttttattcttcttttcttgtgtttgggtctattatctgtctgtagaatttatacagtgagactgctggggaaagtcttatgtctaattatttgctgtgctgtgtggagtgtactgcagacagtcaataaacaatcaatagtaattgtagcctgcctcagagacaggagttagaaacttcaactggcttaggtgcatggtatttttcattaattttcttctgctagtttttttctctaatttaaagcctaaatttaaagattaaatagaaaagctttctttgcttatgagcacaagtaggcactgtttttaaaagaaggaatatataatcccaggtgttttacctctgttaatgagaaagatgtctgtttgcttcagattgaatgagcaaagaagaggacaaggatatttgcatggttaaatgcctatgagcccttccttcagaaagtaatattcccctgatgtcaattacttttatacggacatctggatgtttatcatgagagtgtacagatgtcaactttttcagtattatagctggaaatgtggtgataacttgactttgatttgagtaaacataaaatatctaacatttaaagtcagaagttcacttcaggaaggggtttaaactgacatttattaaaaagaatggttccttggaaaaaacatcagaaccatccctaaagatacagtcactctgataaagtaaacagagtcccagttatgctctgtgtaacaaataacagaacttgaacatgacatttatctgttccttaaacttacagaagctggctctgaagatattgacatacttcccaatggtctggctttttttagtgtggtgagtgtcttcttccttccccaaattcagcagaggagatacaagggtatttgatgagggctgcagaacagtaagttgcttttaaaattcattttccaaaatgcattctgaagaaaagagaggtcaaacaagatcttggaaaacttcctccagcttttctaaatgtagagatgaagactctttgcccattgagatagtgttctttatttccccattgcattgcactaaaatattccaatgcaatctgtgttttgttttgttttttcttttttaattttttttattttttgagacggagtcttgttctggttgccccggctggagtgcagtggcatgatctcagcttactgcaacctccgcctcccgggttcaagcaattcttttgcctcagcctcccgagtagctgggattacaggcgcccgccaccatgcccggctaatttttgtatttttagtagagatggggtttcgccgtgttggccaggctggtctcaaacacctgacctcaggtgatcgcctgcctcagcctcccaaagtgctggcattacgggagtgagccaccacgcccagcgcaatctgtgttttaaatgtgcactattaagagggatatttgaggtcttactgtggatactcaatactaacattatactattttaaatacagcatctactcatctttctattactattcaacttgaagcaaatattcttgccattattatttattttcaaatattataccaaccttgcccttttgctttctttcttttttcccctgaatagccaatcataagtggaaagtcattgagtttatttacacccttcattttgccttgattcttgtaagctgaaaaacaatatcctttctgggtatacaatagaaagactttaaaaacaattggcttgtgaatattgttgtgaatattgttgaaactagcttgtaacaatgtccattctaattggaaatccagataaggggacagatgaggaggttctgaccacctacctccctggcttgggcagacataggagttcttggcatcttcataggtccagtttttctggaggaagaagtaaccaactctgacacctgactgtaattattccatttcctctcaacatccattattttcaggctctgagactcaagagggatgtgaaatactgggagatacttagaagggagtcaccacactaataaaatagttgttagacttatgagaaaggtgagagaactcaggttggagtagaatgagaattagaacactcttcaggttcctgatggtttttatgtgaaagacagtgagcagctggttattaccactgaggcaataaagagatactgtgggctttagcagaaacaccagtatatgtatttagtttttaaaataaggttttaaaaggaatgttttatttaattgcctacacagaatgaataaagtgatatttatagtaggactctgggtttgtttaggagcacatgcttgcacatgtgtggcttaggaaaaaccactgggaccactagtctaaaatattcataagtaaagatgcaaacattctgaataaagtagaaggcagttgcattgatttttttatttgtttatttgtgttttttgttgttgttttgcaaggatgtgttcttggagatttttataatctagaattcacctatttcaagatttctctccagcccccatagtaataaatctgaagtaggagggatgaggtctccaaacacataaatctacagccattttagcttgggggcatgttatagttacaaagatcttatagccatatcaatagaactttttctgctttttttctgttaccctcctttgctcatttgactttttttaaaatttagaaacattcccagtttgctgctgtttttcatttacttggcattgtctctaataaaacctagagtgtactctcttctaaataaagaggtcctacattgtggaggttgttcattcttcttcctagcattttagctcatctaacccaacctattttacagttatgggttgagggtcacctcaaaactaatgtcacacttcatgaagaattggatgacatagaataaaatataaaaaatgtaaacaatgtgagtgtgcttaacaccactgaactgtacacttaaaaatggtgaaagtgatgaatgttgtatgtattttatcataattaaaaataaatttttaaaaagagaaaaaatacttaaataaataaggagtgcgaacataaccatgactagttatcaccatctgatagtgcttcctttgcatgtaaatcatgcttttgttttggggacattcataaagaatagggattaactgaagtggcactgccatgtaacaatagcataattccagtttgttctacttaccaggcttgccctccatgaaaatatacaattgtagataatcttttttaattggagagatttcctcttatgtccaattttatacataaagtaagacttttttattgtgtgcctaaatttgtgtaaatatgactgcatcgtattagtaaactgaattaggtagtgcattcacataaaatttaacatcaccaagaaggctttaccttaagaatgtaatgatgaatcaccattttagatagactgataggtaatttattaactgatttaaaagagaaaagacctatatcatctcagtgagtaccaaaaagcatttaataaaattcaatactcattcctaaagttccaagcaaactagaaagataaggaaaattcccacaaaactacagcaaacatcattcttgatggtgaagcattggctgcatttgcattaatgctcagaacaggaagaaaatacccaacaccacaaccatcagtaatctactagagttcttagtaattcagtaaaacgagaaaaagaaatgtgagatagaaaagaaaaagacaaaactgtcattagagaagcagggactggctcaattgcccaggctgatgtgcagtagtgcaatcatagctcactgcagcctgaactcctaaactcctgcgctcaagaggtccttccacctcagccttccgagcagctaggactacaagtgctcaccataacactcagctaatttttttttttttttttttttttttttttgtagagacagagtcttgctatgttgcccaggctggtctcaaactgctggcctcaagcagtcctcccacgtcagcctcccaaagtgctggaattataggcatgagccaccaggcctgacctaaagctgtagtaatttaaaaagtgttatattggcacaggaatagacatgagacattaaaataacaaaacagagagtccctaaatagaccaatatgtaaatgtcagagatctagcacatgataaaggtgatattttgaatcagtgggagaaggatggactgtatgccaggcactgttccaggcactgggatctagcagtgaacaaatttccacagtcagtatgtagatgtcacttttctccaccctcagctctccctggaatcacctagtccaccaaccttctgattactctctgaagagaataaatccctgatcttcttttcagttattttcaggctttcagtattccacctccccgttattattttttctgttatcttttctctgttttttgagtttttgtggctttatgccactactttaaccacaatctctatttatccttcatgtacagttcccatgttagtccataaaaatacttaagcttttgtatttaacatttttcaccgttttggaaagggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacggtaagagccaatgggctaccaacatttagtaacgtgtgatggttcacaaatgactgtgaaaaatagatttggatcatatttctaggaagagaagaacaattaactcatgagtgatttctgtattcttcattacaaagaacttgttcatttgcctcttcagctggcagtaagttatgctacattttgaaattcctaacaggtaacacctgaaagaatgtttagatttcataatcttttcatatacctacgatcatcacatttaaaaaagaactgtatttttgaattaaagtagaaacagattatgcatgaattctgtatatggagtaggaaacactttcttaaaggtcagggagccaatgatcagaaataacaccagacggacagcaataggaaagacagagaatgatctgttaggtcgtctaacagcttatacattcaacctttccttgcctgtggtatttaaatgtcagtgcctgcccagaggtcccgtagttatgtcttgtaaattaactctgttctttcaattctttagatgacacagtttatctctttgttgtaaaccacccagaattcaagaatacagtggaaatttttaaatttgaagaagcagaaaattctctgttgcatctgaaaacagtcaaacatgagcttcttccaaggtacttcctcattttgttccttctctaatttatccccagcatttgcaaacaatccctatggtgggttgtcctgtcatcttttataagcgctaatgtatatattagctaatatgtaagagctaaagagcttatatttccttatttataaatgtgtgtgtatagtttccttataaaccagggcaagcatggcatatgaaagttgatgtcactcatactattcactgttctatgcggactcctttgagaaatgatgaagtgcccgactacagggtgatactcttcaggcccatcttgagggtagaaggcaaaccctaacattttttcctgctgtcaccctccatcttagatgactcatcacccagatgagtgtcttgccaaggaagaatggcctgttttttattgggtttgtatgctttgcatgggactttataccaatcgctttcatagggttagtgatggttgcatgctagtaatcccacagaattagagccactcaagttgagagtgagtcattacacttcaagaacataaagctggttgaaaatgtggctaagagagaatcatgtgtacccccacccccagttcagtgtgtattagcctactgcttcttttagtttaaacttgatgaatatttttaatttctaatgaaatttcatttctaatgaaattaaaaatattgcctatctagggcctatctatgcctatctagggcataagcatgtaacttccaatcattccttccaaaaatgcacttgataaaaaaaaataggagcataaataccatccaagcattatggtgctctttcagaaaaatgagacctaccttccctgtagctctatatttttcatttagcaaagaataaagcagctctttcagaaatttttgcatagagtaattggaatttaaatttaataacaccctcacctaactggtcttaaaatgaaattgtttttagcatataaatctctcacctgaagcattgtactatggcaattttatcatccatctctctgcaagtgtttattgagtgcctgttcattctcggcatgtcagctttgtgaagcaggtagaaattgaacagtcaaccttagtttgactaataactaagccagggaaattagaaaaatccaggaactgagtaaatggaagctaggtaaatgttactgactgcctaaccagctcaccagccaatcaggctctctccagctctgtactgtggacagctctgtccttacgtataattgttaaaccctacatttcttgctgtcaaaaaacatgccctgatggcactaagttctttcttctcttatggtaatcctgccataattgctaaatgacctgtgttcagattacctggtaccatacaaaattgttctctggcaacaatattatagtatattgtatatgactatagtcgtgatttttagctcgtcttttcctcttaccaaaaatttaaagcacatgttgcataaatcttatgagtacttaatatttaatatggagaccaacaggccttttgtttcctctcacatgctatttttctttttcagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatggccccttatagaatatcttcatttttcttcagttgtggtgctggccaaattctttactttgctttctttgtcaatgtgaaaatagttttcttgacatttatggtatattatacatataatatatagatacactatatatataattatatatgttttgtatatatatttacatatacttagtcacatgtatttatatgcaaatacaataccatatttaagtaaactatataatacagtaatatatatgtatttatatataatatataaagtttggaatacatcattgtcaaatttaattttataaatataaattttaaagtgtgatcatactgatgcatacatattgaagtatcaggtatttccttttaaataaatgtattatttttattggctatacattattccattataaggatgatcttaaactaatttaaccaattctctattgatggatatgtgtataggggtggggagttctacataaaaaatattttatacttcttatttaccatggaattttaaacaagtattttttttaaagaaaaagtccctaggagagtgttttttttttgttttgttttttggagatggagtctcactccgtcgcccaggctggagtgcaatggcatgatctcagctcacctcaacctccgcctcctgggttcaagtgattctcctgcctcagcctcccaagtagctgggattataggcatgcgccaccatgcttggctaattttgtatttttagtagagatgaggtttctccatgttggtcaggctagtcttgaacctccaacctcaggtgatccgcccacctcagcctcccgaagtgctgggattacaggcatatgccaccacacctggctctaagagagtattataacataatggttaaacttgcagattttggactcatacaggcctgggttcaaatcccacccagggcactggctaaatggttctatgagctacttttctgtagaacagacccctagaaatagaactatttgctcaaacagtgtgattcttttaaatgttaactttaatagatattgccaaattgtcctccagaattatctcattatttttatatgcacaaccacaacctataagagaagatattaaattcttgatagctttcttatctactgcctcagcacactgaaaaatttaaactactacaaatacaacataaaataaatttggcactccttgacaactaaatgcccttatttttgtaatccaatttctcctcctttcttgttgactatagaaaaagaatgtagaatcatttaatttaaattgtctctaactgacctgatccaacctctgcagccaaatctgtttttcactcttatatttccattatgagagtcaaactttccaatcacccaagctaacaaaaaaataacaataatgaaaagggagaatcagcttttactcctctttcaccattcctatccagcctgtaggcaggtcctgttggttctacctgtgcctccttcctctacccccaaactcctttccctttgagtgagacctgcctaatttaggttgtcatcctctctgactagcatatgagactttcttccaatttgttttctgtctacttggatttttttcactcttgccaattttgtctgtctatctctattagccttgaagggctccccaaagagggaactctgtcttcctcacctttgactccttatgccagtacagtgccaggcacaaagcaaatgctcaggaattgtggaacagaactgaccatttgttgccactttattattctaagatttcagtggaatccaattgcttatcaaatcaaggcagggtaaagggttggactttgtttaacaggccacctccaacctcccttttctactatttccatgctttctatgctttagacaaagaactcattgttttaaacattccttcctcttcttgctcctgtgattctgctcttgtgcttgcttctgcctgggaagtgcctcctccgtcctcatctcaaatctcatctctctttacacagccactgcagatgccccttccttggtgagcctttctgtgtcctcggaagttagctatttctagacctgaactatttctcatgcttattaggtgtttaatgtgtacaaaccagtgagatttgttccaacacactataaactttcaaggagagaggctgtgtcttcttcatgtttatatctgctgcaacactgagttcatggcttttcacacataattgctcaacagagcaggtgccatggaaagtcaattcaatgagtaaaattacctcaaaatagtctgttaattcactcacctttgaagtagacagattattctgcattgatacttatctcttactcttaaaattcgctatgtattaataaatattttattgaatattaaggaatgatcactattttaataagatgttctttaccatatatttctatatgtacatgataattagaagtatcaaattatattgtggaatgtaaaagcttttcttctgaagccaagcatttgttttattgtcatttcagtggcaaatatggacttcatattcaaaatgatgttctatattatttttccttacaagctttttgaaaaacaatttaataattccatgattgttgtagcaccactgaattgattctgaaagcttactttttaaataaaaattgacctttatcaagcattccttgagggcccatgattgattaacttcttggcaggttattaagacttattctttcacactgtattaatgaagctttatattggcatggagctctaaccactgtgtcctttctgcaaaggtatatctatgttgctgacatattggctcatgaaattcatgttttggaaaaacacactaatatgaatttaactcagttgaaggtaaaatatttatttttacatatagacagtaatctattatgctttgcaatgacatagtttttctataagagtaccacacgtagaacaaaatatggatgccagtgtagctattctgggtttttaaatactccctacaactagagaaagctcctgtttccagcgatctcaagaactgaccatgattacatgcagcagcaggttgagagtgatattcatcagatttagggcccattccatgaagtattgatggcagtggaagaattccaataagaattttcacaattgaaaatactaatagatgaattctcaaatgaaggtttatgcacagtgtcagttctttcaataatacatgaaggtagaaattgggttccacaccattattattttcttcctactcaacaacacatattttaggttgattaagaatttcctatcttgctttgattgagttccttgagctaactgatcattgtgcatcttttaaaggaaaaggagttcagtttttaagatagatttttacagagaccgattatcaccctaactttcttaatttcagggaagaagaaaagtggctccaaaccagtttttaatacattccttttaagcaatattggtgttagaaggtggaagcagggcgatgtgtaatttcctcacatgcatagaggcaggaaggttacctctaaattatttaatcaagtttctcatgtcatttagattttgacaatttctcatttggaaggtacttgagctggatacactggtggataatttatctattgatccttcctcgggggacatctgggtaggctgtcatcctaatggccagaagctcttcgtgtatgacccgaacaatcctccctcgtcagaggtttttatattttcagttttttaaacttaattattcaagtccttttgaactaataatacaataaattgtcacagggatgatttgtttagttattttaaagcaataatataataagcttatgtcgtggttttgtaattgcgttaagccaataattggcagaatgttacattgttcaaatactttaagaaaggtaatcttttgatgtattaaattatggtggaaactagtcaaaaggcatttttataaagacatgtgcccttcttgggtggtatactggcaatttttaaaatatctgatttattgtcagctcaccacatgatgtgatatttgttcatgttgaagtagtgtgaaagtaggcacattagtatgaaagtatttctattaaagctgaattgctataataacactaaatcctgtgttggcatggaataactagatggttttaagaaagtactttctttgaagattggagaaagtactttaatttaaacattaaaaagattggtaactgctattttcaacagcatgtccccttaatcagtgtgtcattgtggaaaacagggcttattgatgattgagtgacatgcatgtacggtggtcttatattcatactttgtatcccctgaataggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaaagactaactaaaatccc

SEQ ID NO: 37454 - DNA, 113970 bp, Homo sapiens; identical to SEQ ID NO: 35669

SEQ ID NO: 37455 - DNA, 181763 bp, Homo sapiens
cagggctctgggctgggaaccaacagacacaaaccaaggagaaaggaccatccccttacctggccattagctgtttaggggccacaatttgctgaggactagggacttccatgacactttgttccttggccatctgaccttggcctcagtgggactcatcacaaaggtaggcaccatggccaactcttggctggattagccatgagcagtgccctgggggcccgggggaggaggcaaagtggtggggcaggtagcccctgcctcagattttctcccctgaacttgcttcttccccctggccagacagggcctgtgcagagtctggggtcagagaatagggaggggagatgcataaacacgcaacccaggcagcagctgctccaagctcagggagattcccccatgtggatagcagccatcagttaaatgaacagcctccatccctcagcatgttccctggtccccgagggaagacagtgacgcagcccaaagggactcttctctttgcttgtcagctctcacagccactcctaagcctttaagtgtgggtctccccagccccacacctgccctcccagagctgcccacacatgtctgctaagaggtgcttgtcttcagccgggacccaacccttgcccaagggatgctcctgctgggggccacgaaaggaggccagctcagcagcctgcttctgcctttgctcactccagagcagggcccttgggcctgggatggaaggacatgaccccagggagcctgccacagtgtgggaggccaagaaggaacgtggcctgaatgcgctggggaaaggagctcctctgccctcctgtggtgcctgagggcatgggggcagctggcctcccggccaggggccaaagtccagcttacaacctgctccgggtgggatccagtgccctctgggcctccacttccccatctggaatgtgggctagtaagaggaacgactccaagatggcagggctctggcgaaatggccagaacttagctcatgataagtttccagcatcattggggcttgcttcagtcttgatttttcccattcggggccatgggaagtcacaggctgtgtgtgtgtgagaagggggtgtccccatggcggctctgggcccggaggagcacacgccccaggctcaggaaaagctgcctcagagttggagtggaaggggactgcgggagtgtgcaaatgaatatgtgtgagagtgtgagtggggagtgtgtgtgtgagtgtgactgtgagtaactgtgtgtgagtgtgtgtgtatgtatgtgcccatgtgtgtgctcactgggtaagtgtgtgagttgtgtaggtgtgagagcatgtaaatatgtgtgaaccattgtgtaactgtgtgggccaccgagcttgtgtgggtgagggtgagtgagcacatatgactgtgaggatgtgtctgcgtgagattgtgagtgtgtgcatgagtgtgtgagtgtgtgtttgtgtaagtaggtgagtgagcatgagttcatgcatatgagcaggtgtgagtatgtgtgcgtgcatgtgagtgggtgtgagtaagcatgtgtgagcgcacacatgaccaggtgtatgagtgtgtgtgtgcgtgcgtgcgcgaacctcagctttccacggcaccagctgcttcctgtggaagggaggggcagtctgtgggggttgtgacggttccctggtctcaggggcagcagaagctttctgtccttttggtccctagcacagtggtgcctcctcaaagaggccttccctgagccgccagcagcctctttcatggctccccatcaatggggttccatagctccgaccccagcggcgtgagcacatttgccatccgacggccactccctgctttgtggtccctgctgtgtccccagtattcagctctggtctggcacacagcatgtccagggccctctttgtccaaggcaagaaagaatttgaggctgcgtccaggcctcttgcacctgcctcaggctcccgcccagagcctctacctgtgccccagcgagcattctctgctcgctgctcagaatgctcgcaaaggccggccctggggtcagaggcctccacagcccctggagctgggaagcctgggggtccaccggcaggcacgggggtctctttccaggtaggtgggaacgcgtgcttgtgggtgtggacaggtgtctgcactggggtttgtctgtgtgtctgtctccactcacaccggggatgtatgtgcccctgcgtgtctgtctctggtgcccacctgtgtgcagtctctgtgttctgcctaacggtggtgttcccgtgataaccgacggtgaggatctccggtaagcgccgcttcctctgggaagacgcatttggacgcccgtactctcaacaggtaatggagtttgcaggagaccaccaatgccttggagtccactgaggcaagacccaaggaccccacgctacacatcagccacccggctctgtgccccattttactgttggggagacgcacctagagggcagggtctggagaggtagtggcagcctcagtcgcaagctcagggtgctctctctgcactcacaggtgccatggtcccccagtttccatccccacccacccccactcggccagtgccctttgggggcaatgccaggccaggaagggcgggcaccctcgcgcgtcctggggacagaagggcgcgcaccgggcgcgtagctcctgagccccgaggcccctgcgccgcgcaccgccccccgcgcccgctccctcctccctccctcctcctcacccagctccctcccctcccccctccctccctccgcgctcagagctgcggttggagccgagcgcgccgcgtcgcccgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtaagtggtgctctgggcgcgcgggcgccgccggggtgggcgcgggcgcggcgcgggcacaaggcgcgggtggggatgggaggatgacccggcaggtggtgcggcggcaggtagggggacacgggtccccgcccgaggcacctgagccccgcgccgggcctgcgtgtccttgcggcactgcggccgcgcgtcaccccggggccccaggccggcgggcagcgccccgcaccctgcaccctgcgccccgcatcgcgcgcgcacgcgcatccgtgtctgaggaacaaggcccttgggggctgcgggccggggctcagggtgggcgcagccgggggcgcgggatctgggccgggagcccgccagtgcgcacgcaccttcccggagcctcgggcaccccctcccccccgcgccctcacactgtatcatccttcccctctcgccttcccgcaccgttccccgcacgcccacgcggctgcccagcagaccccaccgcggtcatgggcagtgcccacgagaagccgcccggggccgcacttaggtaacttctccatccctccaggaacggctgtctccccctcctcgcctgtgtgaccttggccagccagcttttcctgtggccgcctgcgttttctcacgggtgaaagctctggctttaagattctggaatttggaatggcaggtgcggcatctcccagagcctgagacgatgggcttctctctctgtgacctggtgtccttccttctgctggcccttctgggggttggtggctcagccagccggctgaggaggggtgggaggcagggcaggggcatggcgccggggcaggtcaggactggagggagtcttggagagcccgcggtgagggctccatgagggtttaggagagactgtggaaatgctccttcgctcactcaaggggcagggaagggaccagaattcctcaacgagatgcttgccatttcctggcgaggtcatataactttcaaagatgaagcccagggcctccgacctcaaaggagtccctgcctgctaaaggatcaagtccagcctgtccccaactggcccccatcctgaattccactggcaccctaaacgtcagccgacttcccctggctgacttgggcaccagtctggcaggcaccccctgcacctcctcccctcctttgcccactaggatctgtgccctcaccccctgccattgcccctcactagtcagtgaccatcttaaggcaaggactggctcttcatttgcacaggcctggcacagagtgggcacctggtttctgcatggcatattcatgaccttgacctcactgaatctgcagactcactgaacaggagaggcaaggcctggatttttgtccccatttttcagatgggatcattgaggcccccaagaggagaagggattcagccctgaattgaggccccttccttcatgagcagatggctagggacattcctatgaacctggtggggcagggaggcggggagaggttatcgtaataatcaaagaccagccccacttcctgagctccatctgagtctcacctcaaccacacgagtgaatggctgttttcatccccaacccccaccccccgccgccacttttcacagatgaggaaaccgaagccatgtggctcattaaaggggcactgggatgccgaggagagggctggggatgcctgggcccctgtgggacacagctgagacccagcagagggtcccagggtgaggtcagcccctcaagtctgcgccatcggaacgggctgggaacttgtggtccccggccattgattgtcactgctgcaggccccgaggcgggggacagccaaggacacagccagtctccatcagctccacctgggccgtgccctgcacggccaggtggtttgagtgcaggagtaggcatgctctcacacagcagggggtaacgggcagatggaagtggggcgggcgtgggagggggccttgcacagggccagaaggagagccggtccctgaggaaggaagcccctaaggcaaagagcatgccaggggacagccacaatgccaggtgatggagatgccccaatcggcccccgaggggcaaggaaggggccagaggaggctcgtgagggtgcctggggcttcagtgacagcagccccttacctgatggtctttgtgaccttggccaagtcccttctccattccagatccagggagggtgggggtgggcctgggggagctggagcttcagaggttgaatcattcactagcaggagaagccaagcctgtgagtcagtgagtgctctccatcccagaacgtctgctcccagcccagggatgcagccacggagtgccggggtcagccgtggaggaccctctgagaatgtcttgtggaaaggggcgccttgcctgcccggtagacaggatgagggcgccccagagccccaggggcttctgagagctgagtaccctctgggcctcttgcagccagcagagccaggcagagcttcttctggccttttcacctcctcccccacctcacagagcaagtcatcagcacatatgaactcccctctgattttaaactgatggcttgtgtatttcaccaatggccactgtctccatcagtggtcagtagcacatcaagtaatgtcaacaatgataatagttataatggcagtcactttatgtcagacactgagtgctgcacagacatttccttgcccacttaattgaaacaacaacaaatgattgcaagtgctgttatccccattttgcattgcggctgaggcccagagaggctaggtaacttgcccaaggtcacacagccagtaggtagcaaatccagggctggaatgtagtccatcaggctccggagtctggtctgtgcttgtagccattagttcctgtatctccagaagtgtgtgcggaagtcagcagagtagagtgtggttcgtgtgaactcactgtctcgggtactcccagccttgtgggctgaagccggggattcttgggaagaccttgcagctcagaagctgagccacctgcacctctgccccgtctacccactgagagaaatggacaacaggtggatttatatcagtctccagcaactcagggaccggtttagctctgcattcatggccccttcagggcacccggaagcactggcagtgcacgtaaatggcagctgatagatggggacctgtgccatggtactgaaggcaaacacttccctctaagcctcttgctgtgactttgcagcaagctccccagcaacgccccgggctgggtatgccaggcagagacctggagcatgcacagggctcctcccttccccaccctggctaagctggcagaagccaggccaagcagcgcctggctggaaagccctcccctgcctgggctccttctgttgggtgggcggtgctggcagtgggcctgggagcctgcggagaaggatcagagccacgcgtcactggggcagagggaagcaggctctcaaatgcaggggaattcgggcatcctggactgcccaaggttgggaaggagacaagtccaaggtcacatggctgagtaggtggcaggacttgaatcagagcaacaaggcaagggtggaaatgccaatggttggggaatcttgggactggcaggactcttttagagcacgaggaggtttccggagtcttggttccaaatcaaagttgtacaaagcgagtatgtccgtgtccttgaagagcaccttatttaaaggggtcctgagccagcctctcttgttctgtaggtgggtctctcagtaagcgagcaaccattttattccagtgagaagttctcccctgaggccacaggctcaaggcactttctccagctgcactgtccaagcagcgattttattagaatgcacttcctcaggtgcaccagccacatttcaagggctcaggagccacccaaggctggtggctaccgtcacagacagtgcagagagagaacatttccatcactcccgaatgctctgtcacacagagctgctctacaggaaatggaaacccaagtcctcacacggaccctgaagccacctcccacacccactccctggtggcacaaggccactaatgcagcagcttgggctcccccagagaaccatcctgaagagaagccccaaagagggctgactgctcacagaaatttgaagaggtgttctgtggtgggacaggctccagtctgagagcttaacaggtagggacagaaagtgccaggctgggcttgaacgggtcgttcctcagaatggatgagtgcattctattgtcagaatggcgccagctatgccagggggccacatcttattgatgtgatgggcatgagggacactgccctggttcactgtgtgccaggctctgtgtttgcttcaggggagacgacggaaagcaaaaagcaaacgcaatgcccttcctgccctcctggagcctttgtgctttgctcagtgttcaccaaagtaagagtgcaaacctggctggggccgggaggatggactgaggccacgaggccagccggtatctcccagggctcgggtccacaacctgagtccccgcccatcctgccctgaccccgcctcctcaggtagccacacatggctggtggctaccatatgggacagtgcagagactccgggatgtactgtcacacagagctgctttggagcaaatggagacccgagtcctcacacggacctagacaccccccaccaagcccactgccccatgcctccttggaaggcagtggccaagcatgtactctccaggggctgcgcagatacctagacaaacacagaccagggaggagggaaagggcctctgtcccagcagctcaccgtgctgtgggggatgcccagacctcgcctcgtgctgactccagtggtcctagcacacccagcatggggcaaaaaccagatccggccaccgcctggtccttattaggccccaccatatgcccagcgcactgcctgtgctcaggaaacagcagggaggagacgtgggtttttttttttttaattgatttcttcctatttaaaaacaatactcttaatatgctctctataggaaacgtataaaacacagagaagtcgaaaatgtagtaaagccatcctatcatgcaaatgtaaatccaacatctccatttgattcatttcacattgctgtcattataccatgggctcaattgtgtaatctgttttttacttcacataagcattttctttattaatataatcccttcctaaatgaatggtttttttcaaaatggttatagtttaattttttaagattataaaagcagtaagtgcttattgcaaaaagaaagaatgatcttgaaccatgcaaagaagaaatttgatcattcaacagttatttaccaagcacccgggatgtatcaggcggccttcagtaattacaatttttaatggctgaataatattctcccaagagattgtaattcgcttaattatttggctatttttggaaacccaggcagtcagatttattttgctcttatgcgtgagctctgctgaggagcctctgtcctgaggagagggcccaggcagaggtatcttctgccaaattgttctccaaaagggctttttcatcgcactgcatggtgtcgctcactgcaaccttgccagcattagatattttaatcaaacaaattgtcataagtatctaggtcaaaaatatgtactttactttatatgtctttaattgctgatgagggggcacgtttttcctcatgtttataagttgtcttttccttgtgaattatctgttcctcccttcatttttttttttttttttttttttccctgagacagtctcgctctgtcacccaggctggagtgcagtggcgcgatctcagctcactgcaacctccacctccagggttcgagccattctcctgcctcagcctcccgagtagctgggattacaggggcccgccaccacacccggctaatttttgtatttttaatagacccggggttttaccatgttggccaggctggtctcaaacacctcacctcaggtgatccacccacctcggcctcccaaagtgctggaatgaaaggcgtttattgaagtcttagtgtttcttctgtgggcttgaataaactgtatgcatgaaaaaacagtgacaatttaacagatttgttgcaaataatttttaagacctttgttctttgccatttttttttttcatgcaaaaggtaaacactttgttgctcacaattatttgtgatttcttccattgtttctaggcttagaaaatccctttcggaaatttgagagctgttcatttctgagttttccatgtgtcttcgtgtgtgtgtgtctgtgtgtgtgtgtgtgtgtgtattggggtggtgtagttgcatttttaagatacttaactctttaatttagggattagcaagctttttctgcaaaaggccagatggtaaatagatttccagtttgcaggccacatagtctctgtcccgactactcaactctgcatggtagcctgcaagtagccacagacaatgcgaaatgagggggtgaggctgtgtcccaataaaactttattcacaagaacactgggctgccagatttggcacttaagctgtaatttgccaaacctgttgaatccaaatgagatgtgtcttaggggatagtttgaggtgaggatctaaggtgcatcctttgcagattgctaaccagttgtccccatctctagtagcaaatcggttgttccctggctcatttgcacgcactgacactggtctgcagtcagacctggtgctggctgcctgtcctgacccacgggcccatctgtgtgctgctgtaccggtgatgtgcttttgcctcttgtacctggtatcatttaatacctgacctgccggccccacctcagcaatcctaaagcttgcttctctgtccagtggacttcagaaccactttgtcaagacccccttcctccctccccgccaagataaagcactgggtgatacattctctggacatcctcagagttccgaagccgcagatgagtccggtccccatggggtggggtggcggctggctctgtgcagatgctgtggatttgactctccgcagatgggaggcgggtgtgggcagtacagcgccatcctgagtgaaggcccccagctgaggatagccagacggccctgggaacgccacagcctcctgactgagaaacacgaaaacaaagccggcagtacaagagagcgcgggagattgggaagccactgtgggccggcagaagatgacctcaaatgacaggacttaggcctttctgctgctcttttggaaatcactgtcctgacactcagaattccctgcactccggcgtttcaaatcaaaccctgaaccgggttaaggcgcatggagtggccggttcgaaactgaacctacattcccacagattgcgggccaggggtgtgatggtggcacagggcgtgaccaaatgggaaggggccctttctccaggttggaccagcccggcagtaaccgcttggctccctcaaagagcagcaggagcaggagagtgtgtccagccccaattctcgggcagagcaagggctcaccaggcacaagggtccattccgccccccaccatgggcctcagctccatttctcctggaagcatccaggaccagacactgccacatcttggcttggagccacaggcccaggagagatgggctcaggagcagctggtcctggctcctctggctcctggggtctctgggtaccttcctgtagtcagagggcggctgccagcagatggtcccacgtctggtgcaggagaagagggagggctgtggacgggtagggcacgtctcccacctagtctcatctctccctcctggcctgtggttcatctgcccacaacactgtgaccagcagctaggcttggaaacctctgtcctggggagtggagcaagagtccccccttgtaacccatccatggggccagagggtaagaatgcgctgacctgggggccactgccccagacgcctgccctggtagcccctagggaggcactcgtggctgtgtctgtaggtgggatggggtgggtcagggctcccaggccaccgcctggccctctgcgccccatccacccttccccgaaggaggaagctgggctatagcacaatcgtgggagggggtatctgagatggagacgggcagggttggggtctcccctaagggaggaggggagggggtgagcacacagagcagaaatccaccccttcaggtcctgtccccagcccagctgtgctctcccggtgccttcccagtggggagagcaggcatctgtccatgagcacagagggggcgggaggaatggtgctgatgacagatgatgataagagggtcaggaactggaggagcagctggtggtgggagggtagggggagctgatgggctgtggggcgcactgagggagagactcggagccctgtgttggtgttgggtcccggcctgagagggggcctctgcctctgcactcccttcaggcactcctggagcacggcaggaacttggtggtgcttcctctgggctttgctggaaaagctttgggctcgtatgccgggttcctcgctcagaaatagtgtcttaggcaaaattcaaaaatgaaccagcaatgctcagttcacgcgattcagacagcagccaagcccttgatgaccttcgcgtcctgcagcctcggctgcagcttctgaggtaccctctctctgggcatcctcgccactggctcttcctccatcaccacatttggcagcaggcatcctgccccctcagctggggagagtggcacggatacttcggtgtgctcgttccttgggtctagatcacagaagggcaggcttgactcccatcttcagttggagcccccatttggaggtctgcctcccagatccttttattggcctctgaccttgacaccaatgcatccccccagcctgtactcccaaggactttggcctgcttccagaaaccaggatgccctctctactgcccctgccaggattcctaatggggccccatgggactcgttccctaggaggacacgtgtatgtgtcctggtagctccttatttagtcactgcctgtccaagctggaaggacttagcccagggcccacagccccatggcctccagctgcctgtaatttccttaattacctatttaggccccgacggcttccggtcctcagagctggctctgagattggaagcgggctgggacgggcaccgaggtaccacagcagagccgggccgacttggggcacctctcctcccatccacgtgctctctggctatgaagggctgggaggacagggacccggcttcccattggaccccaaacacgaggtctccgtccctttgtaggctagagtctttcacgctggccacagccacagcgtttctaggtccccatgccgtccctgccttcggggctgctgggcaggcccgggctggcaggaggggcgtggggagcacgtaggggcagggtagtggctggccaggctcacgctgctatgcagctcgcacacccgctgtaattggataattagtgtcattatgcttcctgctccctcgctctctccttctgcagctcttgccttctctggcaggaaacaaatgactgtcccccaaccctcagtgtagacttctggccccaatcacaaaggggcttccaacctccccgtgggatccagggacacccagcattgtgagggccgcctgtgtgggagacaggagcactgcgggagtccgggcaagcttggggaagcatccagagaggcacatgggttcagcccccggccgaacggaatgttctgacttcaccggtcgagcttggtcctgacctgtgaactctggggtccagctggagtccagctgaagacttcaggacaagcctcgggaggggagcgtgtggcgggaggggctgactcagcgaagagcattgccctgctcggcttcctggagatctcctgggcttgaaggaacctccgggaaaatgggcccagtcccctggggaccagcctcagggtgtgtgggcaggtggagccctgccttctcaccaacccagcaaaaaggaacgaggaccatttcgcagattaaaaagtgaaggcccagagagcttgagtgaccaaagccagcacctgcactctggaaccctgaggttgatggggacagatttcctgtccagtcactttgctgaactcttttcattggttctaatcacttgctcgttgcttttctgggcttttcagggcagtataacttggcagagcagcaatgtcgaatcctctggagctagaccacttgaggtcctgttggcctctgcttctggcttgccgtgtgaccttgagtaggctctctaaccactctgtgcctgagccgcatgtgctctttggtggggagggccaccccatgctatagaggctgctggcagagtgatagtcattctgcctctcatccgtggctctatcatctcccttctgcctcagctagaacttctaggacaatatcaccccccagggagctcaggggaaagtgggggtttggtaggtcctggagacctcagggaggcctcctggctctcccagaaccaggctggatttgggttaggagtgaacatttactcaggctatgggcttggcctatctaacagagacccagcataacagtggcttcagtgagagagaattgacttctttctcatgtaagagtctaggtgggcaacctagggccagcgcaacagctacttagccctcaggaatctgagctcctttgattgtgtcatacatggactccatgtgcaagatggcaacagatagatagctgcggccgcacctgtccccacatcagcattccagctggcaggaaggaggggaagggcagaggagaacacattccttctctttaaggacatggcccttgaattcgtccctgtcacttttgctcatacccagttggccaggacagagtcagatggtcatggttagctgcaagggagttgggggaatgtaatcattagctggatgacaagacacttagctgaaaattaaaacatgacgtaggaggtgggagagtagctagcaagtttctgccacacacctctgcggattcattaacacctcctcaagacacatttgagaagtggaaggtacccatcttgaggccaggctttccccaggtgacctggccagcccttctggggatggaatggggtcagtacctctgaagaagtgcagcaaaaagaggggccatttgtgagcaagagggcaggagcagtggtgatggcctctctccactgatctgctcctgtgccaccaaatagggtacccacctggctgggcaggatatgggtggtgttaaaagtcacagaggctgcagggtgggggtagggtgtgtggggaagggtctgcttgggtttccatatccagtaggggggtttcctggaagttaaaatccatacaagcgaactgctggctgattgggctggtcaaggcagtgaaactcctgcaatcacggcgtgtggcttgggcaccacgggaggccattcaggcccagtgtccaccaccctggacacagggcgaagtggctggtgggggctgcttgcgtgttctattgtggtggcatagacatcacctaaaatgtaccacgttcaccatttttaagtgtgcggcccaggggcagaagcacattcatggtgctgtgcagccatcaccaccatccagccgcagaacttgttcgtcttcccaaactgaagctctggccccgttcaaccccaactccccagcccccagcccatggcacccacccttccactgtccgtcccctcagatttcacagctctcctatgaggccctcacaggagtggaatcctacagtgttggcctctctgtgactggctccttctactgagtccaacgtcctcaagggtcagccatgttgaagcccgtctcagaatggccttactttgtaaggctgagtcctattctatggcctggatgggccacatggtgtttatccagctgcctatccatggacattgggttgcatccaccttttggctattgtgagtaatgttgctatgaacttgagtggacaaatacgtttgtgtccctgctttcaattctttggggcctaccccagcagtggggtgggtgggtcctatgggaattctactgctttccacagtggctgcaccgtcttccattctatggcggtgcttgtttgaatgagaattctgggccagccctggagcctctgaaggcaggcaaatgtgtggtctcgagcttgactagacacccagatcccccaggggttggggtgctttatagcgttctggtcctcccgcttctgaatgggaagctctggacccaagactctgtattcgtgaagttccctgagtggggaggggtgcccacccaggtctggcatgggctgccgtagattagagtagagcgctgggccacctaggggccaggagtgctgcagaagtgcatccacccaaaggcgcaggctgaatcgggcaacctcctgggctcctgccacctccagggtgtttctgtgggttccagaatcctccttgtctggacccttgttaacgaggacttccaatgcctgtgtctttctgcggcacccggcgccggacaggcggttgctttggctttgcacgcagctgccagtgggtccccaaggtggcccctccggggctgccctgcagggcagagcttcaggcaggtgggtgcatgcaggagtggggagggggcgccatggtgatggctattgtttttgcccaaagctgttccaggcatgagagccacttgtcatgtgtacagattgtaccaggaacagggggaggaaggaacagagcactgggggccggtggggggcagagggggagcctgtccctttaaatctgttttctcgggttttatttccttctcttttcccatcctcctccctccaccagcacaagtggagccgtgagggcccaggagctgcagcgacggtgcctctgaaatattaatgaggctgttctctgcctcagctccttccctcccccttccctggctgcatgcaggccttgtccttggaaccctcctttcccctcccaggtggtcgccaaggtgcgtcaagcagaggggagggggcaggggcgggcaggaaggagagggcctggcgcaagggcaggaagatgtggggaatcagggataaaaggggtctcccaggtgcacaccagccaccagcatctcgacctgcctaggatcatgccaggcccaggagagggcagggtggctgccagactgggcgccctccttccgtgccctctccccacctgctccccagctggtctaggggcccaccccgggcctgacctacgaggcctgggccacacctctcgctgttgccttggcttgcttttcctctctgggttctgccgggcctggcctgtgttctaggagcctggaggtggagagagatgggggactattgttttaaggaatccccgtagtgagtcacgtcgctgagtgatgggcccttctgaaaggcgggcccttgcttggtgggtctgtagggagcaggtgacggacagtctgccttcaggagggcccacggtggagggcatgtgcccaggtaggcccccaggcgtccacctcctgccctctgcccctgagttctgcttccttcttgcttcggggccacggcatcctgggcctggctctggcttccagatggtctgaatgcccaggagccgcatgttctcatcactgagggtccagtgactagggagtgactcgggagctgggacttcctggcagtacatgccccatcatccctgtggggatatatgtccacgcagaccccagaaactgaaggggtgctcgactggggtgcagtggggctgttttcaggaaagagaatggcgtgaatcccgatgcgtgcatcacctgagatctggaggacggtggtgggatctcgccctccatctgttctctcctccataaaggcggagcaggtggccgagtggaatgcagcctgggcctgctggggaggctttcaggggtgtcatcagagcgtcccagcaagggcggccatgacccacctcaagtcacatggaaggcagggctgggagaaccagggcaaaagcaggaggcttcctgagcctcagtttccccctctgtaaggcagggagagttctcctggccctcgtagggtgtttccaagggtgcagtgaaagaaacatgtctgtcaagagctggcatgcagatgtgggctcaaaactcagtgtgtgccatggggtcctgagaggggccccatgggagcgggggtgccccctacttagaaagtgccgagccttctggagcatgctgggctgcccagggcctggaggaagtccatgggggactaagctggaggtgccagcagagcccccaaagccagggagggacaacataggggaaagaggacccctgggtctctggtcaggtgggtttgagtcactgggtggggagtaggcactctgagcctagttgggaggtgagggtctctgggccctgctgaagagaagagtccagaaggcggttgagtaatgggcctggacttgggccatcccctccagcagcccctggaggcagcagccagggacccccctggctgtctcccaccacgaggccggccagtctgtgcggggatggtgcaaatgccggaaggtgcgaggccccctctgtggaggttctcatttcaatgaagccaattaaggtcagaaagatgaaagagcacagaaatggtatgttccctgcccttttggtgcctacagaccattctcggcagccagcccaggccggaaactctgtcaggcctgcagaactgataggcctagtcacttcggttcttggccatctcggcgatggctgctgtctttattgggcctcagggaggccaccgcccaggcttatatagaacccagaaaagcaaagtatatgccatttggtctgcacagcagccaacagtcgctctaaatgggccttactctaactgatggatcctgtctgccctatagcctgttgcattcatgaagacagtgagggttagcagagcaccccgaccccaccctgtcctccaggatggagactccacctcccaggactccaagttcctcccctgtgggccaggcccccattcactcattcctccaggcccccggccacatgcgggactgaccacgcggtagacttcctgccgactccataccacgtgtctcaaagagcttagggcccagctggtgggagacaagctcacagatcatcgcagcgccaagcagagtgaaataggaatgggtcgcgggattatagactcaggcgcaatcagttttggctggggaactggcagagactcctggagaatgttccacttgaattgtgactaagaggattcatcggaggtcagcaggtggagctggaacagagggcgtgcggtcggggctcagagctggcagggctgtgtggctggggtgggagtggggctgggaagtgctcagaaggaatctggccttttgcttgatggggatgggagactgaaacaggggctcgctggagtgatggtgcctgaaccaggaaagtggtgactcacagcagggtcatgaccagttgctggactagagagagacctaagaggtggtccacaggacgtggagcttgcttgctgaggggtggggatcctgcagtggggagggccagcagggccagccgaggagaaggaagttggccccgggaccatggcagaggggaggactgcctccttgcccactgccctccccatgagtcactgtgggtccagtcagacacagccatggctgcaccagtcaggagcagctgtacgacctggtatggttctgtctgggccaccgctgtggggtcaggggcagggaccgggtgggggaggacagagctggccttgggtatgccatggtcagaggagggaggatgagcacatgccaggggagggccaccaggcctcggtgaccgtgccacgaggaacccctgctctgaggaacaagcatttctgtcatggccgtgtgccacccaagagcctaccacacaagccattcactctgtcacccgctgggggcacagagcctgaacctgacagtggcacaaagttgctacatggtgggattgttgaggcatgaggtgactggagctcaggaaggcagggagaaggcgccctggcaggtgcaccgtcacaagcaaaggtcctggggtggggaggggaggctgtctcgagaagacgaggagtccaggtgagagccgaaagctgccattgctgccttgaggggtcagaagtgggacacccagctgtcctctggctctgccacttccccaagccagcctcagtttcccgcatcagaaaagcaagggcaattcgtccacacagcacccccagaaggagcccgcctcacctgggacagcttcgcttgctgtcctggccccctctcctcagctttcactccttctagtcttttccccccaatgcctgtccccagacgccttgcctcacctttgccccagctgcaaccccacagctcttggccctcgggcctgctgttctccctgtcccagctagagagggacggggttagttgaaacttgttgagcacctgtcccagcacatcaagccagtgccaggcatgtagtagctgctcggtgaatatgtgtcaggtgaccaactgcaagacagggcggggagaggtggggagagaggacggcacaggcacatggccatcattttgtccccacatctcccagaagtgaaggctgcttcatgtgcaatgtgtcgcgagagtaaacgcgcaggtgcccacgcttttcaaacatgggtcactgtggatggatgtttcgtgaagtatccaccagggcctctcctgagaataaggccatggacttggccgtgtctgctttggctgcctgagggctttctcccctttcttcagggctctgggccactcgtttccaacggatgcttctgagccaggagcttccccagagacgggggttcagggccctgctgagctgccaggagggctcttggctgatgtcaaggccaggccatgtgcactgaggccatttcagttccatgaggatgtgacaggcttagctcgggccgggaaggagcggagagagaggagctgcagtgggccccgccaaacactgtgatggctgcagaaggggcagcctgggccctagcggatccttgggtaaggtgacggggacagggagagggatgacaactttgcgatgctcggcagagtggggccagggccgtggcctggatgctttcagtgtggggagactttggctccttactttgtcatctggagggaagaagagcgtggaggggagtgggtggcaccatgctgtgggctgggacgttggcagactcaccagcgacctgtggctgctttggctttctcctgtgtaccctctcctcctctcctcctcagccactccctttatcccctccctcttctccctccctccatccccctttccctccctctctttgcctttccgtcttgtccctctctcccctcccctgtttcccacccttcctccgggcctcctcctttcctcgcccctggccccccaggtactctcagggccacagaaaccgtgagccactaaggccacaccagaagaccaccagggactcatggcatgcccgctgcacagggcgcatcttaaccaggcaagagcagggagtgaaccggagtgaacaagcgcaggactggtggtggggcgcgggcaagaccagccactgatcagtcccagcacgctgccctcacttcagcgtgggttcccgaatggatctggggggcagtgacagcctctgcctccagctagctagtgttaaccactgcagggtcctggcaggaggcatcgacacttcccctcccccacctgggcaagccctccaggttctgggcacccatggtgggcaggacccgggagtggcctggctggtggggcctggcagagcatgagggccactggcccagcctgggaggtgatttctgcacttcgagggtcatggcacagactgagtgaagatttgccgagaatattctggaagatgggacctcagttttgtctcaaccactcccctggcttcttctcgcctccatctccccaggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaacccttccgaggaacagggcagggcagggcagggaggaggaagacagccccatctgtatatttggggatttccggtgtgctcaaccctgtgttcacttaagggggatcagaacaggaggaagggatgcagggtgcaagccttcggagtttcgggtgaccggggcctctcctgggaagagagaggatggcctggggatggcacaagccatttgggtctggcaggaaggggtgaccgaagctgggtcacgggaggcccagagtgctgatcagaggtggcactgactggccacaggctgtcccaaagaggcacaagcccagggtagtgtcggtctcactgctgagggaggctctagaaagcccggtgagcactgtctagaaagatctggggcggaggcctgactatccctgtgggaggcaatgttccacccggccttgtgaggcctgcccagccctggttgctgcggtctgccatgaagcggggacccccaggagccaggcccagccccagattccaggagccacagcattctctggcgctgcgtgcctggcagggctgctggggctatcccagcctagtgccaggcctgttccccagccagtgcgggctgatttgatctgctgcccatctgggcaacgcctgggcccacccatctcctctgctcccagccgtgaggctccttggcacctccagcctcccgctctgccctcaccctcaacccagagactgttctcttgtggctccggcctcggccccgtctgtctgcaggtggcactcaggctgcagggaggagtgaagatggaggaggggggctgcgggccaggtcaggaactccagggtctgcctgggtctccctagctttgtgccctggagctgatgcgcccgtgacacccggcctcgccgccgcacacgccctcacggtgcagctgctgctggggctgatgccttggctctgctcccgagcatctcttgccttccctcctccttgcccagcccccgaggaggctgtggagggccatttatccacaagagctctggcctctcccagatcaaaggaagcagatgggcctcagctgtctgctcttcccctgtctgccaggccttgttaaatatttaaaatgtcaaggcccctgggaacctgcccgattctgccatggagctcaggagctcttgcgtgcctgtggaggcaggggcacggagaagggcaggtgcacaggtgggtggcttggcctctgacgggcttccaagcacctgggtccccaaggccacagtgcagggagccggccaggcctggatctgctgcccacagaatgagcagcagaggaccggcccctcccctcttcaaccctcaaggtcctcgggctggagctgtcgggcttgagctgtctgggtgccaggagcgggtgactcgctccccgcatcccctagcccggccgtgcacccggaccctggtgctcagacctgcctgcccctcagtcctcctcagacacaagggcctgagccacgggggcagctggctttgttgtgccccaagccccatgccaatcccctgacaaggtgggcagacgtggggctgcccaggaggcaggcactcccccgtggggcaggtgctttatggcgcatagtgcattgcgggaaggggactttatcttctggcggtacactcatcaatccactgccctccctgtcttgggagcactccaagaggattccagaacccatcctggaaaccgcgctgctgttgtcaggaaacctgggtctcaggctgaactcagaggtgggttcgcccgggaacctggccccgcccagtgcccctctgggctccacaggcagttctggaaaggagggggcggattcgctgggagccgacacgagatgctcctaatccaattctgatggcatctggcctctgctccgggcaggccgcccatctgtgtccatgccaaccggccagcccctgcccccatgccctggacctggactgccctcgggcctgctggggaagcatgtgctcagagccagaggggccgcagctgtgttcctcctccccgtcaatgggtgctgcagtggggcagccgtcgggaccccgagcccacaggaaggctaaggagaaacgagcaaggctacagctgcaagggcaggtcaaggccaagggagaggctggcgagggcgagggagctcctggggaatgggccaggggtcccggctgctctcagggacaaactgggcatgtgaggaggggcaggcaggagagagactcgcatggaggctccaggctaagggcagtggagaccccaggtgtctggggagccctcccctgctcctctccctccgcagaagccccacggttagcacgtgcttcttcttaagtcacttggggggtcttgtactccctagtactgtccccacctggcttagctcctgtaattccaggagacagtcccagtccagagcgaggtgcacacccctcagttgggtccctggtccccagccccctccccaccacccaggagctgaggtcgtgcgttaaccccaggctcccgattggggcaggctcgggcctcagcaagaggcctttggctcctgaagaaacctgagccaggggcagagaggcacggacagctgcggctcttctgggtggggaggacgccatgtggccgtcgcctagctggggtgaatgagccacggttgtgcgggcggcagcttctgttccactgcggccagggctacccctgcccctcctcagaagccccaaggttagcatgcgcctgttctccagtcatctggagggtcttgtgtgccttcccagacccactgtgagtgccccatgggctggggctgggctctctggtcatcccgtccctgcagcagatggcaggcgtgagcccagctgcccagggctgggagctgcaagctgctgtctgtccaccaggtgtcagtgtgggtctggtcacggccgcgacagcactgggcgccgggtgagcgcccgggagggctcctcgggatcagccggggctgagaatcctggggccaagggtggggccagaggagggtgtcatcccacatgcctgccccggtagaaggtggctgagtgggtgtccaggcccggatgccagtcacgcacgtaagcttccagtaccttcaggccaaggaagactgagaagtaagcgtcctcaaggatgacaagtgacagaattggatagggacaggtggctctgattgtgaaggcaaagccaatttgggggcttctgagtggctttgggtgtcattcaagtcgccatgtagacaagctgtgagccctggctgagggatcaaagttggtgctggagttgcattagaaccaaggctgctgggtcctgagggccctgtgctcaccgggtcctgtcgggcagcgtaggttctgtcctgacctgggccacaggccagagctctgactcatggttacagggccctctccacctccggcctcagtggccttgtctgcaccctgcagagagcagctgatgagcagcccagggtgggcagtgtctccccgacccctgcgaggccatgcagcccagaaaaggcttgaagacttcccagtcccctccctcagcaccgtgactccggtttggcttctccccgcctgttccccaccaggaacccactcccattcccgtgcctctctctctcctcgcgtgacaccgttcttcttctttgggtctctggacccaagaacttgcatctcccattagctctcatgctccctccccactgcttcttccccgagaaacttctggaaagtaagcctccgctccctgttgccagcagccacaggcaccctggagactgctgattcctcggcactggccgtgctcatgccccaatccctcgggccctgcccaccctctttgcaggctgtccctgcccccacaggttgggctgtgtgacactgccagtctttgggaccggctggccccatcttacagagctggggaggggggtgttggtgacaagcctgctcagggaattcataggctgggagctagagaggtgtttcctgacaggcacagagccctggcctagtctttggcatctggtgccatcccagcctcccctgattggtggccctccccatgtctccactaaagtcccctggacactcgctctcctccccaggggaccattggctatactcttctgtcctgtctcctagcaacccttgttgacctggacataccctgctgggtcccctctgtgcccccttgttgggtcctgtcccctgccttccagtgccccctcagcggtagtgtggaggtggccaggaaagcacagggacctgggacccgctggagtccaggagcctcctggcctgttttgtcatctgtgtgtcaggaggaggatggctagggactccccatgacagcagccagagagccgcatgctcactcccacgtgcacacccccagcagtctgcagaaaggctcctgtctagagggagagccaggcgctggccagacggccccagagggctgctgccaccccaggagcagtcagtcagggccacataggaggcctgggacacacaaggccgacccgtcccatcccatcctccccttctgtgcttccggggcaccatgcaggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaaggtaaggcccgggggcctgggctggaaggaggaagaggaatggggcttgagatgagggacggtcacaggatggtgatgtctcctccactgcttcccttctgtcctccgcacagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggtgagtgccctggtcttcacccaccctgtcaaggaagctcggctcctgcttctggggagggtgagccagaggagacccccagcacaggttctccccggtggcctgcgtgtcgtcacctgccttaggaggcgggaggtggcgggggtgggggaggtgggggaacacggggcagggcagagtggtttcagacacagcaggcccccgaagaatcaactgtccccacagcctccacggcgggctttcccccctacaaaggatgcaaatgtcctcgttccccagaaggaggagggctcctgagtccctttcccaggcggcccatggcacctgacgggacctcccctggggcagccgggaggaggcggtggggagaaaggcctctgcttcccggtgctctaggcgacctgctgccagccgacggcgtgctcatccaggccaatgacctcaagatcgacgagagctccctgacgggcgagtctgaccacgtgcgcaagtcagctgacaaagatcccatgctgctctcaggtgagggccaccctccgggccagcctggcaccaaggggcgtcagcagccgtgtggcccagcatcctgtccaggctgcctgctgggctcagcctccacctccaccagggccttccagcataaccttcaggttgggaatctgaagactccgcccgtcttgaggcctgatggtggcagctccagccacagggcgaggaagctggccctccaggcccgggagagtgctttgtgtcctgaatgggaagccccaagcggagaggcttgcaggggccagcacagcgctgtgcttctctcaatccagaccctcgacaatatccagtgggggtagtgttccctttccagaaggtttcagcatagtccggtgtttatcccagttggaaacgtagtgtgaaacgggacaggaaggctggaggccctaggtgggccctgtgggcctcggggtctcctccaagccagggaggaggcttcagcctagttttaaggtggacaccgcgtccctgcttccgggagaccctgggagacaggttgtgggcgctgaatgtgtctcccactgggtgatacaaattcctgtctcagtctctgtgttgctgttccaggcactcatgtcatggaaggttctggaagaatggtggtgaccgccgttggcgtgaattcccagacaggcatcatcttcacgctgcttggagctggcggagaggaggaagagaagaaagataagaaaggtagcgcagcagtgccgccagtccctggtgctggtggcggctccttccacgctgcccattctttctttgcgggccggtgccactgggggctcagggagagccagcccaagtgggtgggaggccgggccctctcttttgattctccgtggagactcctcttctgaggatatcccccctgagagccggcaggccaagggcccctccagtgccgtggacggggagtttccctgagaccaccatccccaaaggctccgggatcccatacctacctggacaggaatggcgttagagggacaggagctacggggagcctcatgcttaccctcagggcccgtgcccagtaaggtgccgaggatcccaggccagcgtgggaggcagccagggaggtgggggtcagaggtcagaggaggctgggacaggtgagggccgggcagcccaactgtgggtggtggccctgccctggggcttacaaagctaggcaagcccgagccaggagggcccattcctcgtcctgtggctggagctgccaccatcaggccctgcagcgggcggagtcctcagaccttctaacctgagtactattcagggaggccctgatggacaagattgaatggctgccacagccccttctggctgggcagccttgctctggcctggacttgccttctggcctctcctgcagccaaaacatggtagggagccacacccgcatgggaaagctctgcttcctgccagtgacctccagccagggccctggggccagtgcgcggggtgtgggggcgtgggggcgtggggcgggcagtcagggcccggggaaaaggtcagccctgagcccaaagctccctggaggcagcaaaggagtagctggatgaccctctgtggcctagaagcttcgacgagccctgcctcctggcagcctgggcctgtgtctccctgcaccggctcttctttgtggcaccaagtcctgtagggctcagtgcagtgtctcaccccagtgagtgccctgggggtgcgcaggcagatgggcagccctgggcctcgtctgggctgggctggagtccctaggcctctgtcctgggaagcccagctgcccctgcctgggctgcctcctcatgtcttgcacacaatggccctctcccatcgtccacgggaacccacgctcctctggagtctccagccgcccttctcaggctgctcaccttctctgtaccttaaatgagtgtgtccttcctaactgttccaggcctctcctttcttttttaaattgacaagaccattcagcccctcccaggccccacctggccctcctctccagcaccctcaggctgtcctacttaggagtcagagctagagggcttcctggaggaagagaaccctgagggggccctggagggagagcagcagctggccagctgggtagagggtaccagcaagaccagggggctccctgctcgccctccccgtctctcccgccccatccccattgtttggcgcagcctgccaggtacacgcttaggatacttgccttctacctgcacccaaccccctatttcttgtctcttgaccttgactcctatgcacctttctccaagtgtgcttctcctcctcaccttccccccactcctgtctcttctggcggggcccagccctcctcttccagcaatgctcatcccagacttccccctgcctccctcctccagaggcctcccagggcctgtgtgcaggctgggtccagagtccatgcttccttcgggcccccacggccccaaggctctgccatctcccctgctgtgctgtgcggtcatcgcactgccatcttgtgtccgtgggggtctcccctccctgcaagaagggccctctgtgcccacaggaaccctgggcggagagggcctgatcaatgccccacccctggctgagtagggtcggggggggggccctccctgctccctggggaccccggatcccaaccccaactgcctgggagtgcagatgtggcccccaggaagctcctctaactgcagctctcagaaggggtgactgtgcccaccacctgagcccctggatagggccacttggggcccagcctggccttgcagggctgctgtgtgccggggctcaggctggcactcctgtgctgcagccctgggttgaccaatgacctgaaagcgccccgcagagtcctagcgtctcattcctttgtccctttaaaacacacactggggccaggcacagtggctcatgcctgtaatcccaacactttgagaggtcaaggcaggtgaatcacttgaggtcaggagttggagaccagcctggccaacatggcgaaaccccgtctctattaaaagtacaaaaattaactgggcgtggtggtgtacacctgtagtcccagctacttgggaggctgaggcaggaggatcgcttaaacctgggaggtggaggttgcagtgctcaaacacacacacactgagctaactgctggacgtgactgcagggaaaaccaatccctaggcaagggcagctgggtgctgtctgcctggcttccaggggttaggagccatctaagtgaaccccttgagctggtttgcagggagcagacgtcccgacttggggaggttccagcttccgggaacctcccactgccagccatgtgtgacccagggcccttccaaggctggctttaggggttcactgtagggctgagcttaaggccgaaggggagccctgggcagaggtctggctcaggaatgccagtgttcatggtgaccgtgtgctgggaggtggtgacggggtgagcctggagaggacggggcatgaagaaggccaccagcaatcaggcccctcctccccaccccctctgccacgcggcccccaggctggtgtcctcaagccttcgtgtctgtcatccctcttccattgtaggcaagcagcaggatggggccatggagagtagccagaccaaaggtaacgggcgccgctgcttgggcacaacaagcttggagccctgggggtggggctggtggagggcacagtgttgggggaggttcacctgcctcggtggcaggagcaacacttggagaccaggtgagtgggctggctgcacagtcccgtcccagtgcagagggaggagagagcacacccctggggctgctcagggcatcctggccacagacactgctggcagctcagcccagccacctagaggagaccttagcccagcatgggcataaggatcacctgtgagtgggcgccccgagtccactctggccagatgagaaaactgaggcccagaagggctgactcacctgaagctctgggtcccagtcagtgtgtttcccaggccagcttcctttcagccaagcctgaggacctgggagacagagtggtcggctgagggccagaggcccggctctcctctcagccccggacagctggcaggtgccgacaccctggggccagcatgagcctggctgtgagacgcaggaagcaggagaaggggtgggaggagcggggaggaggccagccgtggcccacggaggacaggagatgtcggccaatgcagcagccagctctaggtgctggagtccatggggaacaaggcaggtcctgaccctcaggaaggtcacaggcagagatgacccaggcaacgccctgtgcggagctgggtttgggagggcagtggggggacagcccgatggctgcagccctgggttgaggaggtggcagcaggtggggcacaaagctggaggggcccagctgggtggggcaattgtgtcctgacgccactgggaagaggagccgtggcgaatggccttgggctggcaagtgaggaggagcaggaggaggcagaggtgatggcggtagtgccaagagccccagtggatcggggaccagagtagtgagggagaaagacgagtctgctctccccaggtcgctgcgtcggtcccggggcagaagagggaggtggggtggccaggattactctgggccgtggagtgggtgcggccagagcttggcagggagggagatgaggaagtgacagaagcagaggagtggggagaggagggagccggagtgggggacacaccaccaccatgtcgagggcagcaaggatgaggagcacaggacccaccagggaagaagggagaggagccgtctgctccaggggagaggcagggagggtgctggagggacagatggagcccgaacaggcgcagggctggctggtgggaggagagtgcatggggcttctgggcctccctaagggaggtaggaggtggctcggacaccagtaagcagatgagtcagctcagggttctggaagattcctcgggccacaggcctctgctctcaggtattatttggggcattccaggaccagtcaccctgtctgtgtgcccaaaagccttgtgctgtgtctgtcctcccttctcccgagagaaccatctctgtcccacctagaacagtgctggagccaccccacccaccccaagagggcctgggcttaggaggcgagagaagggaagctgatagacttggaaataggagagctccactgaatcccgtctcctctctatggtgtggcatgtctttcccccacaaaagccccttataacgccttctccccagccaggcactgaccttggccatggggttcctctgtgtgcagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcaggtagggacagcaggaggtggtgggcccaggccattgactgggcgtggaggatgctgggctcctggagatgagcccaggctgtgtagagcaggtgggaagggatgtggcaggtgatgtgtgggccaggcaggcaagggcacaggccaggccggcagtggccatcagggcctggcgcagcccttccctagtgagcagaagtcccaaaccctcgacgaaagcccgggtcacacactgagccactgcccatgaggtgcccctacccaaggctccaggctctgcccctggcaccctcaaaaggcagctgggggcatgcagggctggtaccccaacttctggggtgcagtgggggattgactcttgctagtcctccccagcggtgcttctcctgccatcagaccacaaagtccactccccaaccccagcagcactccagaagaggccacacagagcccccttgcaaacaggccccagctcacctgctgagccaaacctgggctgtttatcctgaaacgcaaggcaaatctacaaggccttcacaaatgcctccgagaccgtgtccatacctcttcttccctcttcctgtccccctccttccctcacccgtggcaacccctttcgtctcctccccgctctgtggcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaaggtaatcataaaacttacagttgatactgtttacagactcggaaactggggtaagaagtcattgggcgccttggtggcagtataaactggggacgtttgggatagctcaagggaggagaggaggtgccgagcagggacccagggggcagctttgctgatctgtcagctcaggtccctcggcatgagatgggccagaaagcaggcaggcggtgagatacccaggggttcagcatctgcacaatgtgggcagtaggacggaggggctgggaggcagcggggaagcggagaatcagcagagggcccgggacactgggaggcagtgggaggaggtggggggagccaggtgtggggtggtggggtggtggggtggtggggtgggagagctgcagggctggtgggtaactgagagggggctcgggcaggggaggtcccgggtgcgcatcccgcccccaccattggatgaggttgctgatgccttacagcctcgctattggctcagggctgaccaggtgcccagtgggcttagtgccacacgtggagctagctgagcagaacagagtcacgcgatgtttgtgttgacatctctcactcctccaccccaacaagcacctgggccaaatgcccacaccctcgccctttgcagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactagtgagctggggcaggagcgggcgggcagggccgggggcaggagcaggggagggtcctggccagggtgccaggtgagctgttgcaaggtgctcattaggcccccccttgagaacttttgcccatccctggcctcacaggtggctctggctgggaaactgcctgtagctaaggccgaccttcctctgctccctgccgcccacaccctaacaatgtggtgaccacgagggggcagagctggggctccaggggcagcatggagggtggtctcaggcccccagtgcctgctagccctcgtcatcttgcagcctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgagtgagcagcagggaggtgccggggtacgcacggagtttctgattctattgtcgtggtaaaagaggccgaacgtaaaattcaccatttcaaccactttacagtgtacagttgaatggcattaagcacgttcacaatatcatgcaaccgtcaccactacccagttccaaaacacctccatcaacccggaaagaaaccccaggcccatgagcagccctccccacgcccctccccagcctcatgtgcttcctgtctgtatggatttgcctgtctggacatttcctatcaagggactcatacactgtgtggccttttgtgtctggcttctttccttagtgtaaagtttttccgtttccctcagatattagaccttcctttctttttttgttttgttttgttttttccctcaagccatcctcctacgtcagtgtcccccgtagctgggattacatgtgcatgccaccacgcccagcgaattttcaaattttttgtagagctggggtctcctcatgttgcccagggtggtcttgaagtcttgggctcaagcgatccacccacccggcctccctaagtgctaggattacaggaatgagccactgccaccagcccgaacttccattctttctaaggctgagtaatatccattgtatgctaaagagcattgtgttggtccatccatcccttcatctgtctaccagcacgtctaccagcacgtgagtcgtttccaccttttggctgtcacgagtcacgctgctgtgaatattcacgtacaagtttttgtttgaacccatgttttcaattcttttgcgtggacatctaggagaggaatggctgggtcgtggtgtccacgaaactgttttccacaggggcagcaccgtttcacattcccaccagcgacataggagggttccaccttctccccatcttcaacagcacttattttctggtgtgacaatgctgatgggggccatccttgtgggtgtgaggcaatatctcctggtggttttgatctgtgtttccttgatgactaacaacgctgagcctcttttgctgtgctgactggccatttgcctgtcttccttggggaaatgtctgtcctagccctttgctcattgctgagttgggttgtttgtctttttattgttgggctgtaacattttttctgtattctggatcctagatccttatcagctatgcgatttctacacattctgtcccattctgtggcctgtcttcactctcttgatagtgtccttaggtgcacaaatgttttaaatcgtgatgacgtccagttgatctattttcttgttgttgcttagagatgatgaaaattttcttagagatgatgaaaattttctggaattggagactggtgatggtcgtgcagctctgtgactatactaaaaaccatcgaattatctactttaaatgggtggactgtgtggtgcgtgaattatatcccaataaagctattagaacaaagtaagggagagtgcacagcgtcacctccaaatgccctggcttccccactcccactcagccttcccggactccacacccttggccttggcgtctctgtccacaagtcacctcgctcctcatgactgccgtcccagggccctcagggcaaggtcctctgcaggacgcccagggctccccaaaggcccaggcccacgctccttcctgtgttctgcggactggaccaccaagtgcaccctgcctggccgccccacccacagcgctctcccagaactctgccaggtgcagcgctcactgccagggccaggaccacctcctccctggagccatccctgctggtgtgggggcctcagccctctttctgtgcttcttttttggtgggcactgagggacactgaggcactgcggacaaaaggcccagcccagcttcactcccccttactcccatgcctcagtttccctggtggcatggagatcacagaatacttatctctggggaggggtgtgagggttccgtgggtgaatccacatccataggaggctctccgtccacacagcttctgttatgatcatttccttcgtcaccagcctcccatgcagtggcagcacctggcactcacagccccactggcttcttccaccatgcccgcctctgtgaccctcggctcctttgctccctcctctccccacctgaatcctcccaagtcctgtcccttttgagaagctcctggagtcatgagcgctctactgaggctgtggctgcctggacgtggttatagcgattgtccacagacttcagtttttgcccaggttccacccgcttgccctatgaagtctgtggtggagctgccatgagccacatgctcctgcctccctcccggtctctcagcctgcagcagtgcatgagcgtcctggtgccctcaagcaacagaaatggattctcccccagttctggaggccggaagtccaaaagcagggcgtgggcagggccgaagcgcctccaaagcatctcagagaggatgcatcctgcatcctccagcttctggtggtggctgccagtcctcgcgttcctcagcttgcagctgaccctctctaatctctgcctgttgtcacacgcccttctccctgtgtgtctgtgttctcacacggggcactcctctctgataaggaccccagtccttgactaagcccccaatccagtgtgaccagcgctgttccttgttgttctctccccacctccacctcatctctgcccaccccctgcctaggtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtagccaccaccttctctgtgagctgccctggtaactgtgccctctgcccgagcttgtccggactggtaggggcggccttccttcacacacagctgctgcggtccctccgtagtacacttgagccccgtcctgggtgctctcaccctgacacccgcacaaaggctctgtcctgcctgctggaaagcccttcccgcttgacctatgggcccagctcaggctccaccttctaccaggtgagaaggtggcagtggcggagagaccgtcgacatttgggatctgatccacccaggaccgatggactggaggtggtgctgaagcctgaggggacacaggtttggggcacagggtgggcgtttattggttgagggtttggctggggctactctacggtcaggacgtcctgtggcgagctcacagcaaaggtcctggcgggaaagggagcccagaagcatatccccatatggacgatgccaccaggggagtccagatgaggggacctcgagggccgcgtggcagatgccatggccttgacactgggaagtcactttgttgttgaaagatcccagaccctggagagtgtggaggatggccggccccggagggagaatgcaaggcatggggtgcccctctgtctccccagggcctctgcatggcacccacctgtgtcacaagcagggccactgtgaccctgacaacttgtctttgtaggagccaccctgggggtgcaggtgcaacctgggaggagaagcttctgggctctccttcgggagacaggcattcatgtattggatcatgtagcaaaaacactcaattcaaagacagtgcgtctaaacgccagccatggctcatgtcaacagagcagccccgtgccccgaggagaacatggtcactgcgcccagagagggagcacctcgagcttgccctgggagaaaatgggtggtagcggaggacaggggacagaagtccagcgagggaaatgggccccgcaaaggcgggcagcggcatgagtcccgggccccactgagcctgggagagcagaaggagagggtgctggtgaggcgaagcaaggccacacttggggacaggagccatcgagtccctctgttggaccagggagcaactgaagcacagagcagaggaaggaatcttgccagaggggcctggggaatagggacagctcctttccagcttaagagtggctgagagagagtccaaggggtagaccacagtgacagggccaggctgcggaggctgggcagacccccacaaagactggccagcctggtggtggctgaggaggacgcacagaaggcccagcgaagtcctgggtgccggcaacaggcagtaggacacaagggcctcactgaaaccgccagggtgcttggagatgcggcacggctgcagccagaggagggcccgtgaggctgggccctggggagccataggaagcctgtggctggggtggtattgatgctggagctgggccggccgggggcactggcaacttctccagacacctggctggctgctgtgctgtggggccttggggagaaggcagggagcagggctgagcaggcgaggaaggacagcctggcctggccctttggggccatggggaaggaactgggctacacacactgggcctgaggagggaggaggcctgggttcgcagctgctggttttcaggctcgtcacggccacttggtggcagcagaggggtggcttccagacttttcagggacaggcattcgctggctcaaaggagaattgtcttcttgtggctcgtgatcttgttatccagcaccccaagatcctcagagagtacgaagtgtccccgaggctggcagtgaggccacttagtggtatatgctgcaggaaccattggatcaccctgtcacagcttagagtggggcccccagctgtctccctggcaaagatcacagcccccctgcccatggcctcagggggcgccaggattcagggactcccaggtcaatgtcctcccctggtgtctcccggctgccctacccctggctcccactcctgcgtgtctactccccaccgccgcaggctccccaggcctggcggctcggccacacctaggcttctacacttacccgacggtgctcacaagccccactgcctaggcttgacctcctcattcaggttcccaaactctgaacctggctcctcttctcctctccccctgcccgtctacctcagtggcatcagctgcctgaccctgtctctctgtccccgagcctgaagagccacatacctcttcatttgggaactgtcttccctgtccccccaccactgggacaatgccaccacctcccggccagtctcctggcttcccgctctcaaccccttgcaggctgttcgctttccactcagcactggggaacctctttctctttctccagaatctaatgtgatgcaggtggtccccaacttttaacaattttgtaacttggtgcaaaggtgatgcacattcagcagaaactttacttcgagtcccatgcttttccctttcagtgcaggattcaatgagttacatgagataatcagcactgtattccacaataggctttgtgttcaatgcttttgcccaactgtaggctaacacaagtgttctgagcacgtgaatcggatggctttactctcacctctgctggaccttgggccacctgcagatctgatggaggaaggggtactgcctcaacccaaaatacgtcttgcctcgatggccccgcccacctctcttgtctcttctaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgaggtagcacccggctgtctgccaccccagaccccccttctcctcaccccagccccctgcgtgcccgccttagctctgcagcgtccttgtgcttcccctccccagatagaacaggagcggctggacaaggtgtggcccaagctgagggtgctggcccggtcgtctcccaccgacaagcacacactggtcaaaggtagccgagcccccacacccctttcctggggtggccagcccgaggttgtctgcttcctgacaccaaaagccaggttcccaaacaggtccccagggcctgcctaggaagctgggtccatttgtcccattagcccagagcagcagggcaggggcccatgagggaaccagggttcggggagggctagtgactcactccaagtcacacagtgagtctctagaagcagtgggtctagagccagggacccaggattgtgtccccaggccctaaccagatccctatcctcccaccctggccctgtcactcagtgagatttgcttacttatttggggataggagatgatccaggtgacggggagcacagataattgggacagtcaggacggggtaatcccaaagggttttcacagccaacctacccccatagctccctgggcagggctacacagggttgtggtgacagatggccccagccctgccctgccctgatctgtcttccagggattatcgacagcaccactggtgagcagcggcaggtggtggctgtgacaggggatggcaccaacgatgggccggccctcaagaaggcggacgtgggcttcgccatggtaagccacctggtgcccgcccagctcaccacggcagatggggcctgcatctgtcccatggacattagctttgtaccaggaagtgggagccagtgtcggggcaggttacagagtgcctgaaggttctttctttcacatcctggccacttgggcctgcgtgggctctgccagtcgggggacatgtggttaaaggcatctgctgtgatgcccaaggtgacagtgggccccagacatactgtggagaggaaggggaatggggggtgggggctcatcactgatggcattgcccacccccgtcctctctaaatggactctcagccccagatgaggtgagcagagtccccagatgtgctcttcctctgcacttccttcctgttgctcacccactgagcagggtagccctgcagacgccacccacatggctggttgcggcccctcagtggccccacagccactgaacgcagcaacctggtgagcccctctccctgccctaccgaaaaggagtgtcacccagggaacccagcccagtccttcccagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagcaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaaatcacataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggtaggctggccaggggcacccgggaggacttcaggacactgttgccaccacctcgggctcagattctgtctggtgtgtctccacctgtgtctccgcacccagtacggggtgggacgctgcacttcctgactggacagcacacaggggaaggagcagatgggccaggctagcaaccctgcagccaggcctgctggtggcctacagctctttcgcaagcctctcctcccaggccgctgagcagctgagaaacagttcatgtcttgacatcctgcccacggctgtgtagctgtgtagagtaggcagcttctacccagccccagagtggccacggtaaccctaggaacagaacagcccacatttaccctgtgaagattgctcctgtggagtgactggggtgccgtgctggaagctgtgaggtgggtggggggtgaccgcaagagagaggaagaggaggagggcgtccgaggaaagccagccttaagaacttcccttcttaatctcttccttcctgccctcaggctcagggtctggcccctggcccagaggggtctcaggactctggttggttgagcctggggtgggtgtggctgccttgggccttggccgtgagctggaagtggccatcccctgggacaagggacccatctcgggagctacacaccgaagtctcgctcctgagtaatgcgtcatgcgctgagatgactgtgcctgagtggggaatgttgctttccaggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcaggtaggaggggcggctccactcttggcctctgccacttgcaaaaagtggaggtggtgggcttcaagacccctcgtccacccctagtactggcctccccacctccactcccagaaggagccccaccccacctggctttcctgtagcccccgtcctctctgcatgtcggagagggccttcttcatcttccaaacattgccggccttgccctgggtgagcgcgctggcttccagaagggtttcgtgagccctcatcggaacgaagttttctcacagatgctggaaggagtcctccctggctccctctaggtctgccattcccatttctagcacttaattccttggcatgaggctgccataactccagaagtttcttttggagatgacctctgtgcccagtgctgacacactaacctctgcttcccacagtgctgtggacaggctggtcagccccactgtctaggaggggctaagtgttctaaaatatagtgtatttgtagaaaaattgaggtatagtaaggccaaaaggtcaagagacagttgccactgaaagacagtttatgactcagagaccccaagaggaggacacatgccacaccataggggcccacatgggagagcgccaggcaggaggtggggtgtgagagctgtggacaagagcctttgctgtggttccctcggggaggagcaggtgaggcagggctggtaggctcaggactggctaggttgcgtcattgcagcggttccagggcatacgggtgctccctggctgtctggtacctggtcctgggtaatgagtgcaaggggatagtggcccggaatgtgacagtccaacagaggacggggtcagtttgcatttggacagcttgcccctgcaaattggatgcctcccgaggaggcaggaggccaagacaaggtgacctcggcaggttctagggtcctccagaatgaggcatgtccagcgtgcccgcagggtgggtgtcacagcctccgtcttgctgaaaataggagcatggtcagtggagctgggccccactccgaggctggagtcagtaggtgcctggcacccaggggcgctgggggccatgcactgctctgtcatcacgcccccggccttgtggtcctctcgcaaggagcagcccgtgcaactgggggaaccaaccagggtggctgggtcttcaaggggttggaggacaagggtggctcaggagccgcggctggacctgcctctctcccacttgcccttcgcagattgtcatcgtccagtttggcgggaagcccttcagctgctccccactatccacagaacagtggctctggtgcctgtttgttggtgttggggagctggtctggggacaggtgagtgacagccctgcccctcatttcagactgccctgcagacagcttctgtgatgggcccacttgccctaaccctgcttcagagccttggggtcctcaccctaggaagcacactgagggctcaggcctgtgacacaccaggacccagggacaggacgcaagggaaggtgtcagcaaaagaatgcaaaggaacatggctgggatgtgacagggcccaggaaaactgcccgcagctcccctttctatgataagagccaaaaattgccccttccaattgggtgggtagcttgggaaatccccacatattttaaatcaatcaaacagcaccctgatcaataatccatggggcgaaaagaaagtctccagagaaattaggaaatattttgacctgatggaaaggacagagagtcccacatcgagctctgtgggctgcagctgaagccgcacactggcaggtttctaggaccccacaattagatcaggaagaaacagcctgggtatttaggatccgcttatctctgtcttcatcagctccgactgccatagcaaaataccatagactgggaggcttagacaacagacacttactttctcgaagtcccggaggctggatatccaaggccagggagccagcggggccagttcctggtgagggctccttcctggcttgcagacagccgcctcctcactctgtgctcacatggtggacagagggagcaaggtctctggtgtttcctctcctaggagcattaatccagtaggatcagggccccaccttggtgacctcatttaaccttgatcacttccttactccaaatccagccacactgggcactaggacttcaacacatgaactggagagcacagttcagtccatagcattctggcttttcctttttttttttttttttttttttgagacagggtcttgttctgttgcccaatgtggagtgcagtggtacaatcacagctcactgtagcctcgaactcccaggctcaagtgatcctcctatctcagcctcccaagcagctgggaccacaggcacatgccaccacaccaggctaagttttgtattttttgtagagatgtgttgtgccatgttgcccaggctggtcttgaactcctgaactcaagtgatctgcctgcctcagcctcccaaagtgctgggattacaggcgggagccaccatgctcggcctggcttttgtttcttgatctctgtgccggccacaggggctgctgcagctgctgcagatgccagccttcttgctggccccagcattagtgtcctcggggacagcccacccagttcctgtttcattttcagaattctcctttccctctgctactgcacctcacctccgaatcacacttgaacctggttgctccatggagtcccttcacttcccgaaacctggactctaaccacagcccagaggggtgccaggccctcttcttgctcttcaagctcccaggccactggccttctggtccccccaggaatgtggcaccagcctgtagctcggcctctcagggctactgggttgtccttttcatttttaaccttgttcagttacaaagataaaacatgttcaagagaaaaacgaaaagaagggaatctctgtgaaccagtcctcaagtcccctcctggccatgttcgacaaatacactggcatagacacacaagacagacgagacgtcttgctctagaactccagatgcccatcatccctttctgtggcttcccctgcgtccttctagactgttccccccacttcccagtggcctacaatatgcgaagccatgccctctctttactcctgccaggctccttatccagtcaccctttccagctgtcaccctccttgtcacctcccaccctctctagcccccaatgcacaggtcttctctaggctggtgttcctccaggagatgccctctccaggagagactaggccagagctccagctgtcctctcccaggggagttgcgcaaacagcgcctgtgtctcccagcaacggtgtggagcgacatgcagggagtattgtcaaccagggcagctcacccaggccccggtgtccagggcttttcttgcggtggttcacagagccatgctgtggtcacgtggctggcctccatctccagccctctggaggtccagctgttagtgtagcctacggggcacggtccccagccccctgccccactgagccatgctgctctcaagcaggatgttccaggggcttagcgatccctcccaggagcccttgctgcaccgcgttccactcgggccactccctgggccctttggctgaatggagctccatggaggatccgcttatctctgtcttcatcagctctgactgccatagcaaaataccatagactgggaggcttagacaacagacacttactttctcgaagtcccggaggctggcccagagctccacgtactcctgaaaatgcatctcagccccccgggggaacactacgccagttctccaagggctgccagttcccggggggactgctctagctttactccctttgcttagtcacaaaaacaaatgacatcctttggaagaaggaggccggcgtctccctctggagagggaccttacaccaggcagatgctgctcagcctggctctcacggccacttccgtgtggctcccccaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcaggtaagccccgactcgctctcgccctggcacttccaccccaagagggtagaggcaagctggccagcagcagccgagagccggccgtctgcacccgacacccacagggaaaccctttggtcttgctgccaaggtcacaaaagcagctgccagtgtcccctttgccattccgggctgtgcccgctgatggctgtggcactgagatcgcctctccctgacagctccttcagagcccaggcatcccctgtagctaaaggtgtgtgtgggtgactaatggctctctcagaggcacaggccagcaccgtcctcatcactgctggggctcccttcacttggtgggaacggccccaggtcataggcaagtgacagtatcgggaagagaggcccatttcaaacagccaccagcgagctcaaggttcactggttgacactgtaaatgcgatggggagacttcatttgggaagtggactctggccaccgagttggtcctttctggtcatccaaatcaccaagggttagggccggccaagaccaagggcgtcagctgtgttcctctctgaagtcagatggccaccactgccaccagtatcaggcgcttgccagagctaccatgctcccttgttcccatctcctcccggccaacagttttgccagaatgctccagactcgctgtgtctccacacccctccctggaactctcttgtgatcccactacagcctggcctctgcccaccactccccagaaacggcgctcgcctaggcctgcgaggctcccttccggctcgtggggtcgggctgtccctgcatcgttcctgcctgctgtgggcactgcctggagacttgctgtcctcacccgcctggcacccccacctcctgctcagccctcgccccaccctgctgtggcccttgagtgctgaaaatcctggccggggaggaagaaagggcccatggggaccccacctgcggcctggcccctctcccaccgcagcccctgcagcctctccttcatggcctgcccctcccccagcagcctccagagggccacccagcatgcttcacactccacctccttctgcaaggcctgggccaccatctctcaggtcacagccatcactccctgcccctccaggccctgtccaggatccccagttgcaatgcccctgacatggagcgactgaccctcctccctgaggtcctgccagagtaaggacaccactgcacacttggctgcggagccagggcccgcctgagccaccagccccagctcaagcgggaataggcggggcctgaggccacaccccttcccagggtcagtcacacatcaccaagggcctgtcccaaagaatcatccatgcaacttgcacaaagctgttcttggtgccctgggtcctgtgttccctcccagtggtctcaagggccgagtctcaagggacccagcctcagggcaaccccactccctgggcctcagcctcctttgcttgccttggctcagctcagcccctccaacaccaccctctgcagtgggactggtggagcctctctccattgtcctaaggatgaagtctacgctcctgaccatggccttcaagcccctgcctcttggtgtcaccccaaccttcctgcacacctgcacccctgcacccccggctgcctttccaatcatgccctctgcccgcctgtgccactgcacctccccaactcccgctgcgtcccctgggccctcatgcttacaaagccctctttgactcctctcactctcaccacgggctccttgcaaaactttccagagctacagagtcccccagagaccacgatcacgcagggctaggtcaaggggcaacaaagaactccacatttcaagagccccccaggggtccaaggggcctctccagctgagaaccgggaggcgaggctggcatcctaggcaccgaacacagcgtagcctgggaaggatgtgttaggtctggactctgaacactgtcacctatgccctggcctggccagaacacagagagccccggtgaggaaggggagcaggctttgtcgccagatggcctgcgtctcccctcccacgtgcaggggctactgcctcaagcacaatgctcggacaggccaggggtgcagcacagatagtctgttctcgttccctgcaataaatatttctgcgctaaatcttaaacacatcgaatgttagaagcagcattcacatctcccccagtgccctcctagcggcccaactgtgccttctacgagaccatgcctatgggccccccagctgcccccagatgggctcttatctatcgtacccctgttgtgctacagagcccagagctgcccaagcctggggtggggggtgaggacagcaggaccttgcccctcggcggcccacttcactcctgccgccgcagccgaaggcgacgttaggttttccagcagctgagacaacagccctgccctgacctgaagcatcagtggtgtcagtggtaccccggccacctgtgtgtctcgtgtcctctgtatgtgggggccgctgcagcctggctagtagaagcgagtcccatcggtcagagtcttagagttccaggctgttccaattgtcggtgctcacagagacacgggcagctgagtcccctgttttgcgtatgaggaaacagggtgcactctttccccttggcaccagccgatccgactcttccacgggctcctgacccccatggcttttcgctttgactttgtcacatccaactcaccatgtttctcaggaatgctgaaccagtcggttcttttagccagctatgtaagagcatctgctctctttgattcgaaacacctgcttgaaaaatggagctaaagcttgggagaagcccgtcaggttgtacgtatgccccaagccaagaaaaacatttcctaggcagctggccccaggtttctgctttttgggaaccacaaaatcgctccccagattttggaggccggcacaagcttttctgttgctaagtgaaggcattttgtaacctgctcgcaccatggttccatactaacatatcaacgcaccagatggacagggtgtcattccagaataaaagagtccttcaaacccagaacatgtagctttctgaagcgctcatgactcggtctgtcttttttgcatcccattataatgcaaagagaagcttcgtcagcaactgggccttgctcccggctcagctcttgggcttccaggtgtggggtggtggcgactgtggtattgtcactgatgtggctctcccactgggacaccatctgtagccaggccagaccaatgcaaatctgaggcaggaaaggcatctttcctatccctcatcacttttgccgcagcgagagtcctctcctgaatctagacaggagaccccccaccccgcaagccaccgcgacgccatcacatcaaccatcctccttccgtgcgctgacacactcagtatgcattcctcacggtcgcagcaagtgccatgaggttccccttgtgacaagcaagcgagtgggatgtgctgggcggaaggggactgggcaggctgagaagaaggaggagtcctttccacagcgcgtcaaaggctgaagtggcgtacatcctcattttggccggtgcagggggagtctgaacactcaagctgccttcttccacgaagccctggcccgtttcaagacacccaggtgaacctggtggccaccacatagcactgcagggctcgggctggagcaggtagctttgggctccagatgcgcacactggctttgctgttcacatcatctccagtgagacggacatgagtccccatcccagccaagggcaggtcaggaaatccaaagacactgggtcaaggccctcctgcaggcctcagtttccccagccttgcttccccttcaatttgcaggaagctgtaagagtggggacaaagcgaagccacggctgccagtcggtgggaaaaccccctcctccgctaggtccattcttctgctgaagtttcgagggggcgccccctgcccagtcactcagatgagccacagaagctggcggagacgggcaggcggatggagcatggggcataagtcctccgggtttagaggaagcagggcgggttctaataggagcgtgtcatgtccctcaggtgtgttggagaggaaaaacaaggttgagaactatgaagtacttcctgataagtggcttgcaaggggcatttctgacatgtttgcagtgtgccctgacttgtgacccccttcccttcccaatctcatgaccactaaccatctgctcagcaaaccctctctcggtgggtggcacagaggctggcctcagtcagggccctgtccaaacatcgccagctcccagtgagcggggtgacccgatgaggctttgctgtcaccctatgtgcccagtggtggcccctatcctcgcccagccctcccctccgtgatagcctggacaacagtgcaagccaaactttatctcattttctctcccacagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggcacttccggacctcccgttctttgctttgtttggtttttcggtttgtgtttagtgctccttgtgccattggttctcttttcttgaacttgtctgcctttgccgatggttcttcatgaacttgggccgcttctgggggtgtctggtgtcaggctagggccttgctcagtgttcagtggtgcagcatcagggcagcacgcgggctcagggccgccttcccggggctggaggggtggcgggtgcctttcccacactgtttgccacagaagaatctagcccacgtacccaggaactggagcggcgcttccagcatcctccttgaagtggtttcctaaggatgccgctgtcacctgtccccaggtgggctcagtgctgaccaatcactactgcacaggtggtgcctgccctgtaggccttgccccaagccaccgggtgttagaggtttccccagaactggcactcagaggcctcttcaagacgttgccaggaaaatttcccaccatgttggtcacagtttaaagagaacccaggggctgtcctaaggaggtagaaacttccagaattgctcacatctttttacaaagacaaagggaaggccactccaccgctgaccccactaccctgatgggagagaatgcagggaacccagtgggcccagccaggcagcctgctttttccagcaaactcaagagagtttatacaccaaagagtaaactttcgcgcgtgggcccagggcctttgccaggatggttctatgctacctctttcctttccttctagcaagcccccgaagcgctcccctctgccaacacgaacacgccactcccctgcaggtgggagtccttaaccacgcctttttccatcacagactcttccagcttgattgcttttcttttcctttctttttttttttaggaactggtgagaggtccctggtgggggtcacccctcctcttgcataagctgtcattttgggccactctgtcctttaaggaagggaggaggcccatcctgtcccccttgggaacagagcacgtgcgcgcgtacacacacacacacacacacacacacacacacacactccttctccaaaccacaggccacgtacacctccagcttgctccacactcatcatggggccacctacccttgtcacaaatattggctgacaccgtggcagttgggctgaaaagcagtcggcgcctccagtgccctagacgtgggcccaaaggggcctcgccgccactccacccagagaggcggacaggaggctctgccaagtcagttaaagccagaaatggttcgtggcctcccagcaccttccttcctgggagctgagggcagcagggggcatggctgtgcctccgcctccctcccccttgacttcctccgtatgtctctttgccatctctctctgtgcttcctgtctgtctgtccatttgcccatttgttgagttaaggggaaggcagccaccacggccccactccacgcgttcctcgagccttctccacagctctggcctcatcccaccccaggaccagctccttgtccctctccaggtccagcccagcctctgtggggcctgctgtcttttctccctctggattcctcctgcttcctccctggggcagcctcttgctcctctcttccttggctcctagcacttccttcctgccttcattccgtggccatctgtccccctcctccccacctccggagcctggcagtgcggggtaagtagagtgggagagacgccacccctcctgctgttcacaagctattccatgggggccctaagtggcggatagccagaaggagggcagctgtcccttgcacactgtgtgctccagcagaaggtgggtggcagggccctctgaagaggcccatcccagctgaacatcagcatcccagaaaggactctgccgtggaggaagatgctggctggggacctggcaacaccaaggacatgcccacttctggaagccacctgccagaaccacctcctgccatcatcacagtgcagcggattggtttagaactcagaacccaacccccactccacgcttcaaggaccccaagcaatcaccaagcccagcactctcatcctagagatcaggggaaggaggttgtccccaagggccaggacctgcactgggtcccataagcagccaggcctggcagagtggggactagcaccagcgcccaccctctacttggaactttctggtggatgagagatgctctgaaggctgtgacggagctcccctagacaagagggctgccccaactaggcctgcaggggcgtcgagtcacgtggtttcctaaggcaagcccacagtttcccatcctctttgcctgctccaggccaggctgcctttcagcccaccaggagtctggggcctttctgggcactggagctgcctccgtcccaagcctttcctactaaggacctcaggtcctccagagagaagggccggtggttggtagcatgacatcccctcaccctgtgcccctggggccaatgcaggaagtagcaagggggtggctaggaggggtcgagagatttgggatcgctggggctcagtgctcacacactcgagccctccccaccctgtctaacctcccacacctttgctgcttctggactcaggagtcccaacacaggccccatatccctcctctgcatgcattgtcagactgtgccggccacaacttctgacccccagctccaggcagcctccactgcccctcccctgcccagcctggtgactaccccacaccatgccccaaccacacactcacacaccgaggccacagtatcaccctccctgttgggtgtccatattccggagagctggtcagggacagctggttcagtcactcgggtctaccaagggcagcaggcacagggggctgcgcgtctgccactaggaggcacgggagggtgcgcgatcatttggaaagccccatcaaagccacttgagaggccttttatgtctgttttccactgggacacacagacaaaccccagccacgcatccaaagtctatccttccagcagcgccacaccaggcctgtgtgagatgcttactgttggagtcgttcctgagatgcctcctgacctggcccagcaaaggagcaggggttaggcagcaggccatgagtctggtcccatgtggccaccgggggtccctccgggccgtttagttccagttaatcatgctggaaacagatcacagcagttgcttggttttattggctttggcaacatgaaaaccgtgtggccaaaggggccaaaccgggccacgtgagtcccaggctttccctggacactcctttccagggcccagggcgacatgctcaccacactcccagccccgtggtggaaggagtcttgttttctggagtttgctccattctcaggaaggtcatgtgctttgagccaagcctccctacctggtttctgggaacggtgtattggcattttttctcagatctttgacagtctgcaccctgcctccatgctggaagcagtagcaaccctcccccaagagccctgccctaggctttcctggaaccctgggccctaccacaggggaatgcccttccaggcaaaccctaaagtaggcaccagaacgcagcctagggcagaccccaggacccctggtccaaggccctccccatcaggcactccgagtgtggactcccaagctgggaacctgggcagagacctctcaagactaattggaggtcccgcagctggattcagccagtacggaggcaagggctcagctgggccttcctcctgggtcctctttagtccgaccacccgacactgactcgccgcgcccaggtcagttcagcttgctggtgttgggagcacaggtctaggctcacacggtcctgggcatgagtgtgcacacaaggtgggaggcaattttcatgaaacttgccagctgcaagcagttctggcttgccaacacacacacagccatgtcttgtcttttccgttctttggttcaattccttggggaaagagccagctgtggagtttgcattttcattgttcctaattcaagcatgtgacatccccatggggtagaaaggggccttccccttgctcttcccccacatagagaagtgaggccgaagccatcttctcctcagtgttcaggctatctgagcttggcttctcattgcccgagttgactgatggttcctattgccacaggctcttgaggacacctttgtctcgctttcaagttgtgattcaccttcacgcctacaggggttgttttgagcctggaaaccctaaagttcttgacaagaagttccccatgggtctccctggctgctgtgttcagaatctgctctaaattcaaagctcagatgcctggggagctgacaggtccctgcctccaaaggaaggttctggaccagtggttggtgctgagcagtggataggtagggaggaaatcgaccagaagcatccgagttctgtgaaccttagcggctgagactgagcagagagcatggagcccctcgggtcggctggtgcccagcacagaggcagcaggatagggcttgtttctgcttgaggaattagaaggaagagtgagaaggtgtcaggcacagcttctgtcgtttcgttgtcactgcggtcaggagtctttgctttgattgttctcttttcctttcctttttctactcttctcggtccttcgcttgtctccctgcttctgcggcccttctccaccctcatcctcctccccagccctgcactgcaaactccagcacttgaaggctaaccaggggcacgtctccccatgcacatggcgggcacctccactccagctggccggcagtggcatcgcacatggcactccacacctgcaccccttccgctttggctcagtgtggccagggatgggccttgtcagtctgcagcgtcacccgccctgtgtaaggctcagaactgctcatccacgcaagtcgggagcccgggccaagcccacagcactcagcatgtctcctctgggcagctggtaacaaactgcccgggacagcctctctaaggatgcgtacttgagctaagttcagaggaaggagaaaggccagccaggcagcagaaagggcaggggtcatggctccggggagcccctgcgtggggtgttcagaaacagctccagccggctgggcattgcaaagtgggcaaagagctatggggagggccgaagccagcacaggaggctggtgcaaagccgtgtgggccccagacattcagccccgtccactgagcccctgctgggtgcagcgagccagacagacagacccctgccccagggggattaccttccagtgaaaggtggatggatgtagggggcacttgaaggaaggagcagaagtgggcaccatgctgctggggaagacaagagtgaggggagccttcctggtgtggggtgcagccacagcaaaggtccccaggtgggatgtgccggaggctgaggggtaaaagagggcagagtgagaaagactggggccggctccgagggccacagccagtggagggcttgtagcgggggagaccaagacacgctctggttttcgggccgccgtgctaagggcatggaggggtgggggcgaagtgcaggttctggatggcgtttgaagggagccacggggctggggccgggggggttgggcctgctaagtttgagacccagcttagatgcccaagtctggagccggagccgagaggctgttagccgacaggtggaatggaaggccgagagccagaagagagtacctagacccagaggaggggccctcgggtgtcagggatgggagaggaggaggggctggagcagtgtcggacagcgctgggggactgtgaggagtaaaggactgtggcctctcagggccatcagccatgatggggaacggagaagtgtggcagagggagacagcaggaggacacaaggaggtggggacacacagtggggagccacctcgcctcacccggatgagatggggagtcctccagcccaacctgaccctcctaggggcatctctcccggaagagtgctttcatttcctttctttttaaattgtcacagtaaaacgggcttttgggggtacagttcaatgaatttccacacagtcaggacacgggccagttccatcgcctactggaaggtttagagccagatgggggaccaagagtctgacttggcagccagagagagctcggaaactccacctagagaagggacaggaaggatggagggctttgctggtgggggttggggtcccaatgtgaccccagggccccaggcaggacatagcagcagcaatggaggtgaggagaggctcagatgtggaagatgcttttgagttagggtagggcccacaggacacgtggatgtctggtacatagggtcagggggtcaaagtgcctctgaggtttggccagagccctgcactgggatgggaaggctgctggtgggcagagttcagctggagcactgataagagtcctcctcgggcctcctgcaatttgagaggtcccttaggcatccgagggggaacacccgggaggcagccagggcagaagtctggcagtccaggaaaaggtggacatggtgcagctggtatctgcagtatttacggtggcctgatggtctatagacagcattgacagccctgggggccatgagattcctttgggagcagtagggggcgtggcgcgtcctgggctgagagcagagcaggaggcggtgcaggagcctgagatgaggacagagtgaacccaggctggtggaaggagggcatccttgagcacccaggtaggagtgcagccctctgggatgggcctctcttagaaacgtttgttgctttccattgaaccaatctcccaggaatcgactgcatccttcagtgttgggtgggctgaaaacaccccaccttaacaccaacaccaaaacattgtttaatggcccaggattaggatgcagggaaaatagagcctggagaaagctgactcactgtcagctgtaacagactcaccaggactccagccaagcttagcacccccaaacagcagaatgttggggggcagcccttccatcctgcagcggttcactcagtcacttgtgcattccccaagtgtctgctgagcagctgctctgggccaggctctgttgttaagccacaaacaaggcagatgccatccgggaggggcacgctggagtagccggtgagaccggaggagcagtagcagcagaagcccagcctggaaggaagggctggctccgtggcctggctgtcctttatggaggtctttggagttgagccaggtgcagtgagacctgtgcataggtttgagcaggggcctggcctgatcacatgcccccaggtctgaatgaggccaccagctcagcgagatctcaccccacacagccctggggtcaaggcctgcagcactttgtcctttttgtgacttgatgggcaacagctttagcaggcgatgtcccaggcggcttccacaccacaatcctgtaccagaaaaggcctaaataatgaggcaacatctgcattggctacgaaaactgaattctgtttcttttcattaaaaacgtcaaattattctcaatttctgtgttacccctaattcagaaaccagtctggggataaaggcctgagtgagaatagctgaccatctgccgtctggcagatgtggctttcccgaatgcagagaaaatccgaaccagatttcagatggggtgctagaaaattccaatgtggagctttttggcttacttttttttattattattttaaataggaacggggagtatcactctgttgcccaggttggtctcgaacacctgagctcaagcgatcagcccgcctcggcctcccaaagtgctggaattacagccgtggaccaccaaacctggccctggctcactttttgcactggagaggtgatgaggttggcatcatttcagctgattccgaagcactgtgctttgcctagctgagcccctggagggctgaaagaaagtcaccgaaaaaaggtgattaattgtctaaacgacagagccagagaggaaatatttttagctttccaggcctggtctctgctgccgtgacacaactgtgcccttacagcatgaaacttaaaccagtaaaattttattaaccaaaactagcagagagctggggttagcccctcagcaagccctgacaccttgtctaaacccagaaaaccaaatcctaggtcgaaccttggccccagaaatgcttcagaactcctaatgtgtccacctgctcacataggcaggggtggacaggtgttggatgaaccccagggtctgcctggcagctcagcgctccgtctgctgccccctatagggatggcagtacaaggtgggccagctaccattggcggctgtgctgacactggcctgtgcgaggccaggcagaggcctccccatcaactcctggcttctagaagcaggagggggcccaggctgaggggccagggagcaaagagaggcagcaaggacttgagtgcgtgaggcaaggtggagaagccagaggagggaagggctcgctcctggagcagtgccctgccggagggtcagggggcttaagggctgccgtgcgctcagctgggggcagagggccactgtgccgggggagtctggggcacagcgggagctctttcatgcgggaagttccgctgatctgaggtctgcaaactcctgtggggagggatggccagggaacaacacagagcggagcccgggaggcagcagagacgcaagttttggaatgtctgactggaagatggaggaggagacgggagagaggacaggcggagtgaggtcagaagagcaggggcaccagattgaaccagacccagtcagacacgggggctgtgaggaggccacaggggcatctgagcagagacaggctttagtgggtgcaaatcaaaagtgtggccattttcggtctcagatacctccagctggggactgctgggctctctggcctggagctctgagtacaggcctgggccacagtttctggttatagccagatgggccccagcactgtggccagggtggagaggtatggacagagaggaggagggacagagccaggccagagctctggggcacccagggacagaagagagggcagtggaggagatggggccagggcagctggtgaggtggaagagggccaggcaggggcaatgtcaggaagccatgagaagcttccagaaagagggatgatcttctgtgttgagtgccctgagggatcaaatcagacgaagatgcagaagtggccagtggagttagccgcagggagaccctcgacatggcaggtcccggctccagccatgggagctgggggatggagggagacccatgcgagaaaggccggcagtgcccataggctgggaacttgctcataccagcaggtacttcggactttctggtaagatcgagaagacatcccactcaccagcattctctccttttcaaatcatctttcttttctaccaaattggaattcagattgggcagagaccccagaggtcaccaaagccactcgtctccccaggacagggaactgcggggtcacagccaagagcctagtgcagcactctcaagttccagaatacctgcccagctcagcctagagaaagacactgccatcttttcctgcatgcggatcggttgacgagaccaaggcccacacctgaaaactctttccaaaggcaggcagagccatcccattccgtagcagccctccaacaaatgggtggacatttctcatgccatgacccccagccattgacgtgggtggaatttaccagcaccagccggccactgactgtctccttccttccttcctaccttccttccacgtttcctttcctttcccttcctttcctccctccctgctcccacctcgcgccctgtccctccacctcccactccagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgtttttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagtccctaggtcacctttgtgctgtgctgtggagttcagaaacggggtaccatgacctggaatcttttgctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctggtctgggtaacgtgtgtgatttattatttggtgaattattgtgcagaacaaaacaaaggtgccttcatgcctctttaacagagctggagaagccccgggcaggaggggctttcccctgggtgtgcagcagcctggccggatgtgtatgcagaagaggaacttatgctgggatgttaggcccccagtgggaggggctccagctgctgcaggagccgcggctgtcttgacttgaaagggcctctagtacacggcgcggtggctcagtcctgtaatcccagcgctttgggaagccgaggcgggaggatcccttgggcccaggaatttgaggctccccgacacacatgcacgctccccacttcttttattgtggtagaacacagatcacataaaatgtaccacgttcaccatttgtaagtgtgcggcccaggggcagaagcacattcacggtgctgtgcagccatcaccaccgtccagccgcagaacttgttcatcttcccaaactgaagctctggccccgttcaaccccaactccccaccccccagcccctggcacccaatcttctactttctgtctctatggatttgaccactctaggcccctcatagaagtggaatcctacagtatttgcccttctgtgactagcatgatgtcctcaaggatcatccatgtggaagcatgtgtcagaatttcctttttaaggtgaatcatactccattgtctggatatgccacattttgcttatgcaatcagccatccatggacatttaggttgcttccacatttcagctattgtggaccatgctgcagtgaacatgggtatgcaaaccgcccttccagaccttgccttccattcctttgggcctatacccagcagtggaaatactggatcctatgggaactgtaggttgaaccttttgagaaagcgccattttccattctcatcagcagtgcaggagggttccaatcatagacgcctttgctaatcgaaagccacaggaagaaagcccaccatttcactcattcccttaatccacatgctgcatccctcaacacctgtgcctgtgcacgcccatgctccatggtcccatccctgcttgagcccagaagagccaggaaggcaatcctgtggccaagacttgccaatgaccaccctggcgatggcactaagaccacactcccctcatttcattggacttctcttccccttttcgacttggcagcaccggaagacgcattttccaggaaggctgccaagagaggagaaaaatggcttcaaagtcattcaaagcatcagagtccatgcttctaaaactggcaaaaagaccaatcaggccgggcacggtgggtcacacctgtaatcccagcactttgggaggccgaggtgggggatcacttgaggtcaggagttcgagaccagcctggccaaaatgatgaaaccctctactaaaaataaaaaaattagccgggcttggtggtgcatgcctgtaatcccagctacttgggaggctgaggcaggagaatcgcttgaacccaggaggcggaggttgcagtgagccgagatcgcgccactgcactccagcctgagtgacagagtaagattctgtcaggaaagaaaagaaaggaaggaaggaaggaaggaaggaaggaaggaagggagggagggaagaggagaggagaggagagaagacaagagaagagaagaataagaggagaaggaaaagaaaagaaaaaagagaaaagagaagagaaaagacaaatcaaaaacagcaggcagaagaatcgcagcatgtccttgctgcattggtgtccaagtgcatcctgaaccataaggatgagtaagtccagattgagccaaagtccataccaagacagctggcccttcatggagagacatcatgctaccccaaaagaatcgcaaatttgtgtctgtgaatcccttgtccacaagcttctgcttcaaacatgacacaggttccacaggggaaaatcggaactcagtgaaacagctgagtcctgggagtaaaggcttgcgcaggggtctgggggaggcccgtgtgtgagtggcccgtggctgctcacaacagaaacttctctcccagttctgaaggccagaagtccaaaatcaaggcatgggcaggccatgctccctctgaaggctccagggcagaatctgctccaggacctcctcttagctttgggcattgccagccgtcctcggaattccttggcttgtagatgcttcactccaacctctgcctctgttgtcgtgtggtttttctcccatgtctgtctctccctgtgcgtgtgtctgtctgtgtctctcctcctttttcttatacctgaatcaagcagctttattctcacccacagcacagttccatgcacgtgggaggctctgttaggttccagaagaaatataggcacggaggctgtttctggcttgcaattctgtcacctcagagtcctttctttctggaagttcacatgagaaaatagatgtttacacctttgctcttaagtgcttacagtgacatctatagtgtcccctggacttccagagatgaacatgaagcacatgatcctatctagaattggcgggcactaattttccccaccacaatgattgcctgttatttcaagcaactactatgttccttattggttttacattttaacataccgggccaggcatggtggctcacgcctgtaatcccagcactttaggaggccaaggttagaggatcgcttgagtccaggagtttgagaccagcctgggcaacatagcaaggcttcatctctaccaaacataaaaataaaaaattagccaggcacggtggtgcacacctgtagtccaagctactcagaaggctgaggtgggaggatcgaatgagcccaggaggccaaggctgtggtgagccatgattgcaaaagagagaaaagaaaagagaaaagagaaaagaagtggggagggagggagggagggagggaaggagaaaagaagaaagggagggagggagggaaggaaggaaggggaaaagaaaaaagaaaagaaaaaggggtggatgaattagcccaagatacacgggtgatagaaccagccttcacagccaagtggtctaactccagaacccactcttcgtttcttggaatgttaaaatgtatttgaatgctaaaatgtgtcttgtcttgtctttcctgtgtcttgtcttttgtcttgtcttgtctttcctgtgtcttgtcttttgtcttgtcttgtctcgaactgctgagctcaagccatcctcctgcctcggcctcccaaagtgctgggaatacaggcataagccacagtgcctggcctaatttttttttttttaatagacaagaggtcttcatatgttgcccaagctggtcttgaactcttgggctcaaatgatcctcccacttccgcttcccaaagagctgggatgacaggcctgagccaccatcccctgcctatttttaaaatgtttgaggaatatccatactgttttccatagtggctatagtatatcccaccagtagtgtgtgaatgttcccttttctccacatcctcaccaaagcttgttttcttttgtttgatagtagccattctaattgaagtgaggtgatatcctcgatgtggttttgatttgcatttccctgattcctgacgttgagcaattttttcacatacctgttggcgacttgtacgtcttctttggagaaatgtctgtttaggtctattgcccatttttaaattaggttgttattctgttgtctaaattccttatatattctggatattaaccccttgtcagacgtagagtttgtgaatattttctttttttaaaaaaaaaaaaaagataagagtctccgtctgtcgcccaggctggagtatggtggcgcaatctcggctcactgcaacctccgcctcccaggttcaagcgattctcctgcctcagcctcccaagtagctgagattacaggcatccaccaccatgtccggctaatttttgtatttttagtaaagacggggttttgccatgttggccaggctggtctacaaactcctgaactcagatgatccacccacttcggcctcccaaagtgctgggattacaggtgtgagctaccacacctggccatgagggccatttttaccatattaattcttctgagccctggccaccttctcttccttcctcttttcactaccacgctacacattctcattctgtttcccatctctccctccacataagcaaggagtttcacctggttgccagagcgcaggcaaggactgggcacacagtagctgctcaataaatgtggttctttgactgattagtcttaaaaggcttacaacaggtaaagcaggagcccacatttaggagaagttaatcatcaaaacccacaggggagttctacgaaatgaagggcaggtcagccagggcaagcctgcccaccagggaagcctgtgacatctgctcagatacttcattctgaagacactgaacatagtcgctctgtaaagtcaagcaagactctgccctgacctgcatcacccctgcccccacacctgcaggagccggagcccaccctcctgtgtaaacctaccagtcccccggccctacgccacgtgctgaacgtacgtctagcctgaaaggggacctagagagcgcctcctggactggtctatttcttacccactggcttttgagcaaggagtcagaggggtgctgggggccacagctctgagtttctccagcctccccatccagactggctaccttgacatttaaaaacgcattacttttagttacgttcgatcaggactcacttttctgaatgcaagtgatcctccctaaccccaggcctgccgcctgatggctgggacacactctacctgagagcactctgagggaaccagtctctgagggcccctcacacccccatgtgcagcatgcgctgcagagcaaagccaagggtccctattgacttgtatcaccttttattacacaaaatagatttcagccacgttgcacattcattctccctacaaatctggcttttaagaaatccgtagggattcagtctcatcgatttcatgactttcctttcattgatgtcatgcctgtattgtagtcaaagtcctctcaaaggacaaacgcagatgtggctgccttgggtcagctgcacacagtacactcccggcctgcccgctggaggcgcggctcccaccatcacctgcaccgcgacttctagggactggcaaagcggcagcatgccattgccttctccagcccttctccagcagcacaaccagtcctcccagctggtcctgtggggaccagccgtcatggcgacgtggtgacaatgtccccaggcagccgaccatcctgggcttctctttgggcaggcctgggccaggaccttaggggatctctgtgtccatggtataaatctgaatgagatcagacacaatattatcaatgattggcttggtaaggtcgtcattaaacacctagaaagaagaaggaaaacaggttccagttagactccctctatgttaaacaaggcacctgtcactaagcagagaatcacatttcatgggcaggggaggggcacagggacttggctatgtaggaagacagtagctctcctgcaaagccagtttaattccagcccgttgaggccaaacactttacaaggccgagaacattccagatggaacaggccttggtgatcttctgactcagagaggaggggacctgtccaacgtcatacagggaattggtaacacagctgggtccagagcacaggctcctgcctcctgcccgggactccctcaggtccagggtctctgcggacactggcaagaggagagggtggcagtccctgtgcagccacaggcaggctaagtacccggaccccacgcctaccctaacccagcccctggggagcatgtggacccactccacagtccggaccgccacgtgcaggagcactcgcaagacggcgaaggacatcctcggggcccatggcaggagggttgcagcccagggccacgccacaggctggggtccacaccctgtaccttccaaaggcaggtctggcctctgcctggctcctggaggataacctctaggcccctagaaaatcctgccccgtgtgagcgtcttggtttactggactgccaggcggtctgtgctaaccacatcatttatggtgagggccttgggccacagagtcccagccagatctctggtggctgcagcccaagtgaccagggttggccacgcaggcgctccatgcccatgcagcccaccacctcccacggaaaccctggccgccatggctgggatgagcttcccggttgtgactccgtgctcgctgtcccacactgttgccgaaagaaacaggtgccgtctgcacaactcccctgggcgaggagccgctgaagctcacgcctggtctctcctggagcccgccctgtgcgccctgagccttcgctcacggtaacctgtgtcctttccttgtaataaaccggaactgggagtgtgacagcttttctgagttccgagccctcccggcacagcactgagccccagggtgctcttcgggatccccaatgataagggaaatagtaagtaaagcagcaagaccttggtcagatgctgcgtctgtagccaccctgtgccagagcttgctgcctggggaaccaatgtaccaatcagatcaaggccttgggccaagtcaaggcaagaactggacctacgtccacccctgctgaatgctcccaaagaaccctaggttcctctgtggcctacaacctcaggtaggagatggtgacctggacgccctccaagtcctgactcaggaagcatagctgtcttaccctgggctctgggtgaaaaacaaatacttcagaaatgcacacttgcttgctggggtccatgacctgtgtgctcctggagaccccaagctcagaagcaatcattaaaaaacattcaggggctgggcatagtggctcacgcttgtaatcccagcactttgggaggccgaggcgggtggatcactggaggtcacgagttcaagatcagcctggccaacatggtgaaaccccgtctctactaaaaatacaaaaattagccaggtgtggtggcaggcacttgtaatcccagttacttaggagactgaggcaggacaatcacttgaaccaaggaggtggaggctgtagtaagctgagattgcgccactgtactccagcctgggcaatagagtgagactctgtctctattaaaaaaaaaaaaaaaaaaaaaaaaaagcaaggccaaaacgtggaagcagcctgcatccatcgatggatgaatatgttaatatcatatggtccatgcaggccatgaaatatgattcagccatcaaaagaaaggacattctgagacgggggctccaacattgtgctcagcaaaagaagccagtcacagaaaggcccgcactgtaggattccactcctgtgaggggcctcaaaggagagccgtgaactctgtagaggacagtggaaggttgggtgccaggagcttgggggtggggagttggggttgaacggggccagagcttcagtttgggaagatgaacaatttctgcggctggatggtggtgatggctgcacagcaccgtgaatgtgcttccgtccctgggccgcacacttaaaaatggtgaacgtggtacaatttaggtgatgtctatgtcaccacaattaaatgtaacagtccagaacaggtggcaaccctggggcacctgacagcagaagagacacagacccaagtcctaggaggagacactgctggcctctggggactctgcctttttgagggcagtccatctgcttataagacaaaaagcagcagtggctggaaagaggcaggttctccttctgctcaggaacaaggggatggagggcactcggtgtggctctggacgtggaagtttcagcagcattgcgtgacgacctgcatcatttctgaccccgctactgtccctgctcatctggcaagtcagagtgcaggcaggcttctccagggaagcacatcaagctgccatgctgagcccgtggcagataagtgacaggagtcaccgtaagaagtggcagccgagagcacacaaggaagaaagggtttcaaaagccaggccgtgagctctgcagcacccgggtgggtgaggcctcccaggatctcactcatcatgggggatcaggccctcgcaccccgccagcccacaggaggcacctggattccggaagcttctggtgcacagccccgagctgggaggcaaaggtcaggtcaagtttagcagagcctttaagaagagctggctgaacagaagttccacaccccacaaagggtaacttcttcccagtctgaacgatgactgggtgagtctgggccgccagcaaacaacttgctggtagagctgcttcctggctgtgcagggttacctgggctcgcactcctctgggaggggctgagcatgggacgcaggtggtactgccacaccaggtgaggtttacgagcaagcgcagaagacagagcagaaaggaagacagatgcagcatagccaggcagcccagggccagggccacacccaccagatgtccccagagggtgtttgccccccccagagtccaaccctgagcacgaggcagccacattatgtgaaagtccctgagcagcccgagcgtggggcaacactgtctacacagatggccctgcaccacctgcacactgccttggggacagggtgcttccggcttgagactgggaacatgggtgcatgggttcaaagacacatgagcacccgctttggtgccagggaggcgcgggagactggggaagagatgcccagcctcaggcactcacagctgactggggatacgagattacacaataaacacgcaaaaatcagcaaatgctgtggtcttccacaaggcacacgggccagggaagagaggcagggctacctctatgcagaacagcaccagccacctggaaagctgtcctatgcacaggcctacagagttccaccatctaccctccatgatctacctattaatacctatcaatcacccgccaccctgcccatcagctctctcccctatccatccaggtgtctgtcaactagccagctagctgtcacctacctagccatccagccctctccataaagcaccccagatgtttctgatgggaagccaggtttagtaacctgtgatcacagtcaagttcccactcaattcagtaaaagcggttctccgctggggcaaccctcctcccgggacaccggcgacgtcggtggaggccagcactcctgttcgacatccgggacccctaaatggcaactgtgccgagggggagagcctgtcccaggccatcgcaacagggtactttcgagcttccatgttccccagcagcccgtatctttcttcatggataattaatagaatttggtgagcactgcaatacagagacttccagagggaaagggggcacgtccagtgtgccaagcagccacctcacctgccaccacggcttctcagcctcgacctcggcgggcacctcaactccgtagacctgcagggccaggtagagcaccgccacggcgatgtgctgggcctggaagcggaggcacagcgccccatggtagctgtcccgcagcagggcccaggcggtgacggcaacaggggtccgctgccagctgtggcggttcagccagttctggagggaaaccaggtagtggagcaggtactgcaaagacacgtgtgtcagcctttaggcccaccagctgctctcctcatgctgacataatcatatcagcacctgctccaaccctccagcagcttccatgtccctcaggaagaagccccaaggccttctgctggccccatctcctgccgatcccaccctgccttccagcaaaccccatctagggccttcgcacttgctgagccctctgcctgaaaccagctcaccgtatgcacctgcccactctcaccctccagacccagctctagggaaacctacgagggccacccccaccacagtccctctccaccacagggcccgctctggccaccatgaaattcctcggggcctggtgctccggaaagcaccctcttcatgggcagaacagaaggtgctgctccccatgcatctggcctgctgccaagggcacatgctgtcctcggccacaacatccaaatgacctcccagcccagctgccagctcctgctctcagaacactgacattttgccagaacctcacacaataagacagatgctgcgagctctctggacagtctggaacacacatgcgtgtgaccccagcacaccatgcaggagggatacataggttactttccaccccagccctgactggaaggaggggaaggggctggcaggctcccagccacaccaagctatcagttccccatctgggcacagatcacacaccccttgaggtctgagtgctgctctttcctaagccctgtcgccttgacaactccaccctgcagccaccagggcatctcccaccttcccccaggatgctcagcaagcattctgcccactaagacactactgcgcagaaatcccagaccagggctttccaggtactgaggtgggagtgtggaaggctggaggcaagattataaaggcaacacgaagggcccatgcgggtggaaccgtctctcaccttggctgtggtggtaggtccgtgaacggagtcgtgataaaatggaacagaaaaatatacacacaggaatacaagtggaagtgaggatgccagtggactgtgttggttttggcatcctggctgtgttacccctgggggagactgggctaagggtacatgtcacaactgcatgggaatctacaatgatctcaggaagagttccgatgaaaaagaatgaaactcctagcccagagccccaaaccacaactcctccatctctgtctccggccagccttctgagctgcccgtgcatggagctgcggtgcccagagcatcgtgtgccagtcgcctaagcgttccacttttcccttttactgctgtttgaaatggttcttctgttgagactcacacattcctagaagttaaagcatgctgcttgactcaagcgatttggctttccccatggcttcctaagcacagctgagctggaggcgtgctccgaggcatcacagcatcccctggggacggggactctggccggtcacaaaaccagcctgcttccccgaggcccagcgtgcacaccatctatatggaccacaggagctgccacagcttcagcgggcagcacggaccccgcccacaggtgagcaggcagaaaggcagaagctgaaatgagaattggctgagaaaacccacaggggtgggacgggagaggccgggcggccaacccagccacaaacacagagccaggagacccagttcccagccgcagccctgctctccttctgtgctgtgctctcgagtatgagatgggatgcacttttgggataaagaacagagaccatggcttgagcctctccaaacaggcaccagttccccagtatgtaccttgtgtggatgctggaaggagacctggaagcgcagaactctcagcatgagaagctcacactgcacgatgctgtcccggagttcccagaagcgggagtccaattccaggggctcaccgcttgggttaaagtacctgcgcagagaaatggcaatgcttcagcagccagggcagtctcctgagcactggatggctcaaattgcttaagtcacacaatgtccagatgcaaactacatcgtccatctgcagattcatggagggtcattttatttgggtttttatacaaaaattcttcatctccacatctagtgtagagaatgaaaacagtaaccaacagaggaaagaagccagctcctagttttagccagatgggctgtccgctatcattcagcaaaatgtcaagtgcaaagactggctgttggcgatggctccagaggaaccggaagcttgagcatgccaagtcggttgtgcttcctgttatactcagcccggcattagggagtcttcatcacctgaggtggcaatgcccggggctctcactctgggcccaaggaacgtatttttttaacttatttttactttttactttttgagacagggtcttgctctgcctttcaggctggagtacagtggtgcagccacagctcactgcagccttgacctcctgggctcaagcgatcctcccgcctcagctacccgagcagctggaaccacaggcatgcgccaccacgcccggctaatttttgtatttttggtagagacgaggtttcaccatgttgaccaggctggtcttgaactcctgggctcaagcgatccacccgcctcggcctcccaaagtgctgggatcacaggcgtgagccaccacgtccagccatccaaggaacatgtttaagcctctcatgggaatgatatactccaaaaagtgaacatttctcagttttgtatttcccagaccgtctttccctcgccttggcgaagaccctgcattctgccccagcaggaacacacctgcttgggccggctgtgccatgcccacgccacacccacagcagggcgaggctcctaagcaactgggacctaccacctggctgggtctgcaccctcccgctgcaggcaagctcttctgcctgcagccatccctgtctaagacttccacagaatcttctttgacatgcctctccaagctccctctgctgaagccccgcctctgccctccatccagctttcgaggctccccataatctggcccagcgtttctctcacagaccccactggcctctgacatcaggctccttctcacgtttgctgctactgtttctggccctgcctggttcaaggccatccaggtacttccttccaagctccattgctggcacctggtgggcagggccccataggagccttccctgcccgtcccccccaccgggtggagatcaggagcccagccaaatgccattacctgttggacacattgatgatgtcacgagtccgcaggtgctgctcttccactttgccggccaagtaaattgaagacatggcaatcaggtaagggtcataggcgtccaggttggtctcgcaaaagaacttatggtaaatggtgcaagcagtggcaatgggaatggaccgcatccctagcttgacacctgcggagagaaagcaggcaagagaggacttcaatccagcgctggctcactgctccagtgaggggagccattggaatgggccctagcaggtacaaccctacttggacaaggctaagaacttccagcagagccagtggctcctgctgggtctcttactgggctctcagactctagtgggtgacccaagcccctggggatggtgttcaaatgcagacttccccttttgtaggtctgcggctctgagattctccacttctgacaagccccaggtcatgcccatgtcaggggtctatagaccacgctctgggaaacaagggttccgaggaccgctcagttagcaactggcatagcagcttctgcaaaaccctggaaaaggactatatgctgttgtgtgtctgggttcaccttagcaaacagctagctagaagtcgcccaccccacagctacgacgacagaaaagaaacggcctcgtgggtgccacaagtcctgaagtcacagtgaaagattacactgagcactggtttcgtagtccacaggttagaagaggtgagcaaagcaagcagcgtgactgccaagagtaaccacttgcattgcagagaaaaggcaatgtttatggccacagccaggcaccagggaaggacaccagcacattgaaaagtgggctgggcatgctggtttacgcctgtaatcccagcactttgggaggctgaggcagaaggattgcttgagcccaggaattcgagaccagcctaggcaacagagtgagaccctgtctctacaaaaaagagaaagaaaaaaatttttaaggtgaacaaaactcaaaacaccagagcaggattcagtggattctacttaggggttaaagcccatccccagcccatccctgaatggctcctaagaaaatcactgccctggtgcacagaaccaaaacaaattcacaaccaccagggttcacaagacaaggttaaatgacatccactaggccaaaacagaaaggcgaagaacaaccgacaatcaaccatgaaatgacagtcagcatcctctgcctaagaaggtagatcagttccctagggctactgcaacaaatcaccacaaattcagccacttaaacaacacacatttatactcctccgatcctggaagtcagaagtccaaaactagcctagaaagctaagatcaacgtctaagcagggctggctccttctggaggctccatgggagaatgtttccttgccttttccagcttctagaggagggctgcattccttggttgctggccccttcctccatcttcaaagcttctaactctgcttctgtcctcacgtggccttctctgacggtgactcctcctgcctttgccttataaggatgggtgtggttacacccagataatctaggatgatctcccatcttaaggtctctaatcacatcttcaaaatctcttttgctatataagatgacattcacaggttccagggattaggatagggacatctttgggaaatcaatatttagcctcctacaaaggacaaaggattgtgtaatacattttataaagaagtccctcagaaggtctaaacttgttatataaagacaattcctacctgggacccctcattccaggagatgccagataaggtgctgttactgacatgaccttccaagctttgttttacagagcaaaccccaatttacacggaccctccgagcagacggtagcagatgaggtgtcactgccatccttccctaataataactttgcaactcttcttgcaaattacagtaaatttacatatcactgggatgaacagtcctgcagcagtcctcagactctccgcccaccttgggtagaaagcacatctgcccaacccttctcccccaagcagtaaaggtaggaaataactacccgccaactaacagtatctcctatcaagatactgttgatgggccggacgaggtagctcacgcctgtaatcccagcactttgggagggcgaggcaactggatcacctgaggccaggagttcaagaccagcctggccaacatggtgaaaccccgtctctactaaaaatacaaacattagccgggtacggtggcacacacctgtaattccagctactcggaagcgtgaggaaggataattgctttagtccgggagacggaggttgcagtgagccgagatcacgccactgcactccagcctggccaacagagcgagactccgtctcgaaaaaaaaaaaaatactgttgatggctggatggaaacgatgtttctacagagatcttagcttaatcacctcgcctgggaagcgcggagcccaacactactgtggatgtcctggcagggttcggaacaggagctgcaagcagcctaggtccccggagtgacaggaaccctcggacagcgttctccaaaaggctccgcgcgactaagcgccataaagtctaccggagtgcagggccgcgggtgccggcagaaggcgtggcgcactgcgcagagctgcgggcgcccgggccggtctccgcctcgctggaggcccaacccggccacgtcctctcctagggcctgcacaccggtccacgccatggggatacctcgcggctcactgctcagcacaccgggcgcggcgcaaaggcggaggtcctcagccccgagcagggcttcccggcctctgctacggtgagcactccagaaggccggcctggccagccgggcccgctccgcgaagcgggccgcggcgccgcctgtcctggcctcccccggccgcggttacctgcctccatgatgaacctcgccactcggaagtgcaccctggcttcgggcgccggctgccctccgggccccgcgctgcaggcccccctccgccgcctccggggcttccatgaggcgccgcggcaccggcggaaggagaggcggccccggcgcgcagaagccggcagaactggaggtgctcgcggcgggcgtgccgccccacccggccgcgtccggccccgccccgccccgcccctcgccgccccgccccgcccctcgccgccccgccccgcccctcgccgccccgccgctcctccgccccgccccgcccctcagggccctcgcccaagggtgagcgcgcgcttgcgccacagacgctgcctggccgcgcgcgcaggcgcaggcgcaggcgcagaggccgacaccacggggcggctggtatgtgtccaccggcccctaggcgcctcgagccccgcccctgggagacgcaggctcctccccgcggagcgagagcccgcggagctgctccgagacccgcgggagggcacctccggtcacccgagccgcaaatccccgccgtccgaagggggtgtcgccccgggctgtcggcccagcgtggcttaggccaggtacaaccggcagcgcccgccaagccctgggctagggacgcctgcgggagttcacggggaggcgccggtgtctgaggtctgagaagacagcggccaccggaaaaggtgctaatgtttgcagaccccgatccatcgacaccccaaggaaatgctgtgcacaaaattccaagagggccttttcgaatagacgcatgaacggtgtttgtgtctggatcgtccagcctcccgggatcgattgggaatctagcttctgcttgcctttccagcgcgacgcacagtaggagcctaataaatgtttgctgaatgaatgctgaatatcgaactcaggtatttaccatctcatttttcattcgcgtcttccacaagcaggaaatggtgcatcaggctttagggacatagaaccccaaaggtactcactcccaagttagtgacagtcactggagtcattctgatacattcagatcattgctacaatttcagacagctggcaatatggagaggaaaaagctactgctccctaaacccttctgcccaggcgccttgatctcctgatggtgtggaagtctccacctcttacccccaccccacacacccagtccggcctcattctccttcctcagcacttcctgcctccaccagcctccccaagtcctctctccatcccagctgggttagtttcctggggctgctgtaacaaatgaccacaaattgggttgctaaaaacagcagaagtatatcctctctcaattctggaggccagacacctgaaatggaggtgacactagggctttgctccctcaaaggctctggcagaggatcagttcttccttgctcttccagcttctgcagcctgagttcttcctgggcttgtggccccatcactccaatctgtgcctccgtctctacatggccttctccctgtcttctcgtctgtctcttataagcacacctgtcactggattagggcctacctagataatccaggaggagctcatcttgacatccttattttcattacatcttgcaaaggcccttctgctaaataaggtcacagtaacagggattaggacacggacacaccttttgggggctggcattcaccccacaataccagccgccagagcgagctttctaaaaggcgaggctgaacaggtcctgccctgcctaacaccctccggagtcccttcaccttcaggagaaaatgtgaggccttgacctcacatgctggtccttgtggagtcaccctatcaactgaccagcctcggatctcaccactttgcctcatggcagagaccttcggcaggtcccccaaaggttatggtctcctggctgaacgtctctgcacgtattctgcctggtgaaggaattaccactccacttccatcacccagcttgctcttgtctgtatgtgcgcgggtgtgcacgtgtgtgtgcatatgtgtgcgtgtgtggactgactcagggtccccagctccctgtgctgctgacacctgccacgccttgagcaccgtgtctgtctgcaagctgtgagcagccccaccctcttccccagcccaaggctgaaacctaggcaatgcccagagggcccacctcccctcagccccgttggtggaggccaggtcctgtgttcccccagacagtgccctgggctggaccagccacagctagatctggaaggctcaagcccatgttccctaaagcagctatgggccttgggggatcaggctgctgcctctcagcttcccccaccaccacatctgtgcacactaacacacacccccatgcacacgcacacacatgcatcacacatcccccccccacatacacacatgcacacgtgcacatatgtgaacaccccaattcaaacagtgcttccctctggcccctggtggcccgcccatcctctaggcacaactcctccttctcctctgggccttatgtgctgaaaagagtccgggctcagcaagtaaaaggtgcctgggaatgtgagccgagagaatgactcaatgaacacatgaattttaaagccctgggtcacctcggcgcagtggttgatgaatgaataattcactagccaccaactggagccagcaaacctttaggcagcacctcctctcccactggcaagcctgtccccagtgtcccaaaggtggcatcccccgtctcatcaccccggctcagatggtgagttccttgagggctgaagcctggttctcaaccccaggctcgaccctgaggttgacagtcaccatcagaagcgcgattctgtaatatttgccaacgcttccttagctaatcctcaccatgtgcccatacattgattaaatcacagcctacccctcacaatagcactattatggaaaagagtgagtgactcatttcaaggaataggactcgggctgaagctcaaaggatgaggcagagaaagagggaagaggcatttggggtccagaagagaggctgtgcacgggcagggtcacttgaaagcctgtgtggtcttcaaaaagcatgggcaatttccaaagcacccaccctgctctggtcttcatcctggcagcctcatcaaagtccaggcctgccacttgtccttagaaactcctcgctgcctgggaacctcctgccacagtcacctctccactgtaccttccgagccagctccctgtcaccatcggcaagatccacagcctccatctctgttctccctccccgctccccactgcctacccacccttcatctttctattcaattatttatttatttatttatttatttatttattgagacagattctcactctgccgcccaggctggagtgcagtagcatgatcttggctcactgtaacctccacctcccgggttcaggtgatactcctgcctcagcctcctgagtagctggcattacaggccaggcgtgtgccaccacacccagctaattttttgtatttttagtagagacggggtttcaccatgttggccaggctggtctcaaactcctgacctcaggtgatttggccacctcggcctcccaaagtgctggaattacaggtgtgagccacaaaacctggtcagattgtaactttttggtgaatcttctgcctggtattattttctttttcagcgatttgagtaaccaggagctcagtagagtaattgagcaagctctgagcatgcacgggatcttgggtgtgaccaagttggacctaaggagaagtggtgccagttgggcatgagggccggaaaatccaccccagcaatagatgtgtgggagactgaaaccagatgagtgggtgccagggccagggagggagcacagggagtgactgctgatggagacaggggtgacaaggatgttctggaattagatagtggcaatggtggcacaactctgtgaatgctttaagtgggtgaattttatggtatgtgaatgatatctgagtaaatccattattttttaaaactaccacatgcaatcgggccactgaggacaaaatcttcttatggggagaaggggtttcacaaggaagagctgggagactggccagcaaagaaagtcggagggcagagcagctggaagaagcgggcaatgttacggagccaggaagctctcagaagggccaagtgaatgcaaggagctgagaaacccagggcgtcagcaggacagccacagcaagggtggccgggctgtcctgggcctccgatagcccagggacgactcctgatagcaaggaggcggtgcgggaggggaccagagtggggtgtaccctcaaagtcctgcaacgaggtcagcgaggtcacctctgaaacaaggctccgctgcgatggttggagatgggggatcctcattgtgggggcgcacagcagccagagtgggagctgatggaaacacctttgcccgaaatctgtctcctaggcagcccctgagcccctcctgtgatgagcagctggctccccgtctcgggtgggtgaaggctcctgcagcaggaggcaccttgtggaagctcctgtcctgcaaccccatggggactccactcacagccactggtcccactgtgaccctctcgctggagcaaagcaggaaagccactggcaaatgatttgcagttccattctcatacacgagaactctagaagtttccacttgccccaaagagcaacattatgcttttactatccttcccgctaagatgctttagctctccggctccatgccacagtctgtctccagggaccttgatctcgccatccctcgcatgtcacacaggtccactctatccatgacaacatgctgacaggatctggggatcaggagcaagtggctaaggaagggagggagggtagaggtcaaggtatcagggagagaagaaggaggcccgtctatagcatgagttactcaattgtcatgcattagtggggccctaaatgtgttattttcctatggcgtatttgtacaaaagtatcaaagtgaggatgtatttgtttcctttcatggtccccccaccctttcctgtggctgccataacaaagtaatacaacagaaatgcactctcttgcagctctggaggccagaagcctaagatccaggtgtctgcaggaccctgttccctcctctgcaggctctgggggaggctccttcttgcctcttccagttcccgggggatctgggtgtcccctggcttgtggcggcaccactgtattctctgtgaatccacgtggccttctcctctgtgtttgtgacttctttccttcttataaggacacctgtcattggatttagggccctaatccaagaggatctcatctcgagatccttaacttaattacatctgcacagatgctttttccaaataaggttccattcactgagttcagagggtttgtttgtttgtttgtttgtttgtttttgagatggagtctcgctctgtcactgcatggtaacccctctggtgctgtcctcaatctgctgagaccagtactgtccagctcctctcttttcttccaagccagctcgtcatattgggcccggatgtctgccatgattttggcaaggtcctgagatttggggcctctacctccacggtcaactcagagctggcaatctgggcttgtaggccttttacttcctcttcgtggttcttcttcatgaagagcagctcctccttgagggcctcgatctctgtctccagctgcagccgagtgacattggtgtcatcaatgaccttgcaaagcccatggatgttgttctccacagactggcacatggccagctctgtctcatacttgactctaaagtcatcagcagcaagacaggcactgtcgatctgcagaacggtgcgggcattgtccacagtatttgcagagatctgagccctcaggtcctcgatggtcttgaagtaatggctccagtctctgacctgggatcccttcttctccagatgctcccggattttgctctccagcttctggttctcagtctccaggctcctcactctgcccaggtaggaggccaggcggtcgttcaggctttgcatggtctccttcttgttctggatgcctcccattcctgccagacccccggccatccccgtggccaggccccagaccccatgccaccctggaagctggtggagcaggacacggagatccaggaaccagaacccccagcacctgcatagacgcttgcctcactgctgaacagccaggggccgtagctgggcgcctggacagagcctagggactgatagttggtggaaaaggtggagccagtggtgaagctcatgctctccggcgggagagtgagaggacaggactcgggctttgccaacgaccaagatgacaatactctctcaattgatctacaagttaaatggaatccttattaaaatcccagctggcttaaattaagaaagaaagaaagaaaaataaagaagaaagaaagaaagagagagagagagaaagaaaggaaaggaaagaaagaaaagaaggaaagaaaggaaagaaagaaagaaaggaaagaaagaaagaaagaaggaaagaaagaaagaaagaaagaaagaaagaaagaaagaaagaaagaaagaaagaaaaaagaaagaaagaaaagaaaagaaaagaaaagaaaagaaagaaaagaaaatcctagctggcttttgtgcagacattgacaagctgatcctaaaatgcatatgaaaatgcaagaaactcagaatagccaaaacaatcttgaaaaagaacaaagttatttttcctaattttccaagactcacatttcctaatttcaaagcttaccacaaagctacaggactcaagtctgtgtggtactagcacaaagatacttatacatcaattgaacagaattaagaattcagaaataaacccttacatctatgatcaattgatttttgccaagagtgccaagaccattcaatggcagaaagaatagtctgtttaacaaacggtgttgggacaattagatatccacatgcaaaagaatgaacttggacccctagctcagaccatatacaaaaattaactcaaaatggatcatagatctaaatgtaagagctaaaactataaaactcttggaagaaaacacaggagtcaatcttgatgaccttggcttaggcaatggtttcttagaaaggatgtccaaagtgtccaacaagcaaagaaaaaactaaattggaaaatgaaaaactgttgtgcttcaaagggcaccatcgagaaagtgacaaggcgacccccaaagtaacagagcctgtttgcaaattacacagtagctgataattgacttgtatctagatcatataaagaaccaatgcaactcaataacaaaaagaaatagcccgattaaaattaggtaaagggattttgttcaccagtaaagggattttgttcaccgctgctctgctcatgttgctactgcagttccgaggcagcaggaagagatgcggcccctggatgtcgccgagctgtcagaaccggaggaagtggaggtgctggagctggaggggggttttgagcagtttctgctcccggtcatccatgagatgccagaggacatcgcgtcgctgacaagcactggcgggcgtacctgtggaagcggagcacgctgtgggagatggacaatatgctcttccagatcaaaacccaggtggaggcttcggaggagcatcctcaaccgcctccacaacccgggcgacgcagtggagggcagggtgaccaagaggtgccagaaggccgaggagaaggccaaggaaatggtgaagatggcagagatgctggtggagctggcccagaggatagagacgaacgagtcgagagcacggtcggtggtttacagccaatggattctggtaaactggtggagattggctgacacccagaagaagctgaaaccagagagcctttggttttctctattttactctgtccacgctctgtcctcactcacactcagttctctgctatggtctgtggttgatgaactcaatatgagttttgattgtttgtgtttttgtctggggaagtaagtttatttggaaaatgctctctcatacaggaatgagggcctagaccacgctcttgcagcagtcacatttgttcctgggctttggttgttatttctaaatgtttgaggtgctttgctctttcttgtgtgatctgatagctccctggaactttggatctgtgtgtgacacatgagcctcattgttggagttctccagctctggaggggctgaaggagccgcaatgattctagaagatgactccatacagcaactactgaagaaaggaccagacttcagctgggaatgtggatgggccgacctggctgggacccatgaatctggagaagagctggagaatggagagtattatctgtatttgaggactttaatttctgtgtaagaccaaaggaggagagacacattttgttcaaaatttaaattttatgtggtacactatctgatataacctgtctagtgagtttgtttggacaacctaattcagctttatctgacatggaacctgaactagaggatgagatcttgatattctgtacaagttgatgtaataccctgatgcatttcggggactcggcataaaatgaaagagatttgcaaagactcttgaggggctgggggatgagagtgtggaactgtacattggaccctaaactggagtggaagaggcatcttcaatgttcatacattgtccagctataagttcatttaagtagcagacctgataaatatttgaggtcaaaaccctaccatgttttttttaaaacttaccatgttaatcaaagtattcatttgcttgaaaagaaaaaaaagttgggtaaagaatctaaatggacatttctcaaaagactatatacaatgtgccatgaggacatgaaaaaatggtcaacatcactagtcattagtgatgcagatcactagaaaatgcaaatcaaaactagaatgaggctgggcacagtggctcatgcctgtaatccgagcactttgggaggctgaggcaggtggatcaccttaggtcaggagttcaacaccagcctggccaacatggtgaaaccccgtgtctcccaaaaatacaaaaattagccggacgtggtggtgggtgcctgtaatcctagctattcaggaggctgaagcaggagaatcacttgaacccgggaggcagaggttgcagtgagctgagattgtgccactgcactccagcctgggcgacagagtgaggctctgtctcaaaaaagaaaaaaaaaaacttgaataagataaaattcacacgtgttaggatgactataataaaattaaaatggaaaataacaagtgtctgtttggagaggatgtggagaaatcagaaccctcatacattgctagtaagatgttcaatggttatagccatttgggaaaacagtctggcagttcctccaaaggttaaacatagagtaaccatgtgacctagcaatttcactcctagctatacagccaagagaactgaaagcatatgcccacaccagatcatgtgcacgaatgttcatagcagatttattcataatagccaaaaagcagaaacaactcaaatgtccatcaatagatgaataaacaaaatgtggcatatccaggcaacggaacattattcagcccccaaaagcaatgaaacactggtccatgctgcagtgttggtgaaccttggaaacattatgccaagccaaagaagccagatacaaaaggccacaaaattatatgagtccatttctatgacagattggaacaggcaaatccatagaaaggaagacgaatggttgccaggacttagggggagaggagaatgaggagttagtgcttagttgatacagggttcctggtggggatgatgaaaacgttctggaatgagatcgtggtgatggtgacataactctatgaatattttttaaagtattgcattgtacactttaaaattttttttgtaaaggcagtttgccaggtctcgaactcctggactcaagtgacccacccatcatggcctctcaaagtgctgggattacaggcatgaggcaccatgcctggcatgtatactttaaatggggaaactgggtgaagggtacatgggacctccctgcactgtctttagaacttcctgtgaatctatcacaactcaaaataaagacaaaccaacaaaagaaggtgtcaggtggactgggctcattcaggtgttggcagaattcagttccttggagctataggccctagtttcaccttcccgccatcaatgatgccaagagctcttcccatcatctctgcatctttctgacttcggcttctggccttggccagtgaagctctgcttgtatgagctcctctccctatgttaaggtcaactgatgagtagcccaaatcacatcggcaaagtccctttggccatgtaatgtaacatactcacgggcgtgacacggggatgaaggtcatgggggccgaaattctgcctaccagaagtggattatttcaaagctatttgggatggagaatccccaggatcagtgaggaggtggatgttggggaggaggaagaggagatatcaaggagctctcccaagtctgggccaaccaggtgggtgaaggtgccagtctccgagatgaggaacgggtgtgggaagcagaagcgctccattgtgacatgtggagtttgaggggcctatgtcttcctgggggttgtcccctaagggaaaggtctggacaggcataagagggactgaggtcacccaggacgagggtggcgggtgaaaaggagctgccggggcagcgggccgccgcgagcccctcctgggatcttccgccccaagcccagcctgcgattccctccctggaccccttctccttcctctccgaagccctccctggaaggagccccgcatgctgaccgcagctgccgctagggggcagagccgtctacaccaaaagccacaccgctccagcgtgcgcgtgcggggaggtgcgcgagcgcgtgtgcacgcacggcgggggctcgcttgacgctgagtccggcgaactaagctcgccacccccaccccatccccctgctgctgggagccccaggcagtccccggccaaggcgctccaaaaggtcccctctgttgaggactgggaagcagaccccgccccagtgccccccaaagcgcccgccctcccctggtgtggctggagaggggtctgatccggcggggctgagctcggagctgggtctcctccgggcccggggttgcggcggggggcggtcactccccctccctgcctcagccccgcaccctccacgccgtgtctccagcatcgaaattcacagcaaaatacacaactagtgaagaactgggctcgggtcccagaaataggctgccctttccagagggtgacgggaatatcctccctgcttcccgttgccatggtttccgctcagccaccaggcagcctgttgcgcggcagccatttgccgcgacgggatgctgctgccgctggtgtgcagcaggccgccacgcgaggaaggggacagactgccctggagacccgcccaccacggagaaaaggccacggatctaaagacaccggagggcggctacgcgggccagatggacaaatgctagagtcagcacctgtctgtgggggcgcccttggcctgggcgctggacctaggccatcaggactggagagccttcttctcttctggccagagaaagagcaaagggtggcttcctgacaggtccggagctggcacagcacaacagagcctagaaaatcactagcagggctgagctcggggttccaccgctgcagccttcctgttggacccagtctgctcaaggactccctcacagcccagtgctttctgttcaccccggggcgctcccagcccagcctcctagcctcagtgagtgggaaatgtctgtactgcccacttgtcctcaaacgcatgtccttgctcggctgctccctgctctgccccatctggaggggacagggtgaggaggcgccctggaggcctggccccagcttgggcaacacagcctagcggggtgatcacacctgggtctgcagcccctccagcacttcctggggctgtgccggccattccagaccattcctgttggtggaactcatgacagggcttgtttacgccagtcactgtgttctgacacctcccccaccccgatcattaacttttctggtccttttcagttattaaaattcagcccagactcacatcccatgggcctcccctccccatccttggggctggaatggactggaatggagaggaggtgacctgacctcccttccctcccttcccaccccccacccccccgggccggggcaggcagaacttgtgccagggtgagggggtgagaggggccccatctttgcctgggctttttgatgcctgccaatggggtcgcccttttctgagggcaggctcagccccttccttgctgaggctaaagaccctctgggattgggaagcgctgtcctctctgggccccaccagcgtctaccggaccccctcagacctctggcccccacaccttgtgcccccagggcagaaggcagctggggtaagagtgccttcagtcctgccaggctcagcaaatgtcctgccttcagaaacctcagcaggcagacaggcaggtgcctcctcaggaatacagcgtgccccccatccccagggggacgtacccagctctccccacagcctccggggactgcgggctgtgtccacagctctggcagggccttattttctcccagctttttggcattttatggattaaaaacacagcattcccctaagggcagcctgcttccgtccgggcttctgtgggagtgagtaaggctggtctcctgagggaagtgtgtgattcttgccggggccagaggccaagacgagccaggagggcacttacccctttggggcatcttgcccttgtcctttctgttttctctactcaggcctctcccctgagctgaggaaaccaagagaattcttgtccttttggataaagaccttttcctaagatcgttttctcctagaaataagcatactttattaagatattttggactggccgtgcacagtggctcatgcctgtaatcccagcactttgggaggccaaggcggcggggatcacgaggtcaggagtttgaaagcagcctggccaacatggtgaaaccccgtctctactaaaaatacaaaaaattagccgggcgtggttgcacacgcctgtaatcctagctactctaggaggctgaggcaggagaattgcttgaacccgggaggcggaggttgcagtgagctgagatcacaccactgcactccagcctgggggacagagtgagacttcgtctaaggaaaaaaaaaaaaaaaaaagatattttggactgattttgtgtgtcctgatgcagtttttctttgtgcattaaacatagtgaaacacacagtgcagccaagtgtggggccacactgcctcgcttccctcttcccctcacagagccgggcacgacagctgcgggcacagggagcaatcgcctggagccagagggggcaacgccagcccaagggcaaatgggcaaccctgtgcaaaaggctctggcaaccagatcatctactttagaagaaaggagaagaaaaagagcccccaggagaggaagtagcccctaacccgactgacaagcaatccgttcgcaaagacagaagggccttcagtgaattggtttcaaagtgcttgatttcttaaaaccagaacaattgatcattagagaactgattaagctacagccgctgttgaataaaaggtaaaaataaactccttcatttgaattccaaattcaggcttggaggtgacctagccatgaggcaaactggctgtgggtggacagggctgcacacggagctggtgggtggacgtcacctgaagtcttctctcctcccaaagtgtgggtgctgggaccccaagggcacagtgtgaatgtccccagcacttaacaccagggtagcccaggtacagaggctgctgaggggctggtgcaggttctccaagggccactgctatgcccagaatgagccactagttctggatcaggaggagcagggggtgaggaggggggggggtcccaaaggagagaatggttcgggggcagctgcaatttaccaacgggtacagaagtactttgacatcttagccgcaggcacagccctaccagtgggtaccagctgttgtgaccagagatggcagcagtcagagccagtcctgggacccaatttttcccctcatctgttacctgggggggtcaccagggcctaatgaagacttttgaggtttctcagccacaaaaggatcacggtgcctctccatatggaattcagcagaactctcaccttttaaaacggtctagtagatactgagtagacacaaaaggacatttacaaaatatgtgtaagtgtaaagaacaatacaacaaacctctgtgtactcaccaccagcttagaagaaaggtaacgttccctttgaaggaccttgggtgacccttctcattgccccatgtcccctacccccacttcagaggtgaccttctggaattttgcatataccactcctgtgtatttctttatagtttcaccacctttgcatccccaaacaatatattttttagttttgcctgttttgaattttatacaaatggaatcatactgtctgtattattctgtaacctgcctttccgctgaatgtggtattcccgagacgaagagctgtaatccattcttcccgcaagcattctgttctgttgtgggattaaactacaactgatctctgcatcatctgcttggtggaagggggaattgtttccactttttgggctgttaccagagtcctgatgcccagcacaagtttcactagtgggcatatccagaggaaaatccctgggccaccagaaatgtacacttgcaactttgctgggcaatgaaaaattgttttctcaagtggttgtaccaatccatatgcccccccctgtagtatacaagctttctagcggtttcacagccttgccaacacttgatgtcgtcagaccttattttccatatggataaccaattgtccagcattatttattgaacatctccttcccccactggccagcaatgccagctttgtcatacatcaaggtttttgttgttgttgttgtttgtttgtttgttttgagacagggtatcactctgtcacccaagctagagtgcagtggcgcgatctcagctcaccacagcctcgacctcccgggctcaggtggtcctcccaccttagccccctgagtagctgggactacagatgcccgccaccatgcctggccaattttttgtacgttttgtagagacagggtctcaccatgtgttgcccaggctggtctcaaactcctgggctcaagtgatcctcctcttcagcctcgcaaagtgctgggattccaggcatgagccactgtgcccagcccgcactatcttaaatatggcacctttataataattcttagaatctgccgaggcaactccacccacctcctccttctctctgtcttagctgtgccatttgttcttccatatagatttaagaaccaccttgtcaagctccgtttacaaatggcatttagattacaattacgttcaatctaaaacttaaattggaaagaactggcatgctcaaaacattgatttttcagaaaatcctggatatccaaggtaatggcagccccttaaatctggaactctcaacagagcttccaaaccaaaatcacttttaaaaagcaagcacaaataaacccacccaaaacccatgtcctcgtcataatcagaagacagagagcatttgaacttcaaagtacctaaaacagatcaagtcacaagggtggggaaatagatcctcacaggaaatacaaacggaaacaagtgaagcaaaccatatatcgaacaataacacaaccaccttgaaagagaaaaaaactcggcaagcaacctgaacacggtatgggactatatgtcctcgagtgaaaaacaaaaataactctagacaaacctggaaatctgcagagtagttttctcctttccagagacatgagttgatgattctgaaactactttccaagtattctaggactgagcaaatacataaatatatttcaggtaatgggagccaactttctcagcaagagggaaagaagttaccaaccagcaagtaggaggaagactagaagggacgtggtgctgttgggttgaaattggatgggtcagtatgaactcatggtagatagatagatggatatatatagagagagagacagagagagagatagatagatatgggactgtatatacatatatacacatatatgtatgtattctctatgtgtgtgcaatttcccagtaagcttctaagtgtcattatccactcaaaatgaattagggatcctaggagaaatggctgattccagaaaaggagaccagggaaagtcaagatgagcctagaacaccctgttcttccagaaagtaagaaacccccgagtccacagtgataaaaagaaataagtagagttgtacactgaataatgacactttggtcaaaaacaaactgcacatatgacagtgttcccacgagattataatactgcactttttttttctttttgagatggggtctcactctgttgcccagactggagtgcagtggcgtgacctcagctcactgcagcctagacctcccaggctcaaccaatcctcccatgtcagcctccctagtagctggcacctgccaccacacctggctatttttaaacttttttgtagagattgggtctcactatgttggtcaggatgttcttgaatttctaggatcaagtgatcctcccgcctcagcctcccaaagtgctgagactacaggtgtgagccaccgtgcccagcctataatactgcattttgactggaccttttctaggtttagacacacaaatacttaccactgtgttaacagctgcctacattatcatagtgtacaggtttgtagcccaggagcaataggccataccatatagcctgggagtgcagtaagctacaccatctaggtttgcgtatgtgcgctctaggatgttcgcacaatgatgtaatcacctaacaacactcttctcataacatagccccatcattaagcaacacacgattgtaaagggggagaagagaagctctttctcacagaagaaagccaaataataaatgaagaaggaatgatggaaataggaaatcgccatttggcaactattgtagtaatgagtttcaagcaaaaaataatcaatggatgaaaaaactcatgggaactggacagtagagacatctggaagatgccaccttaaccacatgatcaaagtgatcatcatcagcaatgggacaaggggactggtgtcgtggcctcctgatgccatacacagagagggaagcagcacttctgagctattcccatggaaagtgcaaaacctggatggaatcatgaggaaacatcagccaagccccaacacacagaaatgctgcaaaatcactggcccatatgctcctgaaaactgtcgaaaaccacgaagaacaaagagctggtccagacttaaggagactaaagagctaggtcaactgcatagaacgtgtgatcagaggtgctccttttctggaaagaacattatagaaaagatattattggcacaatcaataaactctaaggtctgtagattatagtattttttttttttgagacagtgtcttgctctgtcacccaggctggagtacagtggcatgatcatagctcactgcagtgtcaacctcccaggctcaagcaaccctcccacctcagcctccccagtagctgggaccacaggtgcacaactacatgcctggctaaattttttttaactttttgtagagatggtgtctcactgtgttacccaggctggagtgcagtggcacgatcatggctcactgcagcctccacctcctgggctcatgatcctcccacctcagcctccacagtagctgggaccacaggcgtgcaccaccacacctggctaaattttcttgtattttttgtagaaatggggtttcaccatttgcccaggctggtcttgagctcgtgggctcagggatgggcccaccttggcctcccaaagtctaggattgcaggtatgagccaccacgcctgggaaacacttgtcggtgtccgtccttttgaacagagccatcttagtgtgaagtggtatctcatgtggctttgatttgcatttctctgatgactggtgatgtcgagcatcttttcctgtgctcattcgcctctcgcacatcttatttggagaaatatctattcaaatcctccactcactttaaaaattgggtcatttgtctttttattgtgggtttttgtgaggttcttgatatattctagatacaagtcccttatctgatatataatttgcaaatcttctatttcattctgcgagttgtcttttcactttcttgatagtaacatttgcagcacagaactgttcaattttgatgaagtccaatgtatctattttatcttttgtcacttgggctttgtgtatcacgtttaagaaactattgcctgatctaaggtcatgaagacttacacctacgttttcttctaagagtttcatagttttggggcttgcatgtgagtctttaatccattttgagtgactttttctgtatggtgtgaagctggagttcagcttcattctttggcatgtggatgtttagttaccccagcaccgtttgttaaagagatgattctttctcccattgaatggtcttggtgcacttggcaaaaatcaattgaccattgatgtgtgggtttatttctggcttctcaattctattccatggatctatgagccttttcttatgtcaataccatgcagtcttgattcccgtaggttatcctaaagtttgtatttgataattccactatgggtctatttctgctgctttcattcatattgccttcactcttcatatgcctagttatttttattgtttgctgaacatttcaattgcaaacatttttatagtgataacttaaggacgagggcaatgtcaccttcctccagagaagatgccacttggctgtcccagcttctgaggatgccagcaatctaagattagttgccctaatccagttttgggtattgagaggctaaaaagctagctgaagtactaggagactttccattgctggatcacctttactcctagagaacagccctacagggtccccaccgaaatgagagagatgcaccagggtgctccatgagcagggtcctggttcccgtgcctgtcctgatagccccaggagctgtcaaaagccctggacagtttgtactccccttgttctcaatctccaatcaccctcagggcgtgagcagctgcaaacactggcctcgcctccctagcatcctgccctggaagttcttcatcctctttttgctctatgatgccttcaagcaggtgacttttatatttttccagcttttctaattgccctcagtaggacggaggcatgaattcactaatttatcatgatcacaagaggaagtccttcactgaattcttaaattcaactaccttattttccacttttaaaagtataatttggttcattttcatatatccttggttgtttcatagaatgctgcctttttgatattttcaaccccctcttcgatttctcccaatgtattaaacacactgacgttatgctctgtagctgataatcccagcgttggctgtgggagctgtgctctgctggcactcacccatggagcgctttcctgtttcactcgtgtgtttggatttttttactggatgtttttccttctcaggtcttcagagtgggaatgccttgagacctggttgaaggtgggtccctccagagaggatttgcattgccttctgacagttttccggggcactttaacccagaaccttttttttttttttttttttttttttgagacagggtctcactctgtcacccaggctggagtgcaatggcgcaatcatggctcattgcagcctccaactcctgagctcaagtgatcctcctgcctcaacctcctgagtagctggaaccacagatgccaccacacccagcttttttttttttttttgtacagattggggggggggggtctctctatattgtccaggctagtcttgaacccctgagctctagtgatcctcccatcttggcctcctaaagtggagggattacaggtatgagccaccacacctggcccagaagtattttaaactaaattctcagtttgaggagttaatggcctatctgggtgttgtaaatcccagctgcaaagccatgtgctgctggtttgtgagtacaaatactcaagaggaggtattttcccctccccctcatgccaggcttagaaatgagcaattctccttgaggcctggtgatgaagaggtagtggtcgacatttgcagttcatcctgacgatgatgacaacaccttttatggtcccaccttccgagtagctgagactacaggtgccaccatgcctggctaattttttatagagacggggggtctcactctgttgcctaggctggtctcgaactcctgggctcaagtgatcctcctgcctcggcctcccaaagtgctggcattataggcattagccactgtgcctggccttaaaatcatttttctaaatgcaccaatgatatggcagagaagtaaggaattcccagagtccaaaaattaagtcaaagcaggaactccgagaggtaaccagaacagtgaggctaactgtcaccctcgggcatttgcagaccctggtgactttgggcttcagttttcatggcctcatggattgtggggacagaagacaaggcccaacacttgcagaatgagaagtctaaaaggaaccacccccccaccaccatctgcatggttctctcttctatcagttaggatgagattcagctacacagatgaccaaatatatatatatatacccatacacacacacacacacatacatatgtatatatgtatatatatatgtgtatatatgtatatatgtatatatgtgtatatatgtatatatatgtgtatatatgtatatatgtgtgtatatatgtatatatgtatatatatgtgtatatatgtatatatgtatatatgtgtatatatgtatatatgtgtatatatgtatatatgtgtgaatatatgtatatatgtatatatgtgtgtatatatgtatatatgtatatatgtgtatatatgtatatatgtgtatatatgtatatgtgtatatatgtatatatgtatatatgtgtgtatatatgtatatatgtatatatgtgtgtatatatgtatatatgtatatatgtgtgtgtatatatgtatatatgtgtgtgtatatatgtatatatgtgtgtgtatatatatgtatatacatatgtgtatatatatatgcaaacgaatgggggagagggagggagggaaggagtcctacagacctaacaagaatgggtgattatttgtaatagcaaagtactggaaacgacgccaccatccatcagctgggcctgtttgaacaagctggggctgacctgcgtgttggaatactatgcaactagagtcagcatgctgccctgggcaccccagcataccaagatacacccaacagtgaggcacacgacaatatgccattttttgtataaaaatgtggggatatgaatacacatatattgtttaatgaaaaaagttttccataatataaaaaatcaaaaagaaagatcactgccatccctaagaatcaaacaaacagaaacagatgaaccaaaccatataaaagttggcggcataatcatatatagaagtatttcaagtgtcttgaaacacagtattttggttgaccggacgtggtggctcacacctgtaatcccatttactcaggaggctgaggcaggaaaatcgcctgaacctgggaggcagaggttgtggtgagccaagattgcaccactgcactccagcctaggcgacagagcaagactccgtctcagaaaaaaaaaaaaaagaaaagaaaaggaaagaaaagaaaggaaaggaaaagaaaagaaaggaaaggaaaggaaaggaaaagaaagaaaagaaaagaaaaagacaagacaggaaaagcagtatttttattgtacacacctggtgggatatatgtgttttttttgaaacacagtcttgctctgtcacccaggctggagtgcagcggcgttgatctccgctcactgcaacctccacctcccaggttcaagcgattctcctgcctcagcctcccaagtagctgggactacaggcgtgcaccaccatgcctggctaatttttttctatttttagtagggacagggtttcaccacgttggtcaggctggtctcgaactcctgacctcaaatgatctgcccacctcggcctcccaaagtgctgggattatagatgtgagccaccatgcccagcccagagtcagaatattcttaattgtgggtcacttgcagaagttgttggggactggcttgtgactctgaagggtgatgtatagaaagaagactcacatggctatctggctattcctgccccacctgttttttatggtgaccaaacagtcgatgagggaaagctcttctgttaccgaattccaactaggaaatgcaggaagaattatagaatcgaatcgaaaaatcaccatttttaaccctaaataatggatctaggtgataaaaacactgggcaaaaggatactagagaattctataaaggccagatcaggccgacaccatctgaatctgctgatcagtcttaccgtcgtcaagaggtacacgaaaaggggctcagcatcaccagctgttagggagacacaaatcaaaaccgcagtgcggtgcatcacacacctatcccatggctgaactaaaccacagcagatgccggagtgggtgtgtggagaaaccagcgctcacccatcgctagtggatatgtcaaaccgggcagccactcgggaaagcagttggcagtttcttacaaaaacacacatctataaaggggtagcacggggtagcagagtggtgaggaaaccgctctgtaatttgattgcactggcagttccatgaatgtacacagtgatgaagttgcatagagacgcacatacacgagtgtgcgcacacaggagacacccgagcatcgatgtcgcgtccaggttccggttgtgcctcgggcgttcaagtagccaatgtcagagggacctgtggggaggggccacagcctcccaggcacttcttaccaacgtcctcgtgaatctaacagtttaaaaagaacaagttaaaaaatattccggcagaaaaaagaaaagtataaatgaaaaatgtgggcgaactgttgatgccagctgatggatccacagggtttcatgaactctgtctttgtttatgtttgaacttttccatgataaaccatttcttaagagtcaccacgaaatgagtgtctggtgaataagtgaagcattcatgaatgactgcagtccaactctgtccttccagagataatgcgagcgagatcccgcaaggggagatgattgctcaaggtcacgcggaacagtcaaggctactgagattccgtctagctctttctcaatgtgtgtttttaactttacacaagcaggacattacttttaaaggaaaagtgaccataaactgagggctgcaacataggaggggggaagggcagagggagacccaggatgccagcttcgcctaggggcaggggcgaggcagacagcctggggaggttagaggctctgctgtgagagggtttctgcaagatgaaatcactcaaatgccggctgtgtttggacatcttgagagaacatttccacacacggatggggtctagggttgagttcgtgatacgagcaaacagctacccaaaggacaatgattaactcctgggaaaacaaaatgcagctcgcatggccccaccgtgagcagcatttatgtggccgcataatttccaagcatggggataggaaggggtagaacagcaaaggtttgggggatgggactgatggaagccttcgaggaggcccccaagacgtgggcggacccttgtcttggcacactcctgcccctacatccttcgggccccagagctccctgacaccactggacccaccgccccccaccactctgcttcctgccagccctccagatggcctgtccttgccccctgtgtttgctccctcctgaggtcagcccctctgcaaggacaccggcccttcccctctggctaggttaggtcaaggacttggcctctccaacgcccactcctctcagtcacaaacagggacacctcaggcaccaacctgtacccgagctcagccacggacacatctgggcccccagaagggccctcagctctccagagccagagcaggcaagggcgacagagcgtgtggctttggcggctgggccaggaggagggaggggtccctactgcagggtttagccctttcacacttcagcagagagcagccgccccgtcagcacccacctgctgctgtcctcagaaatggggtgcctgtcggggtgtgctggtccccaaaagatgtgtccacattctggagcctgtgagtgggacccttttaggaaagagggtatctgcagatgtgatgacagtaagcctacatgacggggggcagggggtgccaaatctaatgacaggcatccttctgagacacaggagagacagagaggagaaggccgtgtggagatggaggcagaaattgaggaagcctggagcccccaggagctggaagaagcaggaaggatcccccctagagactcggccctgcgcacacctggatctcagacttctggcttccagagctgtgagggaagagattgctgctgtttgaagcctcagggtccatagtcatttcttatggcaaccatgggacactcatttggtgagaaaaagccccttgaaacacacaagtggtgggtgccgtggatcaagggccgccaaccacagtcaagccccagggccgctggctgggcagactggaccccacagaaccaagccacatggaacaccccctgacctggaggacaggtccctgtcagaactggctcaggaggaactcactgactgcgagggccgggctgggctgggccaccgggaggaaggctggggacacagccaaggtgggggagggacaggcagactggagccccctccagctacaccctcttgctcacaggaccgtgcctcctagccagacttctggaaagtcttcttgacagtcacctgccccaaccaggtgtcccccccttctccttcaccccctttggacagttcccttctctctcccatgaccctcctccatggcctggtgcttcagctccatgacctctggcttcaagtaagggggaggggcaggagggactgggacggcccagcagcctgttctcagaggctggcaccgtgagcaggagaaatgaagggcaaagccaggagacaccaaatgtaggttaactgcaaggaaggagggaagggaaggccatggcagaggctccattgtgcagacccaccccactgaaggctacaggctggccagagccccagcgcctcacaggcctaggagcccgggcttaccatgaagcccagtagccacagtttctggaccccagggaggtctcacggctgtacaggcactgccacccagggtcctccaggtgccagaggacaagaggttggcgagtcaggaacctgccacagccatgctcgtgctaaggggctcagaggatgcctgggcccaggtgcaccctggcttggaataacctgaccttcattcaggtaaccttccgactccccagctaggatatcaaagtcatggcgacagacacttggtcgagtccactcttctatcaccagcacaggtgcttcaatatgtgttgaatgaatgaatgaatgaatgaagaggttcagtatttcctgcagggagcagagggtggtctgggcagcctctgaaatggacgactgttgttgaggcatggctggcgtaccctccccctctttgaagggtagacggggtacccgggggaaagagccttccactcactgccctggagccaaatctcttcctcttggtcagtcttctcgcgccacccctccgggcattggcccagaagccacttgcaaagcggccactgcccggcaggtcagcagtccagggggtgagacagcccctggcagagccaagggaggagaaagagctggagtgtgaaggtgggtgaggaggggctggggaggaagagtcggggggtctgggagcggggagttcccctctcctccctgggtcccggccaccccctcccagtctggctggcctggctgccccccagctccagtctcccgttctcctcttgtcccaggctggcccacgatgggcaggcgaggtagccggggcacaggggagcaagcgccgtcccacagctgtggtcctgcccgctgtgctgggggcacctgccaggccagaggcagctccctcctggggacaggtcagcagcaggcccccagaggcccagcagggaagtccagggtgaagccaagctgtccatgggaagtgagcgagtcccccaaaggactgagccagtgggaaaagaccaggccaaagggggctgtgagccaccttcacggcagggcgggagccaaggcagcacctccccccagggccaactgtggagccacatggtctgaaggaggtggaaggagagttgggggaccctcctctgccttaggctggctcagctggccaggctggctgcgggatcctgggggcagaggcctttcccacactggcatctagttgaaaaaggaggttcaatgagtttaagcgtcctgatctggaggacagggacgttagggctttgcattcaccaggcaccggtgtccccttaatataccgagggttcagcgctcccatgtcccagccttgcccacccagccctggctgctgggagctgagcatgagttaggtgcccccttggcccctgagaaaccagagctcaggggtttcttttcttcagagaccctgggccctggccaggagcacttggcccacagcaaggagccctcagcaggcctgtgctcccaggacgaaagccgtccacccagggcttaggggaagggcggggatgccgctcagggaacctccggctgcagggagcagggcccccagggggcccagtgcagggacagcttcggagcccctttcctcaagcagaggcagggaggtgcccagtggccttcggctgtgtgtcctggtgcccaagcttgccccttcaccggggcgctgtggctggggcctgggctgttgagacgttgtggggtgactggtttgtgcccccactgaaagatacatccatatcttaacacccaggccctgtgatcagggccttatatgcaaataaagggtgtctgcagatgtcattaaattgaggatgtggagatgagagcaacccagatgatccagggggccccaaatccaaggacagtttccttagaagggacaagagagagagacacagagaaggccatgtggaggcgaaggtggggagtgcccagggcccccagaagctggaagaggtgggtggatccgcccccagagccaccggaggaagcactcgattctggactccggcctccagaactgggagagtcaattcctgttggctgaagccaagcggtttgtggtcatttgctgcggcagcccaggccactccgacacgagggaatgagctgagcccagagtcctcctgggccgtggaggcggggggcggggggacctttgcacccgcatcgtccagtaacctggtgggggctggggcgaccttgggaaggcagctcccgttgtccttggctcatttccagagagcatgagcggccaacctgaatggaggctggggagtgagccccttaggccgggggcccctgggagtgcaccccacttccaccgcaggaggaagggccgtgtgcagtgggctgcgggtcccacacaagcctagaaatgggggagcaggggccaccgtgtgcaccattgttggcaccgcgtgtgtggacacattggtggtggaggcagcagcgcggtcagctgaagagcgcgacgcctagagcaagtgaagacgaccttgacaagcccatgatcctgtcaggagatcaatctcccttccagcatgttttcagttttttactgtaaagaattgcaaacacatgcccaacctagagaggatgacagggcacaccggccccgccggcggtcctcacacagccctctctcctctccactccccttaatgtggccccgaggcctggggcctcctgagagaggcacctccatctgccttaagcagggacagggccttccaggcagcaaacccgggttcagaacctggacccttgtctacaccagccagggctggaggttggccctctcagcctggggactcataggggtgcccgaaactccaggaatcagccccctgggcccccactgggccaggtcaaagtcagtgtgggtgggaggtatttgcaagatcgccatgcaggaagtagggtcccagggagaggacaggcccagacagccatcgccgcaggcatctgcccacatggaaagcaaggcggtaagcagaggcgatggaatgtgtgtcaacaccgtgcaaagggccagtgtggccggggctggggcagcgagggcggcagccaggggcctcaaggggcgggcaagaggcccgggaggctgggactgccaggaaggaagccagctgctcagcctggggcgccctccccgaggcctgcccgctccctaccagccagacttctagccaagctccagagctgggagcccagctgcccacctagcatctcacagggatggccttgcacactacacacctccacccaagtggagcaattctgtacattcaagtacaattcagttgtacaattctgtacaattcaagtacattctcaagtgtacttgagcaatttctgatgccgagctcccctgccgcgccacatctatagtggctccaggtgcggttgcctcttctctccacacccctcccgggagcacacacgcaggcatgtaggctgctccaaggggttctggaaggctctggccctttcttcttcagcaacctcctaaggggctgggtgaggagtgagcggccaacacacatacatgcatacacacacacgtacactagcctctgcatttcatatacatgtgaaaatcatttgctccccaatgcaggtaacatgagaggctgggccctgcagctctgaggctgtctgcacaaacagatcctgagagagaatagcctcaaggggtctgtcagcctgtggccaagtcagatggtcacgtcctgtttgccctgggtgactggtccagaggtgggcctccccgtgaggactcgactgctagggccagcaaccagcactgaatgcccgtggcccaggtatggggcagagtgcctccctccctcccccagcaggcctgcctcaccaggaccctctcacccacactctggagggtacacagggccaagagccgggggagggggcaagggaagggattagccccaggcagccagctaaaacggggtccaggagcaaggcggcactgaggggcctcaaaggccagcagcatcaggctggcaaggacgcatacatgagcacacactcggaacacgcgggagtgcctgcctgtgtgcctgcaggcaggagtgtgcaggaggccgtgtgagagcctggggagggctgcgccagtgaacaaggcaggcccatgtgtgtgtgtgtgtgtgtgtgtgtgtgtgtgtgtctgtctgtctgtctgtctgcctgtgcatgtctgtgtctgtgtacacacataagtgcatttgtgcatgacccaggggagcaagtgcgccctgcctcagggactccaggagccgagctggcattcaggaagcatctttaggctcttgaacaaaagggcagcctctgctgtctccctccccacagctccctcctctgaggtggcagccgtgtggcacatcccggctcttcaaccttcagcctcatttttatcctgaatatctacacacttgcgtgcacacgcacatgagcacacgcacaaacgccctgtggtacagtacactccaggaatactatggaccatctttctttcttttctttcttttttttttttttgagatggagtcttgctcttgtcacccaggctggaatgcagtgacactatctcggctcactgaaacctccgcctcccaggttcaatcaattctcctgactcagcctcctgagtagctgggatcacaggcgtgcaccaccacacccggttaatttttgtatttttagtagagacggggttttaccatgttggccaggcttctctcgaactcctgacctcaactgatccacctgcctcggcctcccaaagtgctgggattacaggcgagagccactgcgcccggcctacagaccctctttctaggtccctgagcaggggaagtatttctgtgcctccgtgctcttgcccatgctgtgcccccagcctgctacgacttgctttccagagccacctggtgaactcctactttgagcggcagctcagtggcctgccgtcttcctctgcagagccagtggctttccctggtcctgtcctacctgtgggtcttgtgagctacttgttaaaagtgagtcacttgctcctgagacctcagccaccatcccagtaactatcacagacctagattgtccccagaacccaactgaattggttcatccattcactccacaggcacggattgggagcttactgcatcatgcttctccctaaagataagctcttagttaacatcaccagccatgaattactatactggaatacacactcaggaaaagccataatgtagaccaggatttaaagaaatgccatttaactaagaaaaaactaaggaccttgtttcaatatcagccatgagctgccactgcttgttaaatatgagtctatgtcagaggcagaataaacaattcatcaaacacctctttaaggagttacaagtttcttatcaaaacctccagccccatttgtgcttctgttatatcggcatctccaagtggatgagaatgttcactggtagctttgtcccttttccatggtgaggggcagagggaggtgcaggctgtccttcctcttcctcagtctcggtctggaatagctaaagaaagcaaaactacctcctctgagttgagtctcttttcacggagaccctcttctgttgccaggcgccaaatatcatgaaaactgtaactggttaaaaaaaaatcacctgcataaaaatctttaaaattcatttcaacaacaaaactgtgtatgataaagggtcattccaccaagaaaacatagcaatcttaaatgcgtatacaccaaaccacagaactgcaaaatatgtgaagcaaaaactcataaaactggagggctaggtgcagtgactcatgcctgttaccccagcactttggaagactgaggccggcagattgctttggctcatgagttcaagaccagcctgggcaacatggcaaaaccccatatctacaaaaaaatataaaaatcagccgggtgtggtggtgtgtgcctgtggtcccagctacttgggaggctgaagtgggaggatcaccggagcctgggaggttgagactgcagtgagctgtgattatcctactgcactccagcctgggcaacagaaccagatcctgtctcaataacaaacaactctaataaaactggaaggggaaatagacaaatccacaattatggttggagattttaacacacttctctcaaaaattgacaaaacaactagacagaaaatcagcaaattataaaagaactcaacattaccatctataaacaggatctgatagacatttacagaacactctgcccaacaacagcagaatacccatggggcacatcccaatatagacgatatcccaggcaaacctcaacgaatttaacagagctaaaatcatacagtgtgttcactgaccacaatagaatcaaattccaaatgaatcacagcaaaatctccaaacaccaggaaagtaaacaacatgcttctaaatagcccatgggtccaagaggaagtctaaaggaaaaactttttaaatacaccaaaatagtcaaaaacaaaactacaaaacaggaaaatttgtgggatgcagctaaagcagtgccctgggggacatttatagcacaaaaagaaaggcaattttttctctccctaaaaaggaatcagtttctcagaggcaggttggtgcatgggagagggttgacttgaacaatatctggagagctcaaagctttcaaaaaacattaaaccctgaatatatcgggaagctggaagatgttagagcacttacatttactttcctggatccagacttcacatcgaagagtttaattgaactctgggtctacctccagctggctgaattagtctgaacaagaacaagtcattcagatgttcagagtcttcatttcctcatctgtgaaatgctaagaccctcaacttcacagggatctttttgagttaaacgatagagcacttaagaaagcttcccgaaactcccgaagcactgcattcatttgctagagctgctgtcaaaaaatgctgcacacgggatgtgtgaaaacagcacacatttattctctcccagctctggaggccagaagttcaagatcagggtgtcggcagggctgtggtccctctgaaggctggagggaaaggtccgtcccaggcctctcccctggcttctgtcgggttgtggctgatctttggtgttctctggcttgtggatctctgcctccacagcaagctctatactaaggctgtactagaaagtgttagccttgtctctattgtatcctttgatatatatatacatatatatatagctcaaccttggctgcctccttgccagttggcctacgtggctgagaggcgttctgctgtccccgtccttgtgaaggtatatgcacagctatgtgtggacatagtgtggctgctctggctccggacagggccagcttcctcactgcttccagccccatctcacccagggcctctgcagccctgggagcagccaggctctcggcgcacatctctgagcctgcccaggaggattcgggcagtcacccgagcacctggtccctcacggaggcgcactctgcctgaatccctcctcccagatgacgagcgctcacacgaggcttcggtttcctcagtaaccaaggcctgcagctgactggtcacagaattccagggagaggtgtcccagggaccaccattgtgatgacatggcagctggccctcctcctgcccctgtccccccttattcctctagcgcacgcctagccagcccctggggggtggccagcccgcctcaggccaggccagctgagggagactgggaggcctgtggccagcctggccctggcagccacactctgtgctctctgagacggcgcacagccacctggagcatcatgaaaccatgaagggtgcccaggtgccaggagaagggagcagggctaggccggggctgggctgggaaggccggaggggcctccaacagaggtcagggtgcatttagagaaagggaatggcagaaacaagggactgacagcagcaacagggacccagcgggctccctggagcagaagtggggacaggtgggcaggtgagaggcagggggagaaaaggctcagtgccctcgggctctggggcacgccagtgcacgggagaaagggattccacagcaggcccatgggcctcacccaggaattcccagtcttttcaagacaggacaaggccacagaaagaacgaggccgcatggtacacaccaagatgagggtagggggaggacctgggtagggggaggacctgggcagggaagggactgcggggtgtgcctcgagtgccacctgcgggcatgggcctctctgggccccaatagcgtagccaggcagaaagccgccccagttcgccatgctccactcagaactcggtacccagtgcagtggctcgcacctgcaatcccagcgctttgggaggcccaggcaggaggatcacttgagcccaggagttccagaccagtctggacaacatagggagaccctgtctcaacaaaaaaaaaaaaaaaattgattagccaagtgggtggtgcgtgcctgttgtcccaactacttggagggctgaggtggaggatcgcttgagcctgggggttgaggctgcagtgaactgtgattgatccactgccctccagcctgggtgacagagtgagaccctgtctcaaaaaataaataaataaataaacaacccaccagaaatctgtgcccaggcccgatgccaggcaccctggagcacagaggcatctgcagtgcccatgccctcaccagctggccgatgccacgcgggagggaagcagggcacctgaggggcatgcccagcactgtggggccaacagggaggaggggaggacactgcaggcggggaacacggtgccaggacaccgagccaagaagcaacctgctgaggggggtaaggaccatgcccactgcaggccaaggggtgcctggagggagtggggcatcttgcaaaggctggagggcccctctcaggccaggacatgacacgaatgtggggttccgcatctctctgtcagtgcgccccacagcccatcagaggccgtgtccagctgctcctccaggccccaagcctctcatcgtcatctgtcatcagcggcatccccctcgcacaaccctgtgctcatggacagatgcccactctctccaccgagaaagcattgggagagcactgctgggctggggacaggacctcaaggggttgatttctgctctgcatgctcaccccctcccctcctcctttgggggacaccccaaccctgcccatctccatctcaggcaccccctcccacaattgtgctatagcccggcttcctccttcagtgaagggtggagggagcgcagggggccaggcagtggcccaggagccctgacccactccccacccactgccccatcctacctacagacacagccgcacagggccaccagagcagggatctcaggctctttaattccttccctcctggggtctacacacattgctacggccccatcccagagccaggccgggtgcaaagccctggagacagatgccgctcctccaaacgtcccgtctgctcctcagccaaggacagcagtggtccggggcaagcaggacacaggcattctgtgttgggtggtcctagcaaaggaaagaaaggactctcgtgccagcaccagcattgaggggaggctggaaagatgagtgccctgccaggcagatgtggggcagcgtgtacagcaggagggtgcaggcacataggcaaagatgtgggtgaatgtactttgcacatgtgatggacatgaagtgagggaacagagagaggactgcagcacgctaaacagtgcccccccaaaatatctgtccacctggagcctcagcatgtgaccttctttagaataaggcaagggaacacgcgatatcctgcttcgttctggcaactgcaaggcgcgagttggggctggaatgtgggcctggaggaagtcggggagaggactccggggaagcgagcaggagccagatggctcagggccgtggagctggactttgtccttgaggccacgaggggccactgaagggggctgagaggagaagtggccaggcatctgggcaaggacacttcctctggccttgatgtggaggatgggtgcgaggctggggccgtcgtccaagcgagaggggacagggcctgggtgaagagaaaatccagcaatgtgaggggtgattatggagagagaggaatcaagggcacccccgagtttggggtgtggagggaagaactttgggacatccaggcagcaatggagctacaggcatggaacccaggagacactgatgtcacagtcgtcccccagaagagggacataagaaagagacttgggacaagtggccagagtgagggaaagaaaaccaggagggggtgggcatgaggagggaggccttaggaggggacccaagcaagcaggggcaggtggaggaagagccttgcaggccttggagtttggcaggaggcagatgagtcccgtctggaagccgccacttctcaaggaaggcgatgccagctggcctgggctctggggaggcgggtgggagaacacacagcacccaccggcagcagctcaggagaaaccaggccaaagggggctctcaacttggaagctgtggggtggcacagaacaattttgagatgctcaggccttttagggaggtcaggatgggcaggctcaaggctggtggccaggggatgagggccagaggatggaggacacggggatgggaggagccctgggggataggtgggcttggctgaggagaggacgttctgggcactacacgtccccttttcctgaagacagcctctggacacttctctcccttgcggcctacagagcctacccaggcagacccgatgtggctgtcactgagataagagccctgggcttgtgtctgggacacgtgagtttgagaagcctggaggtcacccaagggaacccacctgggggcagctgggcccaggagcctggggcagagacctggtgtcacaggccagtgtatgagcactggagtgaagtcagccaggcggtgggctaggaggtcccgacactcatccctcccccaaaacaacaatcaataagcgacatgctcagagaaacaggatggcagtctgctgaggatcaccagctcctggtcctacaggtcttcgggcaacatgagaagtgacaagcgacaggtagcaccgacccaaactatgaggacacaaaagacccttcagaggccgagcaagggccttcactgtggctcccttggggcccttgaggttctggctgagctgggccgagaagagggaagtgagcatgcaccagagacgccgcctgccaggagacccggcccaagagcttccaggcagatctccctgccttgcctgtgctgagctccaaagaaccacccaccatccaccatagggcaattctgaccacagccagccagggggcagtgctgggagcaggccaatcctcagatgccaaggagccagcttcagcaccagccatctgtgacacctccctctggctgggctcaccactgcagcgggtagcacaagaaaggcagcagcctgcggcttctgcttggaccctctagagacgggacgcacacccctccaggaagccagtctcaagctggctgccctgccgactgggaagtccacctaggctcatggtcctggggatcccatcctcagcctcccctgctttcccctttagggctgagaagaacaggcagccatggtcctcatggctctggccagctctccaaccacgcatcctgagagctgagccttacaggctgacagactggaccctgggtcaccctcatggtcccagcccatgtcagccacagccgtccttcttggagctcaaaaggcagtgaagaacgagtctcaggccctgctccaggtggtgacagcagtggccaggactgatgactaactcccagagccgcctgtgtgcaccctccttttctctgtataacactgacatggcagtgggcatgcagtgtgcagtggtggaagggagatggctgtggagatggttaccctgtcgttgcaggcagggcagtaagaagccctggaaggggctcagtgacctgccacagcctcccaccgggaaaggccaggctgcatgcctgaccccacacaaggagccttggctgtccccttcccatccatggcatctctcaggcagaggcccactggccctctccgcgtggatgcggttgatccctgggacgtggctgccacctttctcaccttccccctcctctccaccttctctctgcccaggagccggccccgaggtgtgggcaggtcacgtggcaccgcatctgcactgctctcctctctggggccctcgggacccaaatcagccaccgatgtgggaagcaggtactgaggggtaatagccgctctctaaatttagacgggagaactccccagagagctggcagaaatatcccgagccttcctgtggcgaggctctcaggcaggagaatgaagagggggcagcgagaacccggggatggggggcagcagggctaagagaaggtgacagaggagaaggcccacacctgggctggggtgcacatgctctggaccacagccttgaactccaccctggtgggggcggcccacattcaaggacaggccagctcttctctgcaattccggtcgcacccatggctctccagcacccttctgcaaccaggagggagctgcctccttccttgctctggccgggtgggtggcttgccaggtgactgaggcctgagccagcagctcccctcctgcctgtcccccagcctataagaaagagccactcaagggcagaggcagttccctgcggaggggcgccctggccatggggccctggctgctagtctgtggaactgagcacatagcccggtcaccgcccccacattccatacttcagcatcctcatccagaagcaaacaagaagtgcagcaaacagcatggcttgtcctcacggtcacggcaccagtggtgggagggaggagaccctcatctgtccctggagctgctgtcaccattacccaaggggcctgcacacaaggtggaagcttcaggacagctgtgcttccaagggtggcccacgcggcgcccctgtcctggaggccacaagtctccatcagctgggactccttgcctggaaggtgactcgtggcacccacagctgtgattctgtctccagctgtgcccctgatcgctgcagggccttgggcaagtggcagcggtgggcaggagaggtgctgggtgctcccagatgccagagcagcaaggggctcagcagcctgagggtggggatgggtctgggtgcaggaagccaatggggcccaccaggctgggcctttcggtgctgggaggagatggggagtggtggagggaggcagccagacaagccaacaggtgctgtgaccgagcgcgcaggggcagaggcccccgaggagtgagatgagaaaaacccacagcctccaggagccgctctccacccccacagacatctgagccagggcaagcgctcgccacaagcccctgcctgggcctggccatggctgcctgtctcgtgtcttatcttgttacctgtggtgagacaccctgactggagaagcatgttcctggaagggggacggggtgggggatgctgaaatgcggccagaaaggcaggtgggcctttcctcctgggccaggcggggcaaaggttggggggatctgcagcaggggagccaggtggactgggaacatccttggcacccccaatctccccagacccatcgtttcacccttggtggctcccctctctcctggttcccttagccctggacgtccctgggccacgcgggaaagtcacctgctgccctctctcctcctcttcccctgcatggggtctggacagaggctccttgtctcccctcacttcccttcccctgtctagcccagggctgtgggtggctggctgtcccggtaaaaggattatatcatctgtaatgtatatccagacgcacatgcactgctgctcgggaggacaagacaaggagagggagccagtgcagctggccagaggggaattgtattgaacctgaacctgagccctccccaaatgggggtgctaatggctcaccaggtcccggcccgcagaaatcaatcgctgcacaggctggcgctctgtgctctacccccctcccttccctctcacctacctcctgtccctccctggtgctcacacccctgggcactcagctgcccggctggcctgcctttgacctcgtctgcaagtgacatttcagagccattttgtttcaaatgtctgggcagggctcctttgggagcggctgcagacaggtagggtgcttctgaagacatggtaactggtagcggggtacatctagaagatgccggctgaagcgcttcagatatgggagggtgcagagggaggagttggagggttggcgcaggggggtggggggattgtcatgtgaacagaaggcttcagctgcagaagccatctctgtgggacccaatggttacccagaaatgaagtctcggatgtgtgtgcaccctggctccggagcccgcagatgtgatccaggttccatgcagggacacaggcagggaggacccagcactcggaggcagcagcagcaggcgccgtggtgtgctgagacaagccaacagcagggcagcgtggggaccatgggcggggccctgaggagggcgcttggcttatggcaggaacgtgcctgcccctgtgccagctgtgaggctttgacggccatcacctttcccacggtctctccccaaaacctcatttgcctggagagtggcccggaatcgggccctgaacaaactgtcccttaacagatatggatgccttcagccaaagccctccatgtcagagggtgtgagttgggccggccgccagaggcactgctaggctaaagacctctctacccccagcaaagtgcagctcccgtgcccctccaccttgcccggggctggcggttcctgtgtctgatttcaaggtctctggggagcacctttgggattcgggagggcgtggggtctgacaggaaacaagatggccacttcccaatggccatccccaaggaagggacaggaaggacggcagtggccttggggttccgggtggaatggagggcgagggctggggcggccccgtcgcctcaccctgagactcccgtcagcagcagatggacccagctgcttcggagtcagagacccagctgtgccctcggttctgccaagcaaacttgcactcactcaagtcccccttgggagtgttctgcattttcttccccagccctggggatgaagagggaaccgctatttcctgaggccgagcaggcctgtgcctcacgagctccccgggcatctccgggcaggcctggcctttgcatgctcctcttccggcaacggatgggtcttgttgcctggagagcagagacaccaggagggctgggagtgggagctgtgcaggggcgagggtggcattcttcaatccaaatgtttctccgccagcctctcagccctgagtcactaaagcacaggatggtggcggaggggaggatgttaacaaaccttgctagaagctcctccgagtcagctcacccaccaagcctttgccgggggtcagctgggcacccaggccatgggcacagctgtcgtacgtccttcccaaacaggaggtgccctcagtggagggggagtgtgaaaggcagtcccctgtttgtagggcacagcttctatggaatattgatttcttaggaaaggttccgtaacttcagcacgtctagcagtacgggcaccagtggcagctgcatgtgctcgcctgcgtggcatagccttgggtaggtgcaagctcaagtcctgggcagcctgactccccaaggctgtaggggagagccccagtgcagtcccatgaggcccagcgtccagagcaggaagacagttgcagggccagaggcctgctcccaggaggggctgtgctgccgccaaggctgaaaaggtgcagaggagcagtcggggcccagagcagggtgggcaggcctggctggcgacagcaggaccctcccagctcacgcaccatggcttgaaactgcagcacagctaggagggtccttggagatcacatggtcccacctctctccccaaacgtacataccaggaaatggagacccagatgggacagggacctgggctccagaggcaaagctgctgccctcgcctcttccaggggtaatgactcaggggaattcagcgctgcggcagacacagccaagcggccagcggagctgctggcatcccagccctgcctggccgcaccttatcctgcgctccctgggcggagaagacggcccttgatgctcacagcctcctgccgggtctcaggcaatcccccactgcaggcacgaggccgggctcatacactgctggtctgggagccccagaaaggccaggtgcacatctccacgggctgtcctctgcctcccctccccacgcaatcttccgcactcacactcgctcaggctctaggcttctgaactcagccagcccaagccacatcctactctgccactacactattgtgccaccaccagggagccacggactcagtttccctggctgtagcatggggacaatcccctcagacttccggaactgctgtaaggataaaatgaggtccttgatggcaatgcgtgtgacctttggcacaaaggagaaagctaacgggacctagtgacaacagccgctccctactcgcttccagcccctcccccacccaaacgtcctggctccaccccttccaggcactgaggctcaaatgctattactattagccagaatctgacacatgagaatgagaggagacactgcagggggacctggggtgggggatggaattggcagcgctgtcagccagactttataccctcttcactgtgggagcaggaggtggctctggggcaccaagttgcgcccagtcctcaatgggccccttcgctggggtgccagtgcagattctgcgcgtaaccgtccacctagcccaggcccagcctagttcagggcccccaaccccactcccgcgccccaagcgccggagcccccactcattggcgccactggggaccggggagcgcagggcgcgtcgggcaggactggcctagagaacagaggcttgcaggtgggaggaaggcggcggggggtggggggggcgtgggaggtggagggagacgccgggcaggccgcggcccctccccgctccctccccgcgagccgccagctacagtgcccctcctgggcagggggcggagaagacggcgactggaggggaggaggcggcggcagaggcggaggaggcagcggcggcggaggcgggatttggagtttccctccgcagcggcggcggcggctgcccctcggctccaggagaggccgccacccggggttccggtggcgttaggctgcagcagtggcgcttcccgccgcccgagcttcggaaacttcccggccgcgacgcagggaaccggcgcggagaaccgagcagagcggaggtgagtggagcaagcggcgccccggggacccccaccccccacccggcctggctgcccccgccccgacgtgcgctcctccaccctgcacccccaaagtcctgacaacgcacaccccacgaagccggcgcacgcgcccctacgacacccattcggtgctgctccgcacacccccgcacgccgcccgtgcacctcccgtgtctcctgccacttgcaccggctgcacactcgcgcgcatacaaaccacgcaccacagacccgggtgcctgtagtgcacacactagctgcccctgccccaccactcaccactgtccccaactcatgccaacccaccgagaccctgccacgccccagtacacacccaggcgcacacgcacgcttccaacacgtctctgccatacctgcaccaacatagctccccctaccatgcccccaccacctcgaactccccatctgcccattacagacaccccacccacgttgccagcccagagacactgcagtccacccatcctggagcgaggtcccgtcagaaacccacatcccagtggctgacgctccccacgtcccaggcacacacctccagcatctccaacgcgcactctcatccaccccagcacgcgcgcacacctgctggattcacgctctccagcatcctgccccgcccccatcacaaatagccttcgacaccccccagcacatctctgagtccctccctccctcacccccaacacctggcacgcgggctctagaggctgcagcatttggtggcatccctgccaggcacctctggctccccttcggcagaggctcagcagccttgggccccccaggtgcctccctaaacagaccttgagactccccagcgactagcttggcctcttccctaagaaataaagaaggcactttggggtccaaggtagggtacttagatgtggaagcaaggggccccggggaggggcggggaggcggcggagagagcccggcgctgaaatggaggcggcccaggtgggaccaaaggggcgccagctgcccggcaagcacgtagtaggtgggttccatgggggctggcgtccgcgcgcgctgtctgggtgcctgcctgcgtgtgtgttacggggagggctgtgtgtgcacgtgtgcttgtgcgtgtcggggtgggggaggagtgtgtgatcggcagaaggaaaagcaggagcagctccctcaggcaacaattggtttcattcattcatgccttctttgttaacgagcatttcttccgcgagcgccgggcgcgtgccaggccctgcactgggggctggggccagcctggggccgggcacacacccgttcctgccttggaggaactcccagtcccgcgaggagaccgaccaggaaaagcagaaagccatccccagcagaaagtggatttggtggaaaagacactggatttggcaggcacgctgtcgccgggacttgtgctcttggccatgtgacccggccgcgacagccgaaatcctgtcactcggcccggcgggaacggtgcatctcgtgggggaaggcggcgcggcgccgctctcgggaggctcccgggaccagagggcgcacgcggcgcgcgcgaggcctgcaggcggcggcgtccccgcggcctccagggggcgctggcccggcccggcggaggcccggggcgcccggcgggggcgggtgcgggggcgggggcgggggcggcaggcgcagcgcccaccctgcggcgggcagcgagcgcgcggcctggctcagcccgccggagggggccagacgaggcccgggcgcgcggcgcggcctcccccagcacagcgcacccgggagcggctgccggcggggcggcgcccagagccggcgctacagggggcctgagtgggggcggcccggcgagggtcgcgggtgagagggggattagggggttggctgcgctcagccctgcagtgcggaggtggcaacaggttcccatttgtcctgttgctggcgctgcgggcgctgtgggccccgagcactgagctctgactttggaaattgagcccctcatggcctcctcccaaatgctttctcccggtgcgaggacttggcagcagggctccgcagttaggtgcaggggagcccctcgccaagcgtcgggagacgtggacccttggatcctaggcttcccctcccttccccattgcggaggttgcctctccccgtcctcattccagcccagctcctctcacctccagggaaccctctccagagagcgccactgagcagctcaggagctccctctctagccgaactgagcccccacggcagggcgggccggggaagtggctgtccagctccctgctggtcacagccctgcgccacccccactctccacaacaagactggcacatggcagaacctccgtggtgccttcaacccctgcccactctgagctcccacccacagctgcagtgggcctggaggcagcccccaggctgggtgccggtgtccacctccaccactgtggagctaggctgtggacagaaaacagaagacaaagtccctgccccaggaacacactgagaaagggggaaagtgaccacactagggagcacagaggagggagactactggctccgagttgggaaggctgcctggaggagggggcctgaagaatgagcagaatctcagaatctgggcagggggcataggagggaggcctgggctggggcccttgcccactgggtgagagaaggaagggcacagtccagctgcccaaagcccttggatgcaggaattaggactcttgttagacgcagggacatggggggtgtggccggaaagcagcccagtgccagggtcctgggagtccccggctagcagcccactgcccgaaagggagggagagaggcaaactggaagccccttagaggtgacccacctagctttccgtcacctgccctcttacctaaccatgacctgagacattttctcctctaactccatggctcctgagaggagtctttagactcgtagtttgctttgcattttccacttgttagaaaaatgctttgtggtgcccatcctcgtgtgcataactttgctttcttttactttagttccttagattcccaaaagtggtcaaagggttgggattttttcctagctcttgatattgccagattaatttccaaaggggccgtaccaatatataaccctgcaacagttgaacagcacgctgatttcacagcaatcttgccagcactgcgtgttctcaaaaatgagaacatttctaatgcagtaggtgggaagtgttacctcgttggtcattgttacttgtttattggagtggctttccttccacgcctgaagttgaaccttcccccaaatatttgttaggccaccgcattccctccttcctgcagtatgcagtgttttcaggttctttgcccatttatctacaggggtcttaaccttttagttgggtatgagctttatcttatctggcgtacattttccttcaacactgttatttgcttttgttgagctttaagcagagaagggacttttagccagatcagcattgtggacacctccccctgaccctggtctcctgcctcagtgctcaccacacctgagaccttgtccagtgctcttgctgcctgtggatctgtcccgcctgttgtgcccatggaggaaaggatggaggccaccagccttggttgagtggatggcattctgacgttgggcagggctgggcagggcagggtggagggcaggtcgttgcaggcccggaggcagggagactgttgtgcaagacgtgacagtgacctggcctaaagctgatgaatttgagccctcggctagggcaagggacaggggagagaggcgtggatgtgagagatatttaggtagaaactagttctttccactttgattagccgaaggggggttaagggaaggaggcagaggggggagccacgggtgactcttaggatcagtaatgtgataagagcagagtgccccagtttagggctgggagctcagggttcctgggtgcttttggccagtcctgtgcgagtgaagcgggctggtattggtaggtatccaggagctacccctgcctgcctagccctgcagcagacctctgggccaaagctgcactaagtttctggtcctgcctcctcctcccctccgtgatttcggtggcatcccaagtttgcccaagctgctagctctgagcccattacagagatggggccactgagatccaggcaggggagaagatgctccagtatcaccctgtgagttgggctggaggcagcttctgcggcagaggggctgggctctggtcctcacccctccccctgcctcccgaggccaggctggcgccggccaggggagccgcagctggtcccctgctgggcccctgacctgcccttggcctctgccccgaccccgtcccgcctcggtggaagccccagctcagccgactcgcaggtcccacccgactgcttcggctagcacccgttggctcaccggcccgccgggcccgcccccggagccccgccccggcccgcccctcggagttgtaactccacgtccgaaggcagtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccaggtctctttccttttgttctctcctaggggtagggggagatgggggaccgggggccagaccacctctgagaggactcgctgaggcccagcacctcggcgcctcctctgttcccctggcccacctggccctgggggagatctaggcctcgaacggcactcctcgcacgcacacccccagccagagtcggaagctcgaacttggggagcgttcgcgagaagaccgagacaggagcagaaagggggtatggagggaggcggctgcgacctcagggtaccccaagatgagcctcgaaggggcggttagccgctcagccctcttctcgaggacccttccccgggccgagctgctgcctggggggtttcttggggcgccttgttgggagtcctcatggtgggggaccctgggctcccgccttcaggacgcggggccggcttcaagtctgagccccctcggccctccggtagctcacaccgcgccttctctctcttcgcagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggtaggtgccgcggggccctccttccagggggttcgggattcatttgaccttaggccagccccacttctttttttctaaagcgagttgaggcccccctcccctgatgacctgccaggctgctttgagaggagggaagcctgagtgtgaccgtggggaagttcttcaccctcggcagcccagtctctgagcctggaaaatggggagaattagcctgacctgagctagttctcaggatgctcaagaacgaattacaaagtgcgggctccccagggtctcggcaagggtatccccacctccccaacctgctcaggaatgagcaagggaggcaggggtcagacagcactggtgcaatcacggctcactgaagcctcctgggctcaagcgatcctcctgccttagcctcccgaacagcatataaagtgttcaggtgtccagcccggggaaatagtatctgtaaatagagatgctggcttcttgagccatattctcccccaagttcccccacatcttggggtcccacttcatccctgagagtcaggagatgcccaggcagagagctgacatctgagttcctccttttctttagctgatggccgcagtcctccctaaggctggcagtgcatctcggctctgttgagccctcacacctgcctcagcttgaccctaggggtgtaagatcctttccggtggctcagcgtgagcccagcttcttgcagcccgagctgactgagggtggctagggccccacgtgggtaccaggacacaccaagctgctgggttttgtgttccctttgggaacatttgcaaaccctccaagttgtccagggtcatctccccagccccagacagaggcacttggctgcccagaaggccaggtcagcaggccccatgccctctccccaacaggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattggtgagtccaccccacccacccttccctcctgtcctccccaaggcctgctctggcctcccccttgtgagtactcctcccaagccccgctgccattcccagagccaaaagcctaggtgacagttctaggggacaggcagagctagggcggcccccagaggccactagagaaacctgcaggtcgtggccatctggcccagggggcagggcggggcctttgagggcccttcggaaggcctcggcctcacacacgcctgccctccgggtctcccgggccctttcctgccccatctagatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccatgtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagagtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactgagtagagagagaagctacctcctgagcgccttggagggtttgggggaaggtggggaaggaggccctcttggtctctctggactgcccatggtggaaaggggcatgtgccaggctggccagggactcaagtgccaccccactccctgccccatgttatcatttcccatcttgtgcttacactgcccgctggcccacgctctgagtcgcccattcattcacctccatttgaacccctagtctgtgccacacactgtcctggggactaggttgcagcagtgagctccgcctgctcacagcagactttctagtgggggaagaaacgacaaatgcaacagtcacagcactgcggttgtgccgtagacgttcattgccatggacagagcagaaaagtgaggggccagcactcacaactgatccctgagacaccggccaagtcagccccgagccctgcctggagcctcctgagggctgccccggctgggtggcatcctgagagtgacagggaggggtgtgggcagactggcacatgtgagtgttgtggttgtctggctgtggaatttgggctgcaaaggcccaggctggggactagaagagccccatggagaacatggagaccaacgggccacctaaagggacagaggtgaactgcacctctcctcatattgggacactgcaagtgccttctccacaccataactggtggggtctataaggctgtgactctccaccatggacatgtagtagaggggaagggcagctggagggtggcggggagcgagtgcagccagagaaagctgtggaggctttggagcaatgtggcccagaacccacaatctaaaggcatatgcgtgaatggctgagctggtaggaaaggaagagcaaggtgatgaactgagaaatgaggtgaatcctctgggccagcggagtaagccactctggggttagcccaggagccaggaccctccactggaacgcagccccaccaacaccttgatttctgtccagtgaaatctattttgaatggctgatctactgaaatggaagatgtgaaatctgtgttgctgtaagccactaactctgtggtaatttattacagcagccacagaaatctactagaacaggtgacctaggaagatatatcccaaataaagaagagggtgtgtgctgatcttgaccttggatctggggggaagtggaataaaaggaaaatgttccccctcccctgagagcttatagccacaagctgaactgttcttttagagtggtctaggcatagagtagtggacactccagaatctctctcagaggtacttagaaacagtgattcagccgggcacggtggcttacacctgtaatcccagtactttgggaggctcacctgaggtcaggagttcaagaccagcccggccaacatggggaaaccctgtctctactaaaaatacaaaaaaaaaaaaaaaaaaaaaaaactgagctgggcatggtggcacgtgcctgtaatcccagctacttgggaggttgaggcacaagaagcacttgaacccaggaggcggaggttgcagtaagctgggattgcgccactgcactccagcctgcatgacagagtgacagagtgatgagagagtgagagtgaggccctgtctcaaaacaaacaaacaaaacaaaacaaaacaaaacaagaaacagtgatctggctgctggagaaggctcctggatttgtcttgaagctgcattcgactatcttacctacagggtttactgagattgtgacagcccaataaaaatagcagtttaaaacataaataaaatacatttttaaagtttcttattttagaaacaaggtctcaatatagaacttaaataggccaggtgcagtgcctcagcctcccaaagtgctgagattacaggcatgagccaccgcacctggcctatttaagttttaaatgaagtggttcagaggtcatattgctccagagtgaccagcagaagcaagcacaaatcctctgtggagggagggatgtcctttaaacacaggcctcaaagcaccgctatagaaaattccaaaatacgtaattttttaaaatcctaaaatgtacaaggaaacaagccaccatgagttatagaaacatttagcatgtgaattcaagtatcagtcctgcaaagatagcagcctttgaaattatataacagactataagtataattaatatgcttaaagaaataaaaggaaatattgaaactgtaataaaaaagcaagagaatataaaatgactagatacgcttgaaagaaaaccaaaaagagctcctagaaatgaaaaatatgacaattgaaattggacatttaaagtttaaacagcatattaaacatagctgaagaaagaaatagtgaactggaagatggatttaaggaaattacccagaatgcagcacagacagacaataagacagacaggtcacacatatatttagttggatttctagaagaaaaaaaggagaatagggaatataaagtattttaataaacaatgcctgagaaatttccaaaactgatgaaagacaccgtggaagagactgctgagtgtcccccagtatccattctctgcttctcctttttagaaataaaatgcccaaaggttaatagcgtgtatggcttcacagctaaaaactttatttcccatcctcccttgcggctaattgtggccatgtttttgcatattgtctcatatttccattagagcccttagcattttaatcatagttattttaaacttctggtctgatcattccaacacccctgtcatagctgagtctgcttctggtactggctctatctttttgaactatgttttttggcctttagtatgacttgtcttttttttactttttgttttttttgtcaaaagctggacacatactgggtaaaaggacctgctgcgaataggccgtagtgatacagcagaatgtggagggaggaaaagcattcagtcctgtgattaggtttctgtctttgggcgtgcctatgcccctggactgtgaatttcaccaatgcttctcagattgtgccccgcttaggtgggccaggatggctacaaaagactgagttgggtatttcgcttccctcaggtcagttaggctccgccaaaaccctaataggttgggcctggtaagggttactcttgagggcaggcctagttaagaaaggaacgccctgggcgtatttcaaaatgaccactttcccctccccctgccagaagcatgatgagatttttctcactgtgagaacctggttgagctcctaaaggtaaaacttacaaaagtatgggagccccaaaagactgccccatcccagagttttaactctcagacttgtccgcactgagcccccagcaattcagcaattgcagttcgggtgtccctacgccagcactggttcctgtgcctggcctcctgctctgctaagttgtgattctctgtgcccacctgtctgtctccccaattttgggggcagcattttgcccagtgacttcaattctctgataaatctaagaggagttgttgattttaaatgtgttccacttttactcgttcttaggacagaccgatgacttctggcctccttacacactggaccagcaacagaaactcccctgggtctgtttctattgaccgatttttcttctcatgatggctcacatttttatgcttcttctacctgagtcagaaagccgggatgtagagctctcttagtctgtctcctttctctcagggaccacagtccttcactgactgctgtcccccatctgaaaacaatggattttcatatattttgcccagtttctagctgtttatggtgagacagtaattctggaccctcctattccctcatggtcatattgatattgagtgactttacattttgttaagacaaataagcatattaaattttttagcataactagaatataaataggatatactacttccaaactagtagaggaaaaaagcaaataatgaaggaaaatatcaactaatcaaaaaaaggtcaagtaagggaaataaagaaacagaaacattggaataagtagaaagtataatatgttagaaatagatccaaaagacggccaggcacggtggctcacgcctgtaatcccagcactttgggaggccgaggcgggcggatcacgaggtgaggcaatcgagaccatcctggctaacatggtgaaaccctgtttctactaaaaatacaaaaattagccgggcgtggtggcgggcacctgtagtcccagctacttgggaggctgaggcaggagaatggcatgaacctgggaggcggagcttgcagtgagccaagatcgagccactgcactccagcctgggcaacagagtgagactctgtctcaaaaaaaaaaagaaagaaagaaagaaaaaaagaaatagatccaaaaagcattaagcaaaataaatagattaaattctccggttagactggattttaaaaaatccagctataagctgtttaccagagacgcatctaaagggtagaaccagaaaaggttgaaagggcaggactggctgggcacagtggtggctcatacactcaatcccagcacttggggaggtcaaggcgagaagatcacttgagcccaggagtttgagaccagtttgggcaacatagtgagaccccgtctctacaaaaacaattttttttaattttttttttaaaaaagaaggcccaggcacggcgactcacgcctgtaatcccagcactttgggaggccgaggcgggcagatcacctgaggttaggagttcgacaccagcctgaccaacatggtgaaacgtggtctctactaaaaacacaaaaattagctgggcatggtggtgcgggcgcctgtgataccagctactcaggaggctgaggcaggagaatcgcttgaacccaggaggcggaggttgcagtgagccgagatccagccactgcactccagcctgggtgacagagcgagactccgtctcaaaaagaaaaaaaaaaaaagaaaaaaagccctgaaactatcaaaaaattagtcaggcatggtggtgcgcacctacggtctcagctacgtgggagactgaggcaggaggatcacttgaaccaggaggttgaggctgcagtgagccgtgattttgccactgcactccagcctgggtgactgagtgagaccctgtctggaaaaaaaaaaaaaaagggcaggacctccacctatggccaaatgcagatatcagcaaataacctccccaaaaaagtaactttatataaagctggacaaaattgacaaaaacaagctttttgatctggaagtcaacggaaaatgtctcataatccaagtggctggattttgagtaagaacagcgggagtctgtggcattctggcccagggctgctcccatccctcctggcttgctgggcatggaagctatgccaaggaggggaaggccatgaagaccagcagcttctccccataggcttgaaaggcgctcgctcatttggatgattggtgggcaacacctgtgcccagcggcatgatcggtggaagtgacttcttggaggtgggctggcagggaagattttttccatttaaaaaatatatattctagttaaaaattttaagcctggtttcctaggagctaccctgtatctgcctagcttggtggtcagccaatgactggacagaagctgtgctcaaacatctcaagccagtaaggcttgtgtccttgggtctgggtgtgggtaggggagcttattcaatgttcaggctgctttaaggtcttctgggctttcctttccactgggccctctcacatctcttatatacacgtgcatagtcccagggcagtccaggagagcgtgagtagcatgggacccctccagtctctggtcagctagaaatatactgccgcaagcacatccatagcctcagttgagtagagctgatctgtttgcccttcccaacccgcccacctccaagaagtcacttccaccgatgacaccactgggcacaggtgttgcccaccaatccaaatgagcgagcgcccttcaagcctatggggagaagctgctggtcttcatggccttccccgccttggcatagcctccatgtccagcaagccaggagggatgggagcagccctgggccagaatgccacagactcccgctgttcttactcaaaatccagccacttggattatgagtcatcttccgttgacttccagatcaaaaagcttgtttttgtcagtttggtccagctttatagttacttttttggggaggttgtttgctgttatccacgtttggccatagctggaggttctgccctttctttttcttttcttctctttttttttttttttcagacagggtctcactcagtcacccaggctggagtacagtggcaaaatcacagctcactgcagcctcaacctcccggttcaagtgatcctcctgcctcagcctcccaagtagttgggaccacaggttcgcaccaccacacccaactaatttttttatttttttgtcgagacgggggtctcactatgttgcctaaactggtctcaaactcctgggctcaagtgatcttcccgccttggcctccccaagtgctgggatttcaggcgtgagccactactgtgcccagccagtcctgccctttcagccttttttggccctattctttagatatatctcttataaacagcttatagctggattttttaaaaatcctaactggataatttaatctatttattttgcttaatgttttttggatctatttttaacatattatgttatactttctgcttattccaacgttttggtttcttttttttttttttttttttttttttgagacggagtctcgctctgtggcccaggctggagtggcacgatctcggctcactgcaagctctgcctcctgggttcatgccattctcctgcttcagcctcccaattagctgggactacaggtgcccgccaccacgtgtgactaattttttgtatttttagtagagatggggtttcaccgtgttagccaggatggtctccatcgcctgacctcgtgatccacccgcctcggcctcccaaagtgctgggattacaggcgtgagccaccgcgcccagccccgtttccatttctttatttcccttacttgacctttttgtgattagctgaattttccttcattatttgctattttcttctactagtttggaagtagtacatcctatttatattctagttactctaaaaaatttaacatgtatatttgtcttaacaaaacataaagtctctcaatatcaatacggccatgagggaataagagggtccagaattactgtctcaccataaacagctagaaattgggcaaaatatatgaaaatccattgttttcagatgggggacagcaatcagtgaaggactgtggtccctgagagaaaggagacagactaggagagctctacatcccggctttctgactcagatagaagagacataaaaatgtggcccatatggattgcttgagcccaggacttcaagaccactctgggaagtatggcacaaccccatctctacaaaaaaatacaaaaaattagccaggcgtggtggtgcacacctatagtcccagctactcagaaggctgcagcaggaggattgcttgagctcaggaggtggaggttgcagtgagccgtgatcacaccagtgcactccagcctgggtgacagagaggaatttcagtttctggtccagcatgtaaggagcctgcaagtcatcagtgtctcctaagaagaagtaaaaccagaacagacttaaaactgaacacatattttgatatgtgtaattggaggctctgaggaagaggagaaagagaaaggggcagaataaatatttgaataaataatggctaaacaccagcatttggtgaaaagcattcatcagatccaagaagttcgaataaccccaagtgagataaacacaaagagagccactcatagacatttcatggtaaattatcgaaagccaaagacagacaattttgaaagtattatagcagaagaaataaatgacccatatagaagggaaccacaataaaattaacatctgacttctcatcagaaacaatggaggccacaagggagtggaacaacaaactgaaagcactgaaagaaaaaaatactatcaaccaaaaaaaatttgttttgagacagagtctcagtctgtcacccaggctggagtgcagtggtgtgatctcagctcatcgcagcctcaacctcctgggctcaaatgatctgcctgcctcagcctaccaaagtgctcagattacaggtgtgaaccactgcacccagcccccaaattttatatctagcaaaactatgctttaaaaattgaagctgggtgcatagctgggtgcggtggctcacgcctgtaatctcaacactttgggaggccaaggcaggcggatcacctgaggtcaggagttcgagaccaacctgaccaacatggtgaaaccccgtctctactaaaaatacaataattagccagacatggtggcatgcacctgtaatcccagctacttgggaggctgaggcatgagaatcgcttgaacctgggaggcagaggttgcagtgagccgagatcacatcactgcactccagcctgggtgacagagagaggctccatctcaaaaaaaaaaaaaaaaaaaaaaaaaaaattgaaggtttaaaaaaagacattcccagataaacaaaggctaacatagttcattgctagcctgcctccttacaagaaatactcaaggaagtccttcaggctgaaaggaaatgacaccagttagtaactggaattcaaagtaagaaatggagagcagaaaaaatggttaataagtgagctaatataaaagcctctcaacatatttttattcatttcttctcttttaaaaacataagattgcattaaaaaataggtattacactgtatttcagggcttataacctatatagatgtaataaacatggcattactagcacaaaagaagtgggaaagaatgtagccatactgaggcaaagtctccatatttcaccaaaattaagtgagtattcatctgaggtggattgtgattagttaagactcataatgtaatagctagagaaaaccctaagaaaataactcaaacttggagtgaatgaagcatgtttatgtctaaatttctgcttcaatgtaattaaaaatcaacagaggaaaattggccagcacggtggctcacgcctgtaatcccagcactttgcgaggccgaggcgggcagatcacttgaggtcaggagttcaagaccagcctggccgacatggggaaaccctgtctctactaaaaatacaaaagaaaattcaaatataacagatggacatttcaatgctctattttcaatagttgatggaactagacagaagatcagcaaggatatataaaatctgaacaacactatcaacaaatttgacctaactgatacctatagaacacaccattcaacaattgccaaatacacatttttttcaagtgcacatgaaacattctccaggatagaccataaaacaagtctcaatatatttaaaggaatttaaataatttaaataatataaaatatttctctgactgcaacagaattaaattataaatctaaaaagatagaaacctaggaagtccaaaatacttggaaattatacaacactcttctaaataactggcacgtcaaataaaaaacaaaggaaattagaaagaatgaaatgagaatgaaaatgaaaacaaaacatatcaaaatttatggaatgcagctaaagcagtacttagaaggaaacttacagctttaaaggcctataccagcaaaaaaagaaagatctcaaattaataacctacgtctctaccttgacaaattagaaaaagaagagcatgctaaacccaaagcaagcagaaggaaggaaataaagattagcacagaaactaatggaattgaaaacaggaaaacaatagagaaaaatcaatgaaaagaaaagtcagctctttgaaaaatcagcaaaattgtcttgggtagagtgaccaaaaagaaaagagaatcaaattaccaatatcaagaagagaaaaggggggcattactactgacctatagaaatttaaaggattataagagaatgctttgaccactttatgccaaaaacactggacaactcagatgaaatggagaaattcctagaaagacacatgaccaaaactgactttaaaataaattaaaaatctgaatagacctataccaagaaaataaattgaattagtacttgaaaatattcccacaaaaaaaatccaagccccgatggcttcactggtgaattctatcaaataactaaagaatgattaatgccaatccttcacagactctttcagaaaatagaggagtaagaacactttccatctcattctatcagcccagtattacccttgcaccaagtatatcacaaggaaaaaagctacatatcaatatccttcatgaactcctggatgcaaacatctgtaacacaatatttaaaaactaaatctagcagcacctaaggattgggcaccatcatcaagtgggatttataccaagaacccaagcttgatttgacatctgaaactcagtgtcatccaccacatgaacagaaaaggacaaaaaccgtatgatcctctcaataggtgcataaaaagattcgacagaatctaacatccattcatgatttaaaacagtccttttgcgggtggcggcgagcgcagaggacgccatgaaggccccgggcacacgactagagtaccaggtggtgggtcgctgcctgcccgcccccaaatgccacacaccgcccctctaccgcatgcgaatctttgctcctaatcatgtcgtcgctaagtcccacttctggtacttcgtatctcagttaaagaagctgaagaagtcttcaggggagattgtctactgtgggcaggtgtttgagaagcgccccctgcgggtgaagaacttcggcatctggctgcgctatgactcccggcgcggcacccacaacatataccgggaataccgggacctgaccaccgcgggcgctgtcaccaagtgctatcgagacatgggcgcccggcaccgcgcccgggcccactccatccagatcaggaaggtggaggacatcgcagccagcaagtgccgccggccgaccgtcaagcagttccacgactccaagatcaagttcccgctgccccacagggtcctgcgccgtcagcacaaaccacgcttcaccaccaagaggcccgataccttcttctaagggcagggccctcgcccgggtgtgccccaaataaactcaggaacgccccccaccccccccccaaaaaaaaaaacctttctacaaactaggaacagaatggaagttactcacgataaagggcatctatgaaaaatccacagctaacatcatacttgatgatgaaagactaaacgttttccctctaagattaggaacaaggaaaggattcttttaccacttgtatttaatgtagtattggaggttcttggtagtgcaataagctggagaaacaaaaagaaaaaaagagaaaaggaagggaacaaggaaattataagcatcccaattggaaaggaataagtaaaaattttctttacttgcagatgacacgtgctgtgtgtagaaaatcacaaagaatccacacaaataaaacctactagaactaataaaaagggccaggcatggtggcttatgcctataatcccagtgctttgggaggctgaggcaggaggattacttgagcccaggagttcaacacccacgtgtgcagcatagtgagactccatctctaaaaataaaataaaataaaataaaataaaataaataaaataaagtaaagtaaattagaaccgagcatggtggcctgctcctgtagtcccagctactctggaggctgagaggggaggatttgcttgagcccaggagttcaaggctgcagtgagctatgattgcaccactgcactccagcctctagcctgggtgacagagcaagaccccagtcccccccaaaagagagagagagagagctaataaaaagtttagcaaggccgcagaatacaagatcaatatacaaagaaaatcaatggttacttctatacacttttaacgaacaattcaaaaatgaaattatgaaaacaattctgtgtacaagagcataaaaagaataaaatttacaaataaatttaacaaaagaagtgcgaaatgtatacactgaaaactgtaaaacatcattaaaaaaattaaagagcaaaataagtggaatgatattctgtgttcatggattggaaaacaacatcgttttaacatagcaacactctctggctgggcgcgggggctcacgcctgtaatcccagcactttgggaggctgagatgggcagatctcctgaggtcagaagttcgagaccagcctggcctacatggtgaaaccccgtctctactaaaaatacaaaaaaaattagccaggcatggtggcagacacctgcaatcccagctacttgggagactgaggcaggagaatcatttgaacccgggaggcagaggttgcagtgagccaagatcatgccactgcactccagcctgggtgacaacagtgaaactccatctcaaaaaaaaaaaaaaaaaaaaaaaacccatgtgcatcaaaagacactatcaaagagtgaaaagataatccacagaatgggagaaaatatttacaaatcatatatctgataaggatctaatatccagaatacataaagaacccttacagctcaacaattaaaagatgaattatccaattaaaaaaagaacagaagtttcgaatgaacatttttccaaataagatatataaataataaatacatgaaaagatgctcaatatcattggtcattagagcaatacaaatcaaaaccacaatgagatagcatttcacacacactagaatggctattttaaaaatcacacacaataacaagtgttgacaaggatggagagaaatttgaacttcacgcattgctggtgggaatgtaaaatggtgccgttgctttggaaaacagcttggcatttccttcaaaagttaaacatggagttatcatatggcccagcaattctactcctaggtatatactcaagacaattgaaaatccacatccacacaaaaacttgcacacagttgttcatagcagcattattcacaacagctaaaagtggaaacaacccaaatgtccatcgatagttaataaaatgtggtctatccatacaataaaatattcttcagctgtaaaaaggaatggagtactgatccatgctacaatatggatgaaccctgaaaacatcatagtaagagtaagccagacacaaaagcccatgtatggtatgattccatttatttgaaatattgaaataagcaaatccacaaagatagaaagtcaattagtggttgccaagcactggtgggggggggtgcggtgtgtaaatggggagctactgcaaatgtgtacaaggtttccttttggggtgatcaaaatgttctggaattagatggtggtgatggctgcaaaacactgtaaatatactaaacactgctgaattgtacgttttacagggtgaattttatggtatgtgaattgtatctcaataaaaacaaatttttaatttgaacggaaaaggattgaaaaaactataccagttaaatgttaaccaaaaaaagttatagttgctatgttaatatcagaccaagtagactataagggaaaatcattgctagtattaacatatatcactatattttgatcaaatattcaacttacctaaaatacataccaattctaaactcaaatacactgaataacataacttataaatacataaagcaataattgaaagaactacaaggagaaactggcaaaaagcagttgagcctctactcaggacatcatgtgaggaaagacttggttccctggggtgagggaaactgtggaaatctccacggggtgtgagggaggagctctggagagatgggcatgagcttttgttttttaaagaccagcatgatagtaagcatgggctttttctatttctcaaaagggggcagataatagggttgaaaaatattgaaaaattatcttaaagcaaaaatcagatcctgtcacttgttctgtttaaaacgtccgtggctcccagtgccctcttgagaaagttcactttccaggctgatctctacccacctcctctcacaacctccctcaaccagacgggattctttgttatttctgaaacattccatacttcttatcttgcccacctggtgttggggctagtgatagggatccgtggatgaagctggggtggggtggagaacatggttgccacatgcccagacagtgcctggcaggaagaaacatgtggcttatagtgccaactcagccaccgcctggccagggggcccgacttggtcacttcgtctcttcaacagacctgttgctctcccgggttccctggcagcatcctcaactccctcacaacccccccaccacccccattgagtcgatgaccaagctccatctttccagtagtcccacatctcttgccttgttctccacatggttcaggcttgtctcccagccaccagccctgccctgccccacttccaggccatcgctcacaccgaactccaaagggatctttgtagggcccagctcccatgccccatttccaccactgtgcaaagacctccctggttcccacttaacaggacataaaattgaggcacagaggagcttaaaggcaacacaagccaggtggcatggtggctcacacctgtagtcctagctactcgggaggttggggatgacttgagcccaggagttctgggctgtagtgtgctatgtccatcaggtgtccgtactaagttcagcatcaatattctgggagcagaggaccactaggttgcctgcggaggggtgaaacagcccaggtcggaaacggagtaggtcaaaactcgtgtgctgatcagtagtaggatcacacttgtgaagtgaatagccactgcactccagcctgggcaacacagtgagacctcatctcgtaaaaaaaaaaaaaaaaatggcaacacaaaccatctgcaagaccccaactcaaatccagcgtgggttcccccagcccagggttctctttccttcagacacacagagtttgcattcacaaagagaagtggggaaagaatgccgccttgttttcttcaattccccacacaatcatgtcccaagcaagacctcgcttgcatggatgcaagcaagaggatgcagtggcagagtgtgggttcaaatcctcactgtgccacaagctgtatggctttggctcacttagcctctgtatgcctcagtttctccatatgtgaagtggggatgatgatcatgatagcagctatctcacaggtgaggttcaagttaatacatggaaagctcttcaataaagagtcgttactagcatgctttttttttttttttttttttgtaaaggtgggttctcgccatcttacccaggctagtctcgaactcctgggctcgagggatcagtgttctttttattaaaaggaataagccttccagaaataccagatacaatgctagatacatatttgcaaagagaagggtgaaaagtaagtctactttcatgcccgtcaggcacctcgaactcaccacatccagaatcaatctcattactcctcccccaaagtaatgcccgttgaactcttcttgatgaatgttctgctgccagaaacatgatctacctggatccccccgcttcattccccacctgcaacccatcaccaagacctgtccacatgactcccaaagagctcctaggaccacctccgtgtctccctgtccctagggtggacccacaggttgagcttcccttgaaactccgctacccacaggtttgcttcaagatagagcacgtgacccaccctgtgtggcccagaacagcagagacagcttccttttgtgatgcccaccagggttcccctgaccctcaattctggtctggttccagacaccccaattcctagcagccggccccggctcagcacctaacccacactgggcaaggatgctctctggctacaaaccccttcgatggctccccactgctcctagactacagctccagctccttcccctgccaggcttggtctggcccgttcctcttgctgccagcctcagcaccagccctgagcctgagaagccctcacagtgtccagcacagctcccttgccatcacttcacacacacacaccaccttttgcctttggctaaaccagtcctttctctctcccaggctgccatcccactgcctaggtgacccaaactgccttcctcatatgcggtctcggagggatgaaggaggggtgccgcctctgcttgacctgggggttccccctctcgcccctatcacagatgggcaggacctctcccccaaggttggacttccccaaggcaggatttgcagggtgtggggtaggggcagtcgcggagaggaatggatttgagaggctgcccagggtgctgaaggaactagggaggctaatggacgtctaaagatggggccgtggctccccctgctgacgggaggccatattgcaccctgtgtcaaggcagcccagagctggcttaagctccaagccgaagcgatctggccacgtgcctggactggaagagctggctgttctgagcgagtgccggtttcttctgtaaggctggctctggcactcctgctcattgctcccagacccacaaagatcatttttatcatccccgtaaaaccacccctccaatagagggcgtcctcctggagggcaggcgcctcttctgataggcccaggtcagtgcccagcacctggcccagagtagaggctcagtcaacatctgaccaaaacaacagcaagtaggtatcgtgggagtccagtgtgaacaacagagaagatgggaaggggggcccacagcaggggtgcccacaggcaacaaggccccacgtaggggtgagggcaggtgggacaggtcttggaggcgaggaagccgtggtactggctgactgaggtcccctgtggggcccaaagcctggagcgaaggatggcctgggagcggctgtggggatggaggaggaggctgcccacccacctccagcctgctctccctggtggaagccaggtcccctggctccaaccctgaaccccactccagccttcacccacaagacccaggccagccttggtttgagcctcaccgcctccctttggggcccaaagttcaacaaggagagtgatcttctctaccattctcgccagtcaagccatgggtcatcaggcttacactctgagggctggcagggagcaagggtctcagagtggagggaggggtggccagcttgcctggaactctcgctggggccaagaagtggctctaggggtcttcccctgatgggcccaagagaaaggcctagaggggccagcagagctttgggacccagcaaggcagggctctggagccctggcccctccaaaatggaggttggtggggctggggccactcagaccagaggacaggccacggctctccacttcagaagccaccgccaagctgccactgctcccagagccccagctgccagcccaggtctaccccagcctggagcctgagggttccaaagcccccgcacagcagaggggaagagggccctgtgtcgccctctcctggacaaggagctcctctcaccccctgaccctggggtcccctactcttctgctcgacaagatggcctctggccatcaagaaagggaagggagggagggatggaaggtgacagtcctgggctctggtcgccctccatgcacctgtgagcccttcccagtcccaggcacctggctgaggcaccccaggcccggccctgcatggcaggggcactggagcacatccctgggggtctggagccagcactcagcctcctgactgcgccccctgctggcagcccagcaggcgtgcgctgcctccactttgtcccaggaccccaaggctgggcagttacacctctggggtggcagagctgcccggccacgctgccacttgttggtgctttggggggaggggacaggaagtttttggacagttggaaacttgtctggggaagcagaggttcaggtggcagtgggcgaagccgtgtggcaggctctcattggtttccttcccacaagtgaccaggtcccctccacactcgccgcacccccaggtcaccactggcccattgctgtatctttctttattggtttggggaaaactggagggggctggaaggccatgaccatgacacaagcaggaccacccacactcagcgaagcacacaacagccgtgcaggaaagacagcccctgaggcccgcctgccagcaccccctcggcttttggcggggcggggggggcaggggcgggagaggcaacaggggaggggagccactgcccccaggcagggcagagcctggggacagacttgggggtgccccattccaaccccagcgccatgcgccacaccctcaaatctcaaaatccagcagaggccagccccagggggaggggttgggggaggggaccgaaagcatccaagggaaggaaatctgggggtcagtccacttggcctcggcatctgcctgagagggagaagcagagggaaagggggtagtcaggagccggcctgccagccctgtgcccccaccccccgcctcggtcaaatcccggacttcttagaggccctctccccctgcacccccttgcccaatgtcaagcacccactggccctccctgtccttccacctctcctggggccctggctcctccctctgctctctgccttcagtcctctggcctgtgggggccaccccacttagctcttggccacatggagcgccaccaccctctaagctctccaaggagccagctcctgggcgtgcagggtccacccaaacacacctgggcatcaccacttggggggctggccagcacggaggcctgagtggctgtggcgggccatgccctgctcagaggccccctcgccctctgggatctgccccagcttccggatgtggcgcaggaacgaggtggcattgaaggctcgctgccagaagagagggagatcaggccaggcctgggcccaggccccagcccctagactgtgaggactgcagtggtcactgggcagccacggcgatcaggctacagctggggtgcggcgggcgaccacactgggtctctctccacactgaccttccagtgtgtccgagcaaagttcttccggatctgctcactgacagagcctaagatgtccctgtcgaaggctgtgtccccagagatcctggggaaaggctgaaggtcagggggggtctctctgcaaatgcaggccccctggccctggggcagctcagcagggctcccactcaccaaaggtgccgcaaggcctgttggcaggtgaacctcttctgggggtctcgctccagaaggtgccggatgaagtctttggctggaacagggaggctgggtcagcctgtcaggtccccactcccttgcatcacctccaagcacgggccagcctcaagctcacctgattctgagatgtcatcccagaaaggagagtcaaactcatagctggccctcaggatctggctgaagagctcagggtcgctctcgtcgtagaagggggggtacccacacagcctggcacccacagatgaatcatccagctgtcccaccctccccaacccagcaggggcaggcaggcaggagacaagccttcccagcggtcactcacaggatgtaggagatgacgcccagggcccacacatctacggccttcccgtagggtttctgctccaagagctctggggctgggggccagagacagacagacgcacgcacaggcacacacgcagccatgccgctcagtgtcactggctcggcctactcaagcccaggaatggcccacacaaaggcaacgggcacaacagccttcccggctgtctagggtcccccaggccaccccactcccagcaagcctcagggtgtcgtccctcacccacatatccaggggtcccacaggcggtgcctagcatgttcccagcctggattttggagagtccaaagtcagagaccatgatcttcgagtcctcaaagggcgtggcatacaggaggttttcgggctgtgacacacggacaccgggaaaagggccagtcagtcctgacgcggtgccggtgctgggacaggatggggactaggcactctcaggttccccagagccttggtggagcaggagatcaagaaaggccccagccgtgctcccgggaaaacaaaggcagggccaggtgggcaggtgggagggtggggtgcagaggccccagccaggcaccttgaggtcccggtgcacgatccccaggctgtgcaggtaggagacggcgccaaggacctgacccaccagatggctggcatccttctctgtgtaggagccgcgctccatgatgcggtcaaacagctcgccacccgtcaccctgggggtgccaggggtttggctgacccaggcactcagcctggccttcagccccactcactgctcagtccctccccggctcccacagcctgcccaggccctcctcacagttccatggccaggtagaggtgggaagggctctcgtggacatcctccagagcgacgatgttggggtgactgatcctgcaatggcaaggaagcgcctgtgggccaacagagtcaaggggtgctctgtcctgaggccctggggaaagcctcctccctcttctcttcctcccacctctgctccccattccctaccacatgccacccctgcccggtccaggaaggcagagctccagcctgagccccggccttccttctaaagcccatttgaaaagcacagatcaatatcaactcactccctttgccacagggatgtgcaggcccagagagagcactgccccaggcctcccaaaggttggtggccaggcctggactagagccaaggactgcttgcacccccccatcgacctatgccccgtcccagggccccgcgaggtgcgcacctacggagcactgcgatctcgttctccaccagggcctccttgccccggagggccttcttggggatgcacttgagggccacgaggtgtgcggagccccgctcctgggccagcaccacctcggagaaggcacccctgccgcagacggggcggtgggaggtgggaaggaagtgggaagagaggagaggcaggagggagagagagtggagcggggagggccccctgtgaaggagatggggaggccctacctggccctgtgccaccccccaccaccactcacacatgccatctcacagactcactcacattcacacacccctacatattcacacacacacacatcatctcacacccactcgcgtagtcacacacacatgccatctcacacaggtacacacacacacacacacacacacacacgatcacacacgcgcgcgcacactcacgagccgagcctctcgcggatctcgtagacgctgctgatgtcctccgtgtgtttcttcagcagcagcatgtctgcaggggcaggggagaggtgatgggggtctctccccgccccgccgggggcaagggcagcttcctcctccaccccctgccaggcaggcctcagccattgccgctgcgcgctcgaccctcccctcccccgtccaggtccacacccccagacggacgcctcccagcgaggccaccgcatacacgcctccacatcccaggcctacagctgctatcccacgcaccctcccccgcaccccgaaggcgaccagcgcctggatgctgcctctctgcctccacacatccggccgctttccagaaggctccatgctcacccacgccgtccctcccccatccacacatctacagcgcccaagcccccacccccgcctagacccgccacccatggcacagcgcccacaggcacccgctgcccaagccaccaagccgcccgggatgcacctgcgacccccgcgcgcagccacctgccaagaccgcggccacccacgcggccgcagacgcagcccagccctcggcgccgcggagcagggggacctggcagcctgggccgcccgcgtcccgagctgcgtggaccgagcgcgtgcgggcagggggcgcgccaggcgtgacaggtgtgctgcggacgcgcaaggctgcggcggccgcgggccggatccggtgcgcccccgccccgcgcgtccccgcgccccggagcaggtgcagacctggagcgggtgccgcagcgtcgtgccgcgcagtggccgcagcgccaagccccccgcccgcgccccgccggccccgccccctccgcgcacgcccccgccagccgcccaagcacgcagtggcccagcgcggccgcggcgccgcagggcaccttgtaaggcaatcgccgggatccggctcgggtgccggccgccaccgcccagcccactgctcgctcgcgccgcctcccggagctgcggcccggctgggccggccccagggcctttgcaccaccggtggctgtctcccggagagctcttcggccacaggtcggcaaggctctctgccttccagtctctgccttcaccgcctctccgaggacaggctgacccggccacttgcccgaaagcagcctccatgcctagctccaggaccctgcaaccctgcaccacagctctgccaccctgggctcccggcactcactgggctccctctggctccaccattaatccctcaccctcgctttcttctctacccagcagccagagcattccttttattgagatcatgtcaccctcctgcagctctctatgtcaatccaagtcaaagcatgagtccttagggggcggcctaacgactgccctggcccctcctcctccacctcttccccggccacactggcctcctgacggccctagcctttgctcccctgcctggaatgttcttcgatcagatatctgcctggcttggctcctcgttccatcagatctcggctcaaatgtcccctcctcaaaccggcctcccccgccctgcccctgccaattctctccgcataaccctgccctgtctttagaacgtccaaccgcaaaaatcaccttcttcgcctggtcttcctcaccaaagcgtccgctcccagagagtgtatctccgcgaacccaaccaagacgagcccaggaaataagtgcgggtgaccgaattcaatcctgcatccaacagttactggacccccctcgctgctcgccatccagtcccatgaggttgtggccagcatcacaagggttccgtcaagtgaccgtgggccctggcatgacacgacgtcttcaagagagtccacggggcaggaagagtttttaaaaaatcatttttccagacctcaactcccatatatactctgtgtaaaaactgggaaatctgagaaggcccctagcagctcttgccccctggcctttcccagtcacccctcccaggacactgcagaaggctccagggaccccagcactcagaaactccagtcccacctgctcctctatgtgaaaatggtttcctgggaccgacatctaaaacagaaaaaaataggaatggaactgatggtgagccccttctcatgacagcaggaagtgcaatttgtttacagatacctacagatagttccccagaatgtctaatacgccaatggtgctttgcccaagcagagttctacaacatggtcctgggttataaaaagaaatagaaatacacatatttctgtgccccagaaaagtaataaaaaactgcccgcgtggaaagagatggcacaaagagacctatctgaggggcagcagatggaaactggaggccagaaggaaagcacccacctccaaagtgggcctgggaaagacgagccagcgggcaggtattggtccacgaggtgactcaggtggccctggcctcatgtaaaagctgatggcacagtttttgtttgaatcattgtatcatggggttttttttggtttgttattgttgttgttgtttgagacagggtctcactgtcgcccaggctggagtgcagtagtgccatctcagctcactgcagcctctgcctcctgggttcaagcaattctcccgcctcagcctcgagtagctgggactacaggtgcatgccaccacaccaagctaatttttgtatttttagtagaggcagggttttaccatgttggccaggctggtctcgaactcctgacctcaggtgatctgcctgcctcagcatcccaaagtgctgggattacaggcgtgagccaccgcaccaggcctatattgtgtgtttacaagagaaattacaccctccggcctggcaaggtggcttatgcctgtaatcccagcacttcaggaggctgaggctggaggatcacttgagcccaggagttccagcctagcctgggcaacatagcttttcttttcttttttttcttttctttttttttttttttttttgagatggagtgtagaaagtaaaaagttcctcttcaaagtttcccttcttattaaaaaataaatcataagtttagaaataatagtttcttttaaagactaacttccttcaagcctccttgctttgtgctaataactctttgttaagccctatcctatgtagctgttaaacatgcttacaggcacgtagtacattctatgtccttgtactttaaccaagatatctgtgctggacgtgctcacaggcatgtcccagctcgcagcctatctccctttcctattggggaatattattacttttctaagccgtttcgtaagcaacttcctcttttcctttatccttccattacttttatctattttcaaaagttttaaactactagccaatcgggttttaggttagattgtgaggtctggctgcagccaatggaaacaggacacagtagcaaggacaaacggcataaggaataaaaattgcttccctcctttgtttggtgtactcatgtggcaaaactgctggcgagtgtaccctttccgcagaaagttaaaaaatggccttgctaaggagattaaacttatgccgggtgtggtggctcatgcctgtaatcctagcagtttgggaggccaaggtgggcaaatcacctgaggtcaggagttcgacaccagcctggccaacatggtgaaaccccgtctctactaaaaatgtaaaaattagccgggcatggtggctcacgcctgtaatcccaactacttgggagtctgaggcaggagaatagcttgaacctgggaggtggaggttgcagtgagccaagatcgtgccattgcaccccagcctggggcacaagagtgagacttcatctcaaaaaaaaaaaaaaagaaagaaagaaagaaaaagaaaattaaatttatgttcaagtgctatttctttgtgccaccggggaacaaacatttctaacatggagtctcagtcttgtcacccaggctggcaggcaattgtgtgatctccgctcactacgacctccgcctcctgggctcaagcgattctcccacttcagcctcccaagtagctgggactacaggcacccgccaccacgctgggctaatttttgtatttttgggtagagacagtttcaccatgttggcaggctgatctcgaactcctgacctcagatgatccaccctcctcggcctcccaaagtgctgggattacaggcgtgagccaccgcgcccagccacctgtgtccttttgatgtccgttcatcactgcatgtgtgtgtgcatgcccgtgtaggtgtgggcgtgtctgtctctgtgagcccttccttactttctggctctgtgctcatcccttatatttcctgaaccggtcctagaagcagccgttttctctaaggagccatttttgagagaatggtgttggagacgaagatctgggcgctaggtgtgcccattgttcctggagtattgctgcttctaggccctctccactgacagcaagaacttatagtgtgtgtgtgtatatacatatatatacatagtgtgtatatatatatagtgtgtatatatagtgtgtatatatagtgtatatatatatatagtgtgtatatatatagtgtatatatatagtgtgtatatatatagtgtatatatatagtgtgtatatatatatagtgtgtatatatagtgtatatatagtgtgtgtatatatatagtgcatatatatagtgtatatatagtgtgtatatatagtgtgtatatatagtgtgtatatatatagtgtgtatatagtgtgtgtatatatagtgtgtatgtatatatatagtgtatatagtgtatatatagtctgtatatagtgtgtatatatacactaacccatgtacatatagatagatatgtagtatatatagtgtatatatatacactaacccatgtacatatagatagatagatatacaagcccatataatacccatttaatatatataccaacccatgttatgttactaacataacatctataaacagatacacacgcgcatcagtatctatattaaactcaacaggagtgcacactgatgtctccaactctaatccatcaccacctgggtcattctagctgcctgcccttgcttgtctataacctcccactctaaaagtgagaaacccaggccaggcacggtggctcatgcctgtaaccccagcactttgggaggctgaggcagatggatcatctgagatctggagttcaagacaagcgtggccaacatggtgaaaccccaaatctaccagaaatatgaaaaattagccaggcatggtggtgcatgcctgtggtcccacctactcgggaggctgagttaggaggatctcttgagcctaggaggtcaaggctacagtgagccatgattgtgccactgcactccagcctgggccacacagcaagatcctgtctctaaaaataaaattaaaaattaaaattaaagtgagaaacctggctcccaccgtcttccatccattgccgtagttcttgaattccggtataaaggtggagaggttgcagaatcattcacctctaccctggtggggggtgatcttatcaattagagtgcggcgcttatgtgttcttccttttgctcttagtctgacagatgcctattttaagttccctctgtctgctgtaaagttctatgggttttgacatattcagagtgtcacgtgtccaccattacagcatcatacagaacagtttccctgtgctacagaatccctgtgctgcgcctaccaagcacgatcccctctctcagacccctggcaaccatggatccgttttctgtctttttttttttttttttaatctattttgctttttccggaatgtcaggtaaatggagtcatagagtaggtagctttgtcaggctttttactatgcaatatgtatttaagattaacttatttctttgcatgggttcatagctttcccctctttatcactgactagtattccattgtccagatataccacattttatttgttcacctactgaggaacatcttaattgcttccagtttttgccaattacgaataaagctgctaatactatcgcactggtctttaaggaaaaaaaggctgctataaatatatgtggggtggtttttgtgtggacataagttttcaaatcatttgggtaaataccaaggagtgtgattgctgaattgtatggtaagagtatacttagcttcggaaggaactgccaaccgcttttcagggtggctgtacctcgtcacattctcaccagcaatgagtgggagttcttgctgctccaggtcctcgccagcattaggagttgtcagtgttttggattttggctatctagtaggtatgcagcggtatctccttgtggttttaatttgcaattccctaaagatgtatgctgttaaacatcttctgatatgcttatttgccatttgtatttcttctttggagaggcatctgttcagatcttttgcccatttttaaattgggttgttttcttattgagttgggatttttcttttcttttcttttctttttttttttttttttttttttgagacacagtcttattctgttgcccaggctggagtgcagtggtgcaatctcagctcactgcaacctctgcctcctgagttcaagcgattctcctgcctcagcctcccgagtagctgggattacaggcacccgtcaccatgcccagctaatttttgtatttttagtagaggcagggtttcaccatgttggccaggctggtctcgaactcctgacctcaggtgatccacctgcctcggcctcccaaagtgctgggattacaggcatgagccaccgcaccttgccaagaccccatcttcttcaaaaaatttacaaattagccgggtgtggtggtgtgtacccatagtctcagttacttgggaggctgaggcagcaggatcacttgagtccaggagttggaggctgcagtgagccatgatcatgccactgcactccaccctggcaaccagagagtgatagcacaactcaaaaagaaaagagaaaagaaattacaccctttgcaactgtgtaaacatctgctgaaatcctgtacgtgtcaactttgaaatgtatgtgtgttggttgggtggtggtgatgtgatacggtttggatgtctgtcccctccaaatctcatgttgaactataatccccaatgttcaaggtggcgtctaatggtacgtttttgggtcatggcggtggatccctcatgaatggcgtggtgccgtcctcacaataatgagtgagttcttgctctgagtccatacgagatctggttgtttgaaagagtctagcacctcctccaccctcactctcttgctcccattcttgccatggatatgccggctccctcttcaccttccaccatgaatggaagcttcctgagggtgtcactagaagcagatgctggcaccacacttcctgtatagtctccagaaccatgagccaaaataagccacttttctttataaattacccagcctcagattttttttttatagcaatgcaagaacgggctcacatatgacagataaagagctgtagtcccagctacttgggaggctgaggcaggagaatcacttgaacccgggaggtggaggttgcagtgagccaagattgtgccactgcactccagcctgggcaacagagtgagactctgtctcaaaaaaaaacctagccttcagggctgggcgcggtggctcatgcctgtaatcccagcactttgggaggccgaggagggtggatcatctgaggtcaagagttcgagatcagcctggccaacatggtgaaactgtctctaccaaaaaatacaaaaattagccgggcgtggtggtgggtgcctgtagtcccagctacttggggggctgaagtgggagaattgctttagcccaggaggcggaggttgcagtgagcggagatcacacaactgtccgcccgcctgggcaacagagtgagaacctgtctcaaaaaaaaaaaaaaaaaaaaaaggacaaaggacacaggagccaaccgaaagagagtccaatggtccaagatggaaaatttgagcaagaaaataaagagttgtgttagattaaaaccaaatataaggtacacatctatgagtccataccgttataaataaatgattacataaataaatgtgggagaacagacaacactcctgcacagaacaaaacattacttgtgtagatactgcccctccaggaggtggccccgctccctaactgggcctcacggagcggcttccttcccaagagcacggtatggaaagggggaacagtcacttcccagtggagagacccgacaaacaggaccccagccggtcgttccaggtctacatggcccccgatgaggcgcttcacccccgtggtcttcctcctgatcacccctgaggcccacctgatcatgggaaacagcaaaagtttcccaacagaggttgttttacaacacactgcccagtcctcctcgaagctgttagggccaccaagaacaaggagtctgagaaactgtcacagccaagaggagcctcaggagacaggatgactaaatgcaacatgtgatcctgacagaaaaaggacattagggaaaagccaagaaaacctgaataaactatgggctttagatactaacagtgttgattcattgtttgcaataactgatgttgattcattaattgcaataaatgagctgtcctaacataagaggctaataaggcgggagatgggggtgggctgtatgggaattcttggtaccctctttacagtttttctgtacatctaaaactagtctagaaggtgagggttgaaaaattacctattgggtacaacgttcactattcaggttgtaaccacctaatgggttcattttgctcactgcccagatagatagagccaatttatcaagacaggggaattacaataaagttttgttttgtttgtttgagacagagtcttgctctgtcacccaggctggagtgcagtggcgcgatctcagctcactgcaacctccgcctcctgggttcaaacaattctccagccccagcctcccgagtaactgggactacaggcacgcaccaccgtgtctggctaatttttgtatttttagtagggacagggtttcaccatgttggccaggctggtctctaactcctgacctcaggtgatctgcctgcctcggcctcacaaagtgctgggattacaggtgtgggccaccgcaccggcctgttttgttttgaggcagggtgtcgcactgtctctcaggctggagtgcagtggtacaatcacggctcacggcacccttgacctcttgagctcaagtgatcctcttgcctcagcctccccatagctgggagcacaggtgcgtgtcaccgccccagctaatttttaaattttttgtagagacaaggtttcgctatgttgcccaggctggtctcgaacccctgggatcaagtgatctgtgtcaggcctctgagcccaagctaagccatcatatcccctgtgacctgcacatatacatccagatggcctgaagcaactgaagatccacaaaagaagtgaaaatagccttaactgatgacattccaccattgtgatttgtttctgccccaccctaactgatgtactttgtaatctcccccacccttaagaaagttctttgtaatctccctcacccttgagaaggttctttgtaatttgtaattctccccacccttgagaatgtactttgtgagatccacctcctgcccacaaaacattgctcctaactccagcgcctatcccaaaacctataagaactaatgataatcccatcaccctttgctgactctcttttcggactcagcctgcctgcacccaggtaaaataaacagccttgttgctcacacagagcctgtttggtagtctcttcacatggacgtgtgagacaatctgcccacctggtcctcccaaagtgctgggattacaggtgtgagtcaccaggcccagccgagaaagagttgaatacacgtagaggagactggagttttattattactcaaatcagctgccctgaaaatttgaaggctgggatttatttatttattttttatttttttgagatggagtctcgctctgtcgcccaggctggagtgcagtggcatgagctaggctcactgcaagctccgcctcccaggttcaagcgattctcctgcctcagcctcctgagtagctgggattacaggcccgtgccaccacacctggttaattttttgtatttttagtagagacggggcttcaccatgttagcctggatggtcttgatctcctgacctcgtgatccacccatgttggcctcccaaagtgttgagattacaggcatgagccaccgtgcccagccctgaaggctaggttttttttttgagacagagtctcactctgttgcccaggctggagtgcagtggcacaatcttggctcactgcaacctccacctcccgggttcaagcgatttccggctaacttttgtatttttagtagagacaggggtttcaccatgttggccaggctgctcttgaactcctgacctcaagtgacccacccgcctgggcctcccaaagtgctaggattacaggtgtgagccaccgcacccagcccgaaagctaggattttttaaagatagtttggcggacagggggctagggaatgggtgctgctgactggttgggtgggggatgattcttgtgtgctgagctgagtctgcttttaggtagggccacaggaccttgagtcataggtctatgtggtccgggtggagccatctggtagtgagaaatgcaaaaacctgcaaagacgtctcaaaaagccaaccttaggttctacaatagtgacattatctacaggagtaattggagaagttacaaatctcttgagctctgaacaatggctggtcatcatgaatgcttccatgttagcagaattcaggcccctctcatcctcctcacctgatggcctttcattacttttacaaaggcggtttcatcttgggaaggtctgttatcatttaaactataaacgaaatttctcccaaagttagcttggcccatgcccaggaaagaccaaaaacagtttggagggtaaatgcagacagggttggttagatcagctctctcactggcagaattttgttactgttacagtttttgcaaggcagctttagggtgatgggtctgcacggaatatatgcatgtaacagaaccgcgcttgtaccctctcaatctataaaacaaataaaaccagcctaataaaagtttacataaaatgtaaaaaacaaagcaaagcctcctttctgcgggtctgtgtaaacgagcacagctggtgggaagggcgcgggtggggggttctgctgccccccatccctgccctgctgcaggccctcgcccccagccccattctttctgttctccgcttggctgcagccgcacgtcggccccctccccaggagctggaagtacaaagcccttccaggtggactctggctccccctttgttcccagcttattctaattccaaagctcattgtgcccggctcgccttcagaagaggaggcgcccccatcctgtctccagctgcccatcctcccaggataaccagtcaccccagggcccggtggcccctcacccagcccctccccggtccgcagctgccctaggcttgagtgggcgctggctccaattctcaggcctcccccaacaaacaggagcattccggctagcccccctcccctgccctccccccagctccccttctcctcccctctccctcctcctcagctcctactccaaccccccagccccagctggggcctgaaaggctgcccactccctgggacacggtaaggggagggtgcagctctccccccgcccctccccggtcgcctctgccccagagaacagtttgcttctcacccagaagccaccataggagctctgggctgggcacaggtcgcagggcacccccaccccctcctgcacatgctcggaaccccccttcagtgagtagaacacaagggcctggcaagacaggcggaggcttggaaagggctggcgggggacagctacccggccctcagctgggggcctggagagcccaccctgcccctccccagcagctgctgcccccgggccgagcctgacgcgccttgacaaagcccgagaacgctttgaagccttcggacgtgggagaggacccagccagggatggaaatcgctttgcctttgttcccccaactgctcagcagctcgtgggagcagcctcagaagaccctgtcactggccgcccgggtcagagcctgtgacagagaccagagctccggccggagctccccgccggaaactccagccttaccagcctgaacttcatgcactgctcaaagaggcccagctcgccctggctgggcaggggcggctcccagggtggccgacgtggggagggttcctgaacctccctcaggagcctcctgggacagagtcctggaggtcagcagagaaagggaagcccaggctgtgggccccgcgtggagggaaaactcagggggaacgccccgaggctgggagggcacagccccatcacactccatctcgtagtcttggagaaaaatttagttctacctccagggcacagaaaagcccaaagaagggatgagataaaggaggggctggtcagatttgtgcttcaggagggtccctctggctgctcagagaatgcagtttggggtctggcccaggccgtgaggaggagttcacagtcactatggggtccagaccagctgggggcgggaggcagggcctggcccaggggctggtagtgggtgcaccccaggctgggctggcaaagggcggggaagaaggtgggtgtgggaaggggtggctgcctggagaagagcccagttccaggaggtcgtgggagtcaggtatgggggcccactggacctcccctcagatgtgggggctcccactccgagggtccatggagcagtggcagccattctggacagccccccacccttcacttctgtctccagtaccctccagcctggccacctcgccctctgcctcggcctcctctgatctcacaaaggcagcagcagtcaggggtggcgactccctcatgatcctgtccctggcctcggaacccaccggaggagtaaccgcagcagtggtcacttccccaaagtgccatcagctctcctacatccttctcgagcctctgctttctctcccttccacccccacccctttgacaagcaacatctgaaagtctcccctgcccgcggctcccagagctgtctggccgtggcctgcactctccctcaaagcggccctcccccaggtcaccgtcctcccttcgatgacatcacgcgcccaccccgcactcctgctgggctgaggccctccgagcctacttcaccgggtcctcttctttctctcaaaggcaatggggtttgcctgtggtccagctgggttggccctcttccctctgtcctgggtccttgagtggccccgcttctttaggccatctatgagtcacttctctaatgcccctgtctccagaccagcttcagtcaaaggctgggccagagaagaccctagtgagaaacttctgatgagcagtgtgaccttgccacctcaggggtacccacccaccacccctggtctaagcacaggtgacaccgcctgtctcccccaaccacacacaccccttgaggctcctcctccaagcctgggtggggacactgtccctccctcacccagcaagctcaatctggcttgggccggaactgcttttcttcctaaagctggacggatggccgcgggcttagcttaacgggatgagccatctggggactgcagtgtccacgatcagatcagggagcttgaagctgaggggggcacactttacctcccaggccaggacaatgaccacttccttccccaccccacccccaggctactcttagccctagaaaattctaaacaagctgctcagctggcggcggagaggcagcccaacaagctggctcttgctagggaggcctggggggtcctggggagaggaacacggggtgggtggggggcgggcagccaggacctcaggcctgaggcctttggggaagggtctgtgcacctgccaggcaccagggggcagccttgccttgttcccgctccagtcccctcaagtccgaagcccctacccactctcacgccaggcaggggtgggggccgccggggtcatttacccgggccccttctctgccttgatgacaaagtcgaggcttgctcatcagccaggcaggctcccctctgcccactgtggagacacagaggcctgtcacctgaagagctggtcccggcctccagcttccagggtagccgggaagctgtagcccccagtgggcagcggtggagagagctcaaggaaggagggagcaccgggaggagacggctgcagcctgccaggagcggggagaaagggagagaaggggaggcggagggctgagggggcccgggggacgtcttcccagggctgggaggggccggccgggaagcctgggctgcactaggagccggcgaccctggggcgaggggcggcccggagccctgcgggaggagctggcggccgccccaggtagcaaccatcctgcctcccgctggagcggcgtctcctccccgggaggagggcagggaggaggtgggcggagtgtgacgaggagggcgggagggagggatgcgggagggggagggggaggggggccggccggccgtgggggtggggcgatagtgacatcaccccggagtcggtttttaagcggcggccggccggggacggggaagagagggatagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccgaggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgagttcccccgcccgccgcggcctcctcccccagcaggccgccggcccccgcccgacccccggagccgccgcggaggggtgaagtccgggcaacgggtggcccccgggcacgcgggggtcggggccgcccctcgtccgccgctgccgctcggtggccgggccgggcgcctccacccccctcgcagtcatgtgcctggcatggtggggggagggggccggcgatgcccgcgaggctgccccccagactcccgggctgggaggagcgattggccgccgaggtgggaaagcaggcctgcgccttggggtctccgcgaggtaaggagccctggctgcccccacgggtcgggcacacaagcggcacattgtgtgggccccccacgtgtgcacacacacgaacacacacacacacaatgggccactctgtccctccccctgccctcccctcccctcgcggccctcccgcccctcccctctggcccgggcctggaacactgggtgcccgagccaggcttgggaagcctgcggcctggcccgcctggcgccgccactggacacactgcatgcacgtcccatgcccgcccgcccgcccgcccgcccgggcccagcttagcaacagcgatgggcacgcgtgtgtcctgtgactacaaaacagcactggggttgctggaagccgaagtgacccggtgatgggtgggaaacagaggtccagagcaaaggcctttgcccaaggtcaggagaaggatgctgggacctggagtcaggcaagttgcagccaagctcagcctctgagtagtggagcgagcccagccagggcaagggtaggaggcccagagaggagaagggggtagtggcacccagctctccctgcccttctgccacccccaccccagcctgctggcctcaggagataggcctgtgtcacgccctgcctatctcctgcagagcctgactccctggccttgctaaggccggcctggcccctcttccgcacctgtatccctctgtccttgcacatcgccatcccaccagcaggggactgtgacccacccaccctctgccttagacctcacacttgcaggcaagcgtccaagggcaggacagtcgcgctccctgcctttggatgagccccccaggcctgatcacccagccttggcacacatgcacacatgcacgtgccctcactgtgctgcctgaaacagggaattgcagcactagggacagcccgcgtgtctgagcgtgtgtgtcctccatggccatcgccccaagtgaccgtgggggtggaagccctgggggcctagggcccctctgccacccagggaatagggctccaatggctcaggggctactgtagcccctcttcaacacactcaacccaccccctcaagactccacctggggcctgagtcagtggccacccctacactgactcacccagtcggaagttgtgatggggcctttggagtctgggctggcccgctgggcctgggcagcctggctgggggccaccctgagtccacgctgtgcctccacccccaggtgtgttccttattccctacgtcctgatcgccctggttggaggaatccccattttcttcttagagatctcgctgggccagttcatgaaggccggcagcatcaatgtctggaacatctgtcccctgttcaaaggtgagcagcccttggccagcctcagggactgcccccttctcccagctggctcccacttgagaaatcttttcctgtcgtgagcaccaggcctggggccacgtgatggcgtcccagtctcgaggggggagcctggaggagatgttcaggccgcacagcgaacttggggaagcggggactagagggggcataggcagctccacaaggcaaggacaggccaggcatagccgggctggggacgggacctgcccagcagcacccttggctctctaggtaggtcctactgttactatccccaaggacgctggggcacagacaggtggagcgacgtactgaggttgcccactgcaggggcgactgtctccaacactacctcaggcgactagaaaccccccccccccaccaccaccatcaacaccagctgctgaggactggaggctactgggtggccaggcagaggcttggacctcctggaaccgccatggtggcagtgggacccacagaaggggccaggtgtatgaggctggagactccacagcacttggtcagatggggacaggaggagaggggctcgctctgccttgggtctagggggcggctggaggagaggagacaggctggggagtcagcgcagtgttggggctcacacaagggggagcccaggggagtcaggagcaccacaaacaaggctccaggaggacagatggtgggagcacggccagcctgggtggggacataaaggggtggcagggggaggtggccagggaagaatctacatggcaaggacttcccggccccaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagtgagtccggcacctctgggccaagcccatcccatcccccaggtctccctcatgttgcccggctccaggggagtggccctgagggggcaccagggtgttgcctggcagtccatcctggaccctgcctgcccttgcctgtcctcggagagtcctggggccagcctcgctcctgggttcggcagccgatcactgtcctggtcactcccccctgatgggggagctggggctgcatgtgaggtgggatgggagtggcctcccaatggccaggggatcgtgggctccaggcccagcccaattggacaagagggacccgctgaaccctgggctgtgggagagaagggagccacaactcctgggggtggaccctgtggctccatcctctgctggcacaggcctcatgggacctccctccctcccctaggaacaaagtcttgaggctgtctgggggactggaggtgccaggggccctcaactgggaggtgaccctttgtctgctggcctgctgggtgctggtctacttctgtgtctggaagggggtcaaatccacgggaaaggtaccactagaggcatgcagcggggagggtggctcagccctgggagccggatgtctgtgccaggcacacctgtggcaacgggaggtgaccagacagagtctagccctaaggaagggggaggtactgaaagccaagcaatgctccccaccctgcaaatccagggcccagcagcctttgctcctggggatagaggccctggcaggcactgtcccttccctgtgcccatcacccccactggtgccctcctgccagtctctgactcttgtgacagtctggtggacctggtctggccatctgttacctatcttgccttggggacccagagcagagtctggccacatcccttgggggctcctggtcaggctggggagtcacctgaacaaagaagacagtgtctagagctgtgggacatggccagctccctgggggacaaggtccccagagcagcatgtgggaagagggggcagacagtgtggcagctgcatctcgcctgcctctgcctggcccagttccactctccacctgctcaacccccacctctctccagaagaggagggggacccgacccggatccaatatcccgctccctgcctgggcctcccacacctgcactgcccacacactcatacagctctcactccccacgtgctccacgcctcctgtccccactgaggagagctcccagaggctcgcctgctccccaccgacacgcgtccctgcagacaaacgaggcgcccagggagcttccccactgcacttggccagggctgccggggcgcagccttgcccctagcttcctctggcgggagccatggctcggaggacaatggggacctctgaacatacctgcccgcaagggggaccggaggcgctgggagtgggggtgtgagggaggtggtgccacagcctccgctgagcagcctggccccccagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgaggtggaggtggagaggctgcagcagggcgctgcgggggagccctgcaggcccctcatgcctgcgctctccggcccttctctaggtgtggatagatgcggggacccagattttcttttcttacgccattggcctgggggccctcacagccctgggcagctacaaccgcttcaacaacaactgctacaagtaagcaccgccgccctgccacccgtgccctgtcctgccctgccccgccctgcccagcagcctaacccatccactctggcccctccacccctcagggacgccatcatcctggctctcatcaacagtgggaccagcttctttgctggcttcgtggtcttctccatcctgggcttcatggctgcagagcagggcgtgcacatctccaaggtggcagagtcaggtagggccctacccccagccccgcctccagagcagcgagtgctacccagatgcatgatgtacaggaacatgcaatagaaatgctgaaaagtgacgaggattcaaacggaacttgtcagattgtgggcctgtgggggcaggtcctgggatttgtcaatgttgacagagaaaggacctcccagcccctgccgcacgacccagggttgacagcgcctctgaggcaggcgtgggcatgggcgcgagtgttgcaggcagggctcagggtgcgcacagggcaggacatcggctacaaggtctagagcctgcacctttcccacagggccgggcctggccttcatcgcctacccgcgggctgtcacgctgatgccagtggccccactctgggctgccctgttcttcttcatgctgttgctgcttggtctcgacagccaggtttgcatggggctctgggacagggagccaggaggggggcggagggagggctgcaggcaaggaaaggggtggagggcggtgcggggctcggcctgagctgccctggccacagtttgtaggtgtggagggcttcatcaccggcctcctcgacctcctcccggcctcctactacttccgtttccaaagggagatctctgtggccctctgttgtgccctctgctttgtcatcgatctctccatggtgactgatgtgagtggggtggggggtctgcctgtgacctctggtggccgtctgccatcctccctgactgggctctgtcccccagggcgggatgtacgtcttccagctgtttgactactactcggccagcggcaccaccctgctctggcaggccttttgggagtgcgtggtggtggcctgggtgtacggtaggtcatggctgagggctgggctgggggatggtggcggggaaggcaggtctccagcttggccctcccgcctcacctcgccgcaggagctgaccgcttcatggacgacattgcctgtatgatcgggtaccgaccttgcccctggatgaaatggtgctggtccttcttcaccccgctggtctgcatggtaagggctgggggaggtggggcagggcggggggcgaggcagggcggggtaggggccccattaaccgcagcattctggtccgtagggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgaggtaaggctcccgcccggcccgccctcccctcccctgctgtgaacattcaacccagcctgcttcctagccagggagtggccccgactagggtggcaggcagtgggaaccggagagaggcagaggaagtcaccgtggggacgagcaggtgaccctgggggcttcagcatgtcctcctctcctgcagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttcc

SEQ ID NO: 37456 - DNA, 8863 bp, Homo sapiens; identical to SEQ ID NO: 37138

SEQ ID NO: 37457 - DNA, 46791 bp, Homo sapiens; identical to SEQ ID NO: 36310

SEQ ID NO: 37458 - DNA, 102993 bp, Homo sapiens
aggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcgggtgagtccctctcgcctcatccccgcgccccccgcccccgcctcgggggccattgcgagcgggggcctttattagagactttgccccgccggggcctgcagggacaggggcctgggagccgcggcccgccgcgcgcggtgtggggccttggggggcgcccgtgccgcctccccctacccccacccccaccgcctcgccgggtctcgagccccgccggccttggcagtggccgaaacgaggcgatgggggtggggcggcacggacgcggtcgcgggggacgacagtggcacgcgcgcgcctcagtgcgcgtgggggaggggcgcgcgcgccgaccggcgtgcggtgggggggcgcctcgcgcgtgcgatcccgcgcgcgagcgagcgagcggccctgcgggctgcgcatgccccgccgcgctgattggccggctaggcggtgcgggggcgcgcgcggtgccaggcccgagccgtcgtggggtcgcgctcgcctggtgtatctggggctcctgcgccggggcagcagacgcgcgggattggccaaccggcgcgggggcggggccgcgcgttgcctggtaactgcggcgggcgggggagcgggagcgctgtcccccgccccgccccgctcccaggtggagtccgcagtgggctttgtcccgggccggcccggcgcgcctgccccgcggggcctgttctttgggggaaataaacacaatgaccggaaggaaaacttcagctttaggccatgaaaattaagccgtctgggttcagccagcacccagacgacgggagtgcagaggaagaaggaaaatgaaatggaaaaagctgtctccttcccgctccccgacttctccactttttcttaatccagcttttgctttttcgtgtagcgaattttgtcctccctaggttatggatttgcgctgatttgcggctggggatgttcacaggtggggtgctgttggagtagtgtccactcttggcgatgcgcagctcttgctgactgactactgacctcctttttttaaaaaaaattatttgtggagatgcgttctcactttgttgcccaggctggtcttgaactcctaggctcaagcgatcctcccaccttggccccccatagtgctgggattacaggtgtgagccatcgctttcggcttaattttcttttttttttttagaaacagggtctctctatgttgccctggctgaagcgcagagtggcacaatcatagcacattgcagcctccaacacctgggctccagcgatcctcctgcctcagcctcctcagtggctgggactacaggcgcatgccatcatgccctgctaatttttttttttttgagatggagtctcactctgtggcccaggctgaagtgcactggtgtgatctcggctcactgcaacctctgcctcccgggttcaagccgttctcctgcctcagcctcctgagtagctgggattacaggcgtgcccaccacgcccggctaatttttgtatttttagtagagatggcgtttcaccatgttggccaggctggtctccaactcttgaatcaagctgaaagcaatcggcccgcctcggcctgccaccaaagtgctgggattacaggcgtgagccaccgccctgggtcacgcctggctaatttaaaatttttttttagagatggggtcttcttgtgttgcctaggctggtcgggaactcctggactctggtgatcctcccgtttaggcctcccaaagtggtgggagtacaggcttgagccaccacgctgggcctcatctcttttaaattcaactttgccgcagacaatggcttgatcagccaacagtgcagaggagaagtctccagtccttcagggaacaaaaggggaagttagtttgcaaatgagaacgtgcaggtagagtgccctgcggaggcggggtcttctccccaggctgaggcctgtggtgtgggatgaccgattttatttcctgctacaggatttttctgtggctgctaccttggctttcgtttctcctcctccttgagatcttggtcttttggctggaatgacatttttcagcctatggaaatctttcttgctcatatgcagccacttccttaaggtcttctcttttttttttttttttgctgctgttgttgagagggtttcgttctatccccccaggctggagtgcagtggcgcgatcttcgctcactgcaacctccacctcccgggttcaagcgattttcctgcctcagtctcccccgagtagctgggattacaggcgcctgcccccaagccccgctaatatttgtatttttaatagagacggtgtttcgccatgtttgtcaggctggtcttgaactcctgacttcaggtgatccgcctgcctcggtctccgaaagtgctgggattacaggcgtgagccaccgctcccggcctgtggtcttctcttatattgcatagtcagagtttgttccttcttagtctcccaatcaacttgtgtgcccttcctcgcagggcacctttattttctctcttttttttccttttcctttttcttttcttttcttttttttttttttttcggaagcggagtttcgctctcgttgcccaggctggagtgcagtggcgcgatctcggctcactgcaacctccgcctcccgggttcaagcgattctcctgcttcagactcctgagtagctgggattacaggagcgctccaccacgcccggctaagggcacttttactttcctctgcatctggcctagtcactgggtgttgagctcgtaggggcagggacaagaagccttttcctcctatgtctttctccctccacttccccctccagtttggcatcgtcctcgtgccttgccggtggtagcaatgctgcttacatttgagtgtcttccgtgccccctccatggctcttgagcgctttggatgtacagtatttttcttatttaatctttgtgacaagtctgtaattctattctatagagcggaacaagtctagagaagttggagagttctgtactcttgcttgcctagcacatgaacctggccagtgtgactcaacccctaagccgaggttgtgaaaccaccgcgcctgggcgtccccgggagagctggcatgtgcggactctgcttgctgggccctacctcccaggctgattctgcaggtctggggagttgccccacaatttgcatttcgattagctccccaggtggtgttgatggtggctgcttcccggacagccctttgagaaccattcacaatggtgcaaaatgaagggagagaaatttattggagatatttgctttttcttactttaaaattagatcttggccgggtgcggtggctcacacctgtaatcccagcactttgggaggccgagggaggtggaacacctgaagtcaggagttggagaccagcctgccgacatggcgaaaccccgtctgtactaaaaatacaaaaattagccgggtgtggtggcgtgcgtacgtagtttcagctacttggggaggctgaggcagggggatctcttgaacccaggaggtggaggttgcagtgagatgagatctcaccactgcactccagcctgggcgacagagcgagactgtgtctcaaaaaaaataaaaataaaaataaaatagatgttaaagaatgaaaaataattcggacgactgacggtagattgctcagaaaactggctgagagttgagaattcctgttagccatgattagaaaagttaaaagtttcataagtctccagtttaaaaaggggccatggatttaagtgtggaataaaatgggaaatctttggaagtttggcttttttcccactctgatttatttattaatttagtcgcagcacgggcatttgttacattatcctcttcagatgcccaaagtctgccacaccaccacacagaaggtttgagtgataggaccacagcttgtagttttggcccttggaggtaggggggttggggagcattgtgtgctgagtctcctctgccacatgcccctccagcgattcagcttactcaaatatgactacagagactgacattaaaatgtaggctttgggggttctttttgcgggacagggttgggggcaattcttgctgagaaagatttttaggttttttctttctttttttttttttttttttgatggagtttcactctgtcgcccaggctggagtgcaatggcacaatcagctcactgcaacttacgcccccccagggtcaagtgattctcctgcctcagcctccggagtagctgggatcataggcatgcgccaccatgcctggctaactttgtatttttagtagagacggggtttctgcatgttggtcaggctggtctcgaactcctgacctcaggtgatccgcctgccttggcctccttaagtgctgggattacaggcgtgagccactgcacctggacccttttttttttttttttttttttttttttttttgagacacagtcttgctctatcgcccaggcgggagtgtaggtgcgtggtctcggctcactgctacctctgcctcctgggttgaagtgattctcctgactgagcctcctgagtagctgggattacaagcacgcaccaccacgcctggctaattttttgtatttttagtagacacggggtttcatcatgctggccaggcttgtctccaactcctgaccttgtgatctgcccgcctaggcctcccaaagtgttgggcttacaggcgccctgtgatttttaggtttttaaaattataatggatttctttccggggaaaataaccgcagataggtgggaggaatggttttagtttacagttgatgacccccctcctttccccacctacacccttaggcgagttgtacacactcctcaggggatcccaacttccatggccactgtcctatgttctggcattttcgatgacccataggtggacaggttgttatcatctaaaggagctgaacactgaacaattactaaacacttaaccttttctgttattactggttaccagctatttgcattgcatttcacctaattcatttctactgttgtttcattctttgttgatgacatgaatgttttatataaacatgagtttttgcaatatgcttcataactggggtggtataattaacacgaaattgttttaccactggcttaaatagatggatgtcaaatcatttttatgtcagtctaagggaaagtatttatttatttttttgagatggagtctcgctctgtggcccaggctggagtgcagtggtgccatctcagctctctgcaacctccgattcccgggctcaagcgattcttgtgccttagcctcacgagtagctgggattacaggcatgtgccaccatgcccagctaatttttttgtatttttcatagagatggggtttcaccatgttagccaggctggtggtctccaactcctgacctcaagtgatccacccacctcggcctccctaagtgctgagattacaggcgtgagccactgcgcctggttcgtttattgagtgaaggttattcattgttaataactgaaagaaagtagaaaatacacctaatcagttgcttattctaattgtagagttgagatacttgggaatcagtaggcttaagctggcagcatagctctatgaagactcatactcggttaactaaagtgtattggggctacctacctgggggagcaaaacgccttagtgtcttagaagatgtgtgtttttttattgcattttattttattattatttatttttgagacagagtctcgcttttgtcacccaggctggagtgcagtggcgtgatcttggctcactgcaaccttcgcctcctgggttcaagcgattctcctgcctcagtctcctaagtagctgggactataggcacccgccaccatgcccggctaattttgtatttttagtagagacggggtttcaccgtgttggccaggttggtctcaaactcctgacctcaggtgatctgcccgccttggcctccgaaagtgctgggccaccgcacccagccaaggatgtgtgtatcctgtaaaaattgtgtgggtacgtcatcggaagaggtgaaggtattgtcttgataattcttcattctccattcttgccctgtcgtcctttactgttgtccttttgttctggaactctccctgctgtcttcctgtttgttttctcctctgtaaaattcttgttttggtattccatgcctgtttctggcagtactcatttgctttttaccactttggcctactgagaaagtaagagaaagttcagtatagccaggaactgtcagagttgttggaggattgactcattctcctttggttgtaacttgtttctgtttttgtttttttgagaaggagtctccctctgtcgcacaggctaaagtgcaatggcgcgatctcggctcactgcaactctcgcctcccaggttcaagcgattctcctgcctcagtctcctgagtagctgggattacaggtgtgtgccaccatgcccggctaatttttgtatttttagtagatacaggtttcaccatgttggccaggctggtctcaaactgctgacctcaaatgatccacctgcctcagcctcccaaagtgctgggattacaggcatgagccaccacgcctggccaacactctatgtaggatttttaaagaactagttacttaaaaaatatatcatgagagggaagacaaatttataaattgagagagggtttatagcttatggctagcgacacaagtttgaagtctgactgcctggattccagtcctggcccttgccgtttcctgcctgtgcgaccttgggcatttcacttcatctttgtatgtttccctattttttgttttttttttttgagacagagttttgctcttgttgcccaggctggagtgtagtggcgcgcctggctcaccgcaatctccgcctactgggttcaagcgattttcctgcctcagcctcctgagtagctgggattacaggtatgtgccaccaccacgcctggctaattttgtatttttagtagagacggggtttctccattttggtcaggctggtctcgaactcctgacctcaggtgatccacccgcctcggcctcccaaagtgctgggattacaggtgtgagccaacagtgcccggcctattttttatttttatttttattttttgagacagtgtcttgctctgttacccaggctggaatgcagtggcatgatctcagctcactacaacccctgcctctcgggttcgagtgattcttgtgcctcagcctcccgagtagctggaattataggcatgcgccaccacacctggctaatttttgtatttttagcagagacagggtttcaccatgttggccaggctggtctccaactcttgacctcagatggtccgcccacctcagcctctcaaaggctgggattacaggcctgagccaccacgcctggcccctatttttaaaaatggagttgataatagaacatgtttcgcttctaagagctgttgcaaggatagagtttaagtgcttaggttgctgtctggcatgtagtagacactcaagaaatattagtcataaaagtactattataaagacttttgggaaattgaggaagcgaaaattttactagtaatatcgactatgacgttaatctccaagaactctggagaatatgaattgcaagggcaaggacttattcctctgtgggattttcccctgtgactgttacattgtttttatgttttgttttgttgagatggagtctccctctgtcacccaggctggagtgcagtggcgggatcccagctcattgcaaccttcacctctgcctcccgggttcaagtgattctcctgtcttagcttcccaagtagctgggactacaggcgtgcgccaccatgcccagctaatttttgtattttttagtagagaaggggttttactatatgttggccaggctggtctggaacccctgacctcaggtgatctgcccatctcagcctcccaaagtgctgggattacagacgtgatccaccgcgcctggccagagcttgacagttggattgatgaaacctgagaatgtatgctttatatgttgttcattttaatttgttatatctagaaatttagctcttactgttgactataacacatacatgacgtgagtagaattttatctagattgagttttcagaccgtaattggtttcaagaaaataaataaggtattggaagtgaactaaaattagtaactggctttggcattagactttaatgcacttaaattacatgatctcatctgtgagataatttgacagaggaggacgatggcatgtattatgtccatatgaggaaagggcagagaaatagaccctgcaagattcattagtgttactccttcctcctgttcgttttctttcttcgttttccccccctggtaagcattaaaaaaaattttttttggctgggtgtggtggctcactcctgtactcccagcactttgggaggccatgactcacttgaggtcaggagtttgagaccagcctggccaacatggtgaaaccccgtctctactaaaaatacaaaaaattggccgggcacggtggctcacacctgtaatcccagcactttgggagtccaaggcgggtggatcacgaggtcaggagatcgagaccatcatggctaacatggtgaaaccctgtctctactaaaaatacaaaaaaaaaaaaaaaaaattagccaggcgtgatggcgggtgcctgtagtcccagctactcaggaggctgaggcaggagaatggtgtgaaaccggcaggcggagcttgcagtgagctgagatcgcaccactgcactccagcctgggtgacagtgtgacactctgtctcaaaaaacaaaaacaaattagctaggcgtggtggtgcgcacctgtaatcccagacactcgggaggctgaggcaggagaatcacttgaaccctggagtcggaggttgcagtgagccaagatcacgccattccactccagcctgggccatagaacaagactatgtctcaaggaaaacaaacaaacaaaaaaacacatctctactgaaaatacagaagttagctgggagtggtgacaggtgcctgtaatgccagctgcttgagtggctgaggcatgagaatcacttgaacccgggaggtggaggttacagtgtaccgagatcttgccactgctctccagcctaggcgacagagcaagacaccatctcaaaaaaaagaaaatcctgtaagatgaatttgttcctttatgaagaataaatttgtgtctgccatttacaccgtgaatgcctttctttggagtggttccttgtagtgttttttgttgttgtcgttgttgttaaattgtggtaacatatacttaacacaaaaattaccattttaacctttttttgtggggggagggacgggatgtcactctgttgcccaggctggagtgcagtggtatgcttttggctcactgtaaccttcgtgtcctagggtcaagacatcctcccacctcagtctcccgagtagctgggactacaggtgcatgccaccacgtctggcttgatttttttattttttgtggagatgggggtctcactatgttgcccaggctggtctccaactcctgagctcaaacaatctgcctgcatctgcctcccaaagtgctgggattagagacatgagctaccacacccagcctgattttaccaaaagaaacttttttttttttttttgagacagagtcttgctttgttgtcaggctggagttcaggggcatgatctcggctcatggcaacctccatctcccgggttcaagtgattcttctgcctcagcctctcaagtagctgggactacaggtgcgcaccaccacgcccagctaatttttgtatttttagtagagatggggtttcaccatgttagccaggatggtctcaatctcctgacctcatgatccacttgcctcggcctcccaaagtgctgggattacaggcgtgagccaccgcgcccagtcttaaccatttttaagtgtatgtatagttcagtggtgcagaacttttttttttttttttttttttttgagacagggtcttgctctgttgcccaggctggaatgtaggatattatcaagttcatctgtgtgttagaatctccttcttatttaatccttcttgtggtttttggagtctttgttttgtagcatggcaaagcccattgtgtgtgtgtgtgtgtgtatgtaagaagtatatataattatattatggtgtacttggagaagtggagcatgatgaagagtttgatccataatataactggttatatagaaccctgtttagcagacagagcctaggaagttttctgattgtataggttctatgcttttgagaattcctgcttgtgttttgatctcatttccatacacagtccttaaagatcatatttatttatttatttatttatttatttatcgagatggagtctcactctgtcacccaggctggagtgcagtggcatgatcttggctcactgcaacctccacttcctgggttcaagcaattctcctgcctcagccccctgagtagctgggattacaggagccggccaccacgcctggctaatttttgtatttttagaaaagatggggtttcaccatgttggccaggctggtcttgaactcctgacctcgtgatccacctgccttggcctcccagagtgctgaaattacatatgtgagccaccgtgcctggctaagaagggatcgtttaaatttttaaaaataccttaatttatttttatagagacaggatctcgctgtgttgcccaggctggtctcaaactcctgggctcaagtgatcctcccacctcagtctcccaaagtgctgggattcaggtgtaagccaccacgcccggcccaaaagaagggatcttttatcatgtcgggaacagtaactattcatttattcaacatactgatgggctcatcctatgaggcctcagaacacagcatgtttcttggaaaatactggcatgggcaaatgacattgttgagagcttcaggataaagaatcttttagtttagtttgtatatccagactagtttagttttttttttttttttttttttgagacagtctcgctctgtctcccaggctggagtgcaatggcacaatctcagctcagtacaacctccacttcctgggttcaagcgattctggtgcctcagcctcctgagtagctgggattacaggcgtgcaccacaatgtctggctaatctttgtgttttttggtagagaacgaggtttcatcatgttggccaggctggtctcaaactcctgacctgaagtgatccgcccgcctaggcctcccaaactgttgggattacaggcgtgaaccatcgctcccagctggaaggtgactttttttttttttgagacagtgtctccctctgttgcccaggctggagtgcagtggcacgatctcggctcactgaaacctccgcctcctgttcaagctcttctcgtgcctcagcttcctgagtagctgggactacaggtgcacgccaccatgcccagcaatttttgtattattagtagagacggggtttcaccatattggccaggctggtctcaaattcctgactttgtgatccactcacttcgacctcccaaagtgcggggattacaggtgtgagccaccgtgtccggccaaggtgactttttaaagttaaattttaaaacgatctttgaggagtaaatttgacataagcaggtgttcatgcacaaatgccttaaaaggtacacatacttcatttcaaagcagttatttattttgacacttgtctcattaattttcctgctctctcagaaaataggttattttatttagccgtgataattaatgcagtttgttgggaaataagctattttcaatttaccaggcttggatttggtgagtttttatgtaaattaatagatatatgtacatatatttttaaaataactattttagtgaagtttaaattataaatgcttgctcattcactgaatgcttttgtgatgcactttattaagaattgacatgcattctgataacaactttgtaaggtaagtatgcagactgttgtcattttccagactagtaaatttgggattaaagaatcccagggtcacctgtaagatttgagacaggacttgaattcagaacttttgcctgattgcaaagctcaccttcctaatagctttgctctgttgcctgccttctgtgaacagtgcttttaaaaaagtaaagattgtcgggtgtgggtggctcacgcctgtaatcccagcactttgggaggccgaggtgggtggatcatctgaggtcaggagtttgagaccatcctggccaacatggtaaaaccccgtctctactaaaaatacaaaaaattagccaggtgtggtggcatctacctgtagtcccaggtactcgaggcaggagaattgcttgaacctgggagacggaggttgcagtgagctgagactacgccactgcattctagcctgaacgacagagtcagactctttctcaaaaaaaaacaaaaaaaaaacaaaaaaaaaaaacacctcaagaacaaagtaaagatggacctttagataatagctacttgattttcattttctcttccaaatggtttttccaaaatccaactgagttttaaatttggagtcatgtcaaagggacacattctttgtgtattggcagagtaagctgctgctgtttaaaaatctggactatcaatttaaaagtataattaatacatatgcaaaaatggtgtcttaaactgtggtgcaaggaaaataggtctttccgaatagctggtaagatttttccttgtttgttttttaaggatgttgttttggctactgtgaaactcagaactcagagctgaacttgtgatccactgattgggcagatccttttttttttttttttttttttttgagacagagtctcactctgttgcccagggtggagtgcagtggcgtgatctcagctcactgcaacctcagcctcctaggttcaagtgattctcttgcctcagcctcccgagtagctgagattacaggcgtgcaccaccacacccggctaatttttgtatttttggtagagacagaatttcaccatgatgtccaggctggtcttgaactcctgacctcaggtgatttgcccaccctggcctcccaaagtgctgggattataggcatgagccactgcacctggctagatcttttctttattattttgtcattctttccttcacctggcttttttaaaaagttaaatttagctattagctgtctgaagtgtcttgttttttttttttctttaatggggtcaccatactataaagctttaagtacgaatacaacacagttgtaaatcgtttcaaatcttaacccttcaaatttattttattttttcttgagggatatttgttatttattgatgtaagtgccagctttatttcagcagatagaaattaacaattttgtatcttaaaatgtcagcatacgcccctagaaaaatttcacagccggctggccatggtgtctcacgcctgtaatctgagtactttgaaaggccacggtgggaggactgcttgagcacgggagtttgacaccagcctgggcaacatagtgagaccctgtctctaccaaaaaatcaaaaaaattagccgggtgtggtggtgcattcctgtagtctcagctactaagaaggatgaggtgggaggattgcttgagcccaggaggttgaggctgcaatgagccatgtccctgccactgcattccagcctgggtgacagagcaagaccctgtctcaaaaaaaaaaattcaaacccttgatttaaaaatcaatcctgatcaaagatttggcctagggatttcttattttatttggaagtacttgccattcatatatatgtatgagttatatatattcatatatatatgagttaaaaattaaagtcaaatgaactaaaatgagttctttggctctatttcttgtctgctgaagtgtatatgttaatatacattaatataaatcgtgatagtttatatcctgttattaaatatttgtaaaacagaacctctggccgggcacgatggctctcgccagtaatcccagcacttcgggaggctgaggcgtgcagatattgcctgggctcaggagtttgagaccagcctgggcaacatggtgaaaccccgtctctactaaaattacaaaaattagccaggagtgatggtgcacccctgtaatcccagctactcgggagctgaggcagcagaatcacttggacccggaaagcagagtttccagtgagccaggatcgtgccactgtactccggcctgggcaacagagtgagactctgtctcaagaaaaacaaacaaacaaacaaaaaaaaacacagagcctgtgaattgctgacctaatttattttccttgggaaaatacctagtaagcctatggagataaactcttagaattgaagtattgttcattataagcaaggcatacagaagtcctgcctattccaggtctagtgtagtctctggagaacttatcttttctaagatactatgtacagtaaacaggaagctctctgttggaggatatgtcagagctggagattggactagaatactgaagacaatatcgacaacaatgacattttttgagagtttatgagtttactgttttgttttttttcttttgagacagagtctcattctgctgcccaggctggagtgcagtggcacgatctcggctcactgcaacctctgcctcctgggttcaagcgattctcctgcctcagcctccctagtagctgggactacaggcgcgtgccaccacgcccggctaattttttgtatttttagtaaagatggggtatcaccgtgttagccaggatggtctccatttcctgacctcatgatctgcccgccttggcctcccaaagtgctgggattacaggcccgagccactgccccgagctgagtttactgttttaagtgctacctgcattaacatctttaatcctcatagcaatcctgagatgtgaggtaggcactattatgatcccattttaaagttgagaaaaatgaggttaactaatctgaaaaatatagtaagggacagtgttaatataaaactaggcagccagacaactcctgctcttaactgctatgtggtttttggatttgtttgtttgtttgtttttgttttgtctgagatggagtttctctcttgttgcccaggctagagtgcaatggtgtgatctgacctcagctcactgcaacctctgcccctcaggttcaagcaattctcctgtctcagcctcccgagtagctggaattacaggcatgcgcagccatgcctggctaattttgtatttttagtagagacaaggtttctctgttagtcaggctggtctcgaactcctgacctcaggtgattgcctcacctcgccctcccaaagtgttgagattacagggatgagccaccacgcccggcctctttttttttttttttttttttgagaccagtcttgctctgtcgccaatctaaagtgcagtggtgtgatctcagctcactgcaacctccacctcccaggttcaagcgattctcccgcctcagcctcccgagtagctgggattacaggcacccaccaccacacccagctaatttttgtagttttagtagagacagggtttcaccgagttggccaggatggtctagatctcttgacctcgtgatctgcccacctcggcctcccaaagtgctgggattacaagcgtgagccaccgcgcctggcataaaactatttttaaaagaagaaaaatagctacaaaatttaaaaagcaggtaaaatgtacaactaatataaaccagctagtgatctatgactttttttttttttttttttaacagggtcttgttctgtctcccaagctggagtgcagtggtgtggtcataggtcactgcagcgtcgaactcctaggctcaagtgatcctcttgcctcaggctcctgagtagctgggacaacaggcgtgtaccacacctggatactttttaaatttttggtagagaagggatctcactctattgccaagctggtgtcgaactcttggtcttaagcagccctcccacgtcagcatcccaaagtgttgggatttcagaggtgagccacggcgcccagtctgagtcacttttaaacttagaaaatagttgcaagaacagcaaataaacaaaacttgctcacatatctttcacgtagagacttgcattcaagttctgcccatcgttttggtgatggatgtcctttattgcaagactgtaatccaggatcacatttccacccagtttccttgcctctctaatatacttttttgagatggagtttcgctcttgttgctcagactggagtgcagtcgtgcaatctcagctcactgtaacctctgcctcccggtttcaagcaattctcctgcctcagcctcccgggtagctgggattacaggcatgagccaccacgctcaactaattttgcattttttttttttttagtggagacggggtttctccatgttggtcaggctggtcttgaactcccaacctcaggtgatccgcccacctcggcctcccaaagtgctgggatgatgggcatgagccactatgcccagccctctaatatatatatatatatttttgagacggagtttcactctttcacccaggctggagtgcagtggcaccatctcagctcactgcaacttcttcctcctggttcaagcgattctcctgcctcagtctcccaagtagctgggattacaggcacctgccaccacacccagccaatttttgtatttttagtagagatggggttttgccatgttggccaggctggtgtcgaactcctgacctcaggtgatccacccacctcggcctcccaaagtgctgggattacaggtgtgagccatccatcccggcctaatatactttattttagaacagtttttcagtgttttgagtttcattcatgcccttgacctttttgaagactagaggcatttttatagactgtctcttaactcaggtttgtccagtgcttcctcatgcttatattgaggttaagcattttgagcaggaatatccatgttttccttgcattttgttgggtgggacgtggtgtttgtctgtctggagactagtgttaactttgatgacttggttacgatgggatgtgccatgttctccttttttttaaaagaatgaatatttttaaaagaagaaaagtagctatgaactagtattttgtggtacaatactttgggaaaatgaaaatatctccttttagtattgaggaatcctatttctttgagaggctgttttttttggggggggcagaaggtcagttcatagacttaaataccattatagttgttgtctaagcccttgaaaacttaatgtttttctaaagtttaaatttgtagataatggaatttgaaaaatatttaaaatcggattaaattttacagtgtatagtgtggtttgaaagagaatggggggctgggcgcagtggctcacacctgtaatcccagcacttgggaggccgaggtgggcagatcactagaggtcaggagttggagaccagcctagcaaacatggcaaaaccccgtctctactaaaaatacaaaaattagctgggcatggtgatgggcgcctatagtcccagctacgcaggaggctgaggcaggagaatcgcttgaacccgggaggcagaggttgcagtgagccaagatcatgccactgcactgcagcctgggtgacagagcaagactccatctaaaacaaacaaacaaacaaacaaaccaaataaaaagacagagaatggggaattgaggacatctagtcagttggatagatctggattctattcttagcaattctgtgatcttgggcaatttacattgtcttttaagttatcagctgttcttaggttataaaaagatccattttgtaaattgtgtcaagcagatgtcgaccatttataataaacttatcaagatatgaagttaatttctttgctgtcattcgaaagacaaactgatagggtcagcaaactaccttaaacatgttctcattaaaacaaaaattaaaaacacagctcctatagccagacgtggtggcagatgcctgtagtcccagctaattgggagactgaggtaggaggatcctttgagcccaggagtttgcagccatcttgggcaacatagtgagacccttatctgaaaaacaaacaaacaaacaaaccaaaaccctagcaaagcacattttctatagaagctactcagtggacataattaaaacaaatggtagtatcttgaaaaaattaagacatttagtgtgaaccacatgtctagaaaaaaaaattaaatagaaaacattaagatatttacaaagtctgtgtttacaatctgaactgattatattaaatgtatactgacattttagggatgaataaatttccttctgaaaaacagattttagttttggcttttagtacttaataattatagggagaacatggaaatattaaataccaacaatttggctgggcatgatggctcatgcctgtaatcccagcactttaggaggctgaggcgggcaaatcacttgaggtcaggagttcaagaccagcctggccaacatggggaaaccctgtctctactaaaaatacaaaaaaagctagctgggtgtggtgtcaggtgcctgtaatcccagctactccggagatccagccaggagaattgcttgaacccaagaggtggaggttgcagtgagccgagattacgcccctgcactccagcctgggcgacagagtgagactctgtctccaaaacaaaacaaaaacaaaacaaaaaaccgaaaaaaccccaacagtttcagagatgaaaagatttaggcggcctaaaagattgccaaaatgtagtattacatgataatctaaactagttttaatgcagctgaatcctggtttagactaaagtcagctgattgaactactagtattagatcttttggatttattttaagcactattttaggacaaaatatctaacattttacttgatgaattttaactttttcttaccactcattgttttgaagaaattactttgtaaaagtttgagatgtcactaatttttcccttggcattaagcgatacatgaattcattttattcttctgactgaggatgtttctgttagtgtatacattcaagaatatgatgatgccattagtcatttaattttgttgaaacttggctttagtggctgttaataaaatgaattggttggccaggtgtggcactttgggaggctgaggcgggcagatcacctgaggtcaggagttccaagaccagcctggccaacatgctgaaaccccatctctactaaaaaaaagaaaattagccgggcgtggtgacatacacctgtaatcctagctactcgggaggctgaggcaggagaattgcttgaacccaggaggcggaggttgcagtgagccaagatcacgccactgcactccagcctgggcgacagagtgagattctgtctcaaaaaaaaaaaaaaaaaaaaaaaagtaaatttgggttttacagtttttcctcttatacaaaagataactggagactagatctcaaagaatgaagacagctggaaagctggaagacaccagaaaaccaagaaagagagaacttccctgaaatactggccaaggcagaagtgcatccaccagtactgcagactcaccgctgtagtccattttttggaatagggggacaaaaacttaggtttggacggaaaatttctctggtaaaagtattatttctgtctgtctctctctctctctctttaatggacacgggcttactctgtcacccaggctggagtgcagtggtgccatcatggctcactgcagccttcacctcctgggctcaagccatcctcctgtctcggcctcccagagcgctgggattacaggtgtgagctactgagcccggctttttttttttttttttttttaactcaagcctgttgaataattacagaattgaataccattacctgtcttaaatactgtcttccagggacaatatcctagtggcaattattttagctaattttgaaggtttttctcagtttttattcatctaagcatctaggggtttagtgattattgtctgaatgcaaaacattgagttaagaaagatactgatttttgcagtcttgagtttatctcgccttccttaagtaaaggtgcagtgtagatcttcattgcttattacaagtaaaaatagtagcctgtagaaatttgtgcagaagaaaataaaataatgggcctggtgtttctcatcagtttaaatccatttcaccttcgttgagactgagtcttcagtcttttaggtggcgagtcaaggttttactaatttaaactattgtctaaattcagggctgtctttcattgttaaaggagatagtttgcctgacagtacctggaagcagtgttttgtgacataagtaatgtgttcacctagataatcggtctgtaacctactcatatatatatattttttgagacagagtctcgctctgtcacccaggctggagtgcagtggcgcgatctcggctcactgcaacctccgcctcccgggttcaagcaattctcctgcgtcagcctcctgagtagctgggaatccaggtgtgcgccaccatgcctggctaatttttgtatttttaatagagatggggttttagcatgttggccaggctggtctcgaactcctgaccttgtgatttgcccacctcagcctcccaaaatgctgggattacaggcatgagccaccgcgcccagctatatttttaaaaattttttaattttttgagatggagtctcactctgttgctcaggctggagtgcagtggcgtgaacttggatcactgcaacctccgcctcccgggttcaagggattctcctgcctcagcctcctgagtagctgggattacaggcgcccaccacacccagcttatttttgtatttttagtagagatggggtttcaccatgttggccaggctggtctcgaattcctgacctcaagtgatccacctgacttgacctcccaaaatgctgggattacaggcgtgagccgctgccatattttccatttattttttttttaaccaaatgccttattttcttagaatgtgactgatgctgatacagaaagttcagtgtccactatcatctttgctttctaatgaaaaggatattatactttgcttcagtcagttcgtttatgatgagtggcagttaattctctgctgaaagactgtgtagtattatagttgcaatcactgtctaattatttaccttgtgttgattatgtttttaaaacctgccattctttgattgttattatgcattaaaaaggcagtttggtcttgaactctagacctcaagcgatcctcctaccttggcctcccaaaatgctgagattacaggtgtgagccaccacacctggctgtaaagaggcaatttggaatttagagagggattctagtcccttgttaaagaactaactctaggctgtgcacagtggctctcgcctgtaatcccagccctttcggaggccgaggcaggcagatttcctgaggtcaggagttcaagaccagcctggccaacgtggtgaaaccccatttttactaaaaatagaaaaattatctgggtggtggcggacacctgtaatcccagctactcaggagtctgaggcaggagaatcgcttgaacccgggaggcagaggttgcaatgagctgagatcacaccattgtactccagcctgggtgacaagagccagagtccatctcaaaaaaaaaaaaaaaaaaaaaaaatatatatatatatatatatgtatgtatgtatatacacatatatatatgtatgtatatacacacatatatataattttatatatttatttatatatatttgtgtatatatattataacatgaaaaagaaatagggcatgaatgtaatttaaataaaagagtgttctagcacctgcccacttgccagtctgactggaaccttgttttgaagcagaaatgtattgaaagttcagaagtatctcagagaacagcatcataaaaaatattaagaacctcagtttttattagggtaatgataaggtttgtaaaaatcttcaagcgcgttcttcctttcactcactataaaatatttttttttgtctgggtgcagtggcttatgcttttaatcctagcactttggtagactgaggcgggaggatcatttgatctcaggagttcgagaccagcctgcgcaacatagtgagacccgatctctactaaaaatacaaaaaattagccgggcgtggtgctgcaagtctgtagtcccagctagtagggatgctgaggtgggaagatcgcttgaacacaggaggtggaggcttcagttagcagtgatggtgccactgtactcgtccaggcaacagagtgagactttgtctcataaaacccaaaaccaaatgttgttgtgtgctgtttggtattaacagcaaggaatcagataattaaagcagaagtacagacaaaaagaaaattttatggaattagttattggcttattttgaggaagaatggatcagaacagcaaggacacggataaatctaatacctgaaatggatctccaacaggaaactcgaggatttcaaacaatggctagagtcttgttttcagagataaagaaggcatcacatatacagtagccaaccagaatcggagataaacaatgaaatagcaacaggccaattgagttcaactttgaaactcatgaaggagaattaaaatcaaatcagggaaacgaaaggtgaagtcaaaaaacgttgagaatagaagaactgaggagattgaaaaaatgggaggctgggcgcagtggcttatgcctgtaatcccagcacttggggaggccaaggcgggcagatcacctgacgtcagtagttcaagatcagcctgaccaacatgacgaaaccccatctctaaaaaaaatacaaaaattagctgggtttggtggcaggcacctgtaatccgaactacttgggaggctgaggcaggagaattgcttgaacctgggaggcagaggttgcagtgagccgagatcgtgccattgcactctagcctgggcgatagagcaagactctgtctcaaaaataaaaaaaaagaaaaaaagaaaaaaaaatgggaaagaaggcataccaggctcacatagctgttattttttgtgtgtctgtttaatcacagtatatcccgtgtcatcttgttctgaccagcccacagtaattgggtttgggtaggctcatgacacatatgcccagatcttttacacaaaatgtaatgggaaggctgggcatagtggcttacgcctgtaatcctagcattttgggagcccaaagcagacggatcaactgagatcagaagttcgagaccagcctggccaacatggcaaaatcctgtctctactaaaaatacaaaaattagtcagacgtggtggtgcacgcctgtaatcccggctactcgggaggctgaggcaggagaatcacttgaacccaggaggtggaggttgcagtgagttgagattgtgttactgcactccaacctgggcgataagtgagactccgtctcaaaaaaaaaaaaaaagtaatgggaggatgtgatagttctctgcctctgggatcacaggacaggaatgtggtacgcatgaaggtgcatgtggctgtcaggtctgccttagggagaacacccttctgcttaagctgagagaattctaatgacttattttgtggttttggatctagctatatgtggagccagtataacctttagacttaattaattaaatgaagcaataaaagttctcttttgtacttgatcttgtttgaattgggaattggtaacctcgcaatctaaagtagttctggctaattcataaattgttcttgagaataaaggatatggaaggtatggttcccagagttggtgaggttagttattcttactgaaaacaaccaacactgttgtaaaattataaaacaaaacttttgtgaaaacaccagaaagttgaaaagtagagaaaatttgaagggctgggttatgggaactcaattgacagaagtgagaattactcttgtcctgaaggcaaacatttcaccacttgaccttgagttttaaaagctttgtggggtgagagactcagaatagtctgcatccttacttgtggcctgggttaacttctactgggtgggccaaggaaccaagtctcgaacttggattagagtgattctaggcaggtgttgtctcttgacacctggaggaagctgccttcaccctaggcttaagattataagtaattttttcacgtaaaataactaactcactaagataattaggcatagaagggaataagaaccatgcataagggtaagaaccactgggaacaacagaaatagtcctgcaaaaacttgagatttggaattatcagagactataaaataactgccccattaccaaagaaatatgacaatcttgaaattccttagagagtaggaaactataaaatatgacttagcagtaactagaaatcatagaaatgaaaattacaaacaaaattaaaaaccggataggtgttttaacaacagaataaaaagatgaagaaggagttagtgaaatggaaggtaagccagaagaaataattgtttagtatggagaagaaaacgtaaaaaaaggtaagaagctaaaaggataagtgatgactaacatacattaatgtgagtcccagtaggataggagatagagaatggggcagaatctaaagagacaatagcttagagttttccacatcgaaggataccatttcatagttaagcctatgaatgacagacatatgtttaataaaaataaaatctacacctagaatacacagtgaaactgtagaaaacatcttagacaaagaaaacctcttaaaaacagcaggagtaggaatgggaatcacctaaaaagagaccgtagattacttctcaatagcgacagtggaagccaaaatataatgacaccaacagataatgaaataaccttagtgtgctgaaagaatataattgtcaacctaggtttctattccagcgaaaatacctttcaagaaaaattttttagcaaacaaaaacagtttgtcaccagaggacagcaggaacacaaaagaatgagcaaattatgtcataaatacgtggttacatctaaaggaaaattaaattaagcaaaaatagtgttgcatctaaaaatacagaattaggccgggtgcggtggctcacgcctgtaatctcagcactttgggaggctgaagcgggcagatcacctgaggtcaggagctcaagaccagcctgcccaatgtggtgaaaccccatctctactaaaaatacaaaaattacccgggtgtggtggcaggcgcctgtcatcccagctactcgggaggcagaggcaggagaattactcgcacccaggagctggagatttcagtgagccaggatcgtgccactgcactccagccggggcaacagagcgagactccttccccccaccaaagaaaaaaaaaacttaaaaactcgtacctagttgcattccttatgagcacagagcaaaatgtcctcattttacctggtttaattttttttttcttccacggcctcttttactgggagacctctgagttttgatgtgtcatgacagataggagaggtcatatccttgtgatttgtggttcattgctggtgacatcagaaagtaaagtcaaccaggaaaagactccatgggcctggctcaggtggcttctggagcaccacctccatcaaggagcttttcctggggtccatgtgtagtccatgttgcctgctctcccacccagggttgctgtgcttattatacaagatggccaataaagcatgacatatattcaataaatgttcatttctttttccaacccttcttattttaagttgagggtattcataaaagggattgagcatttccatttatggacgaggcaactgagtacagcccccaggggcacgcagcgagatggctgtctgctgaacccatacaccagctctctaggcgtttggtcctgtggggaccggtgcatcagatgcttcctaagctggcgtcacctgcctggcccgatgcctcctctggtgttcattgtttaattaatgccacctcctgatggcagtttctttctgggaagaggagaaaagagagccgtccccaagtgaagggtgcagggaagcctccacgaatagtttcaactaaggactgtcccaggaaggaaactcttgggatgggcaaagaacagcgaacttccggtgtgacccggatgcacccatttccagagagcaggaagcacagagaaggcccgtgggtcgcccttggggtgctttccatcctgcagggctcgctgcctgccctgaaagttctgataaagacataggaccttcatcaccaggggcgccccgtgggctgttgctgtagcgtctgtcccccatttcttacacacattgagtgtgattgttaccagtggagggtgtccaatggaagaagcaccaaaagccgagatttattgaaagtggaaggtacagtccacaaagagggggcgggccgagcctgggggctgaagagcccctttacagaattttctggggtttaactaccttctggggtttaactttctggggtttaattttctagaggtttcccattggttacctggtgtacatcctttgtaaatacagtagtggcctgcaagcagtctgattggttgtgaaaagcaaccaattagaggctgacttgaagttacaaaggttacaccctatgcaagcatctgtggaaagcaaccaatcagagactaaagtgaagttacaaagttacacttgtatgcaaatgacgacttgccctgccgggctccagtaatcccagtactttgggaggccaagatgggtggattacttgaggtcacgagttccagaccagcctgaccaatatggtgaaaccccctctctactaaaaatacaaaaaattagccaggtgtggtggcagttacctgtaatctcagctactcgggaggctgaggcaggagaatcgcttgaacccgggaggcagaggttgcagtgagctgagatagcgccattgcacttcagcctgggcaacaaagcaagaccctctctcaaaacaaaaacaaaaggccgggcgtggtgggaggccaaggtaggtggataacctgaagtcagaagttccagaccagcctggccaacatggcgaaactccatctctactaaaaatacaaaaattagttgggcgtggtggcgggcacctgtagtcccaggtactcgcgaggctgaagcaggagaatcgtttgaacccggaaggccgaggttgcagggaacccagaacgtgccactgcactccagcctcggcgatagagctagactccgtcttaaaaaaagaaaaaaaaaagtccgggggcgatggctcacgccggtaatccggccgaggcgggcggatcatgaggtcaggagatcgataccatcctggctaacatggtgaaaacccgtctctactaaaaaacacaaaaattagctgggcgtggtggcgggcgcctgtagtcccagctactctggaggctgaggtgggagaatggcgtgaacccgggaggcggagcttgcagtgagccgagatcgtgccactgcactaaagaaaaaggaaaggaaaaaagacttggtcgcagtcagtctgggattcgttgcaggaagcaaccaatcagaggctgaagtgaagttacaatgttacactcctgtgcaaacgtctgattggttgcagaaagcaaccaatcagagatactttgaattttccatctgggacacagaaaaagtgggggtggtggtttgcaaactgagtagcctcccatccttttgttacttaggtgtgaaaagttggggttttccttttgatttagttctaggaagtcagcatgaattggccttaggttccctgcctccagaccctattctccggcctcatgatgacttgatggcagatttatggcgattaaagatgagaaaaagtggtaacagcagtaggcagaaaattgccctagtttcatgttctgactgtgatagtggcaatatgaccttgacaaatcactgcatttgtaaaatgagaacacatctctgttttctttcgctggggaattaaaggaaaagtgagattatgaagaaatactatgaattttcagaaataatgaaagtgtacgctaagtgaatgtctaattatagaaacatatatgcctttgttgtccatttcgcctaagccacattttaatggaaatttacttagacttgggggagagggagagggaaagaaaaccagacaaattcacttagttttatccaagagaaaaagaatgggacctaagctgttaggccaaataatttctataatttacctattcacttgcttgatacggcctttacttccgtctctagtcagggacccttgtgttgggaatcagatttgcttctgtttgttcaaatatatggggataagtgttttgtttgttttgtttttgttttttttttttgagatagagtcttgctttgttgtttgggttggagtgctgtggcgtgattttggctcactgcaacctccacctactggattcaattgattctcgtgcctcagcctcctgagtgactggaattacagatggtacaccaccatgcctggctaatttttgtatttttagtagagacagtgtttcgccacattgcccaggatggtctcgaactcctggcctcatgagagtcacctgccacggcctcccaaagtgctgggattacaggtttgagccactgggcccagccaagtgtcaattattttttattatggtttgtatttatttattttattttttttgaggcggagtctcactctgtcgcccaggctggagtgcagcagcgcaatcttggctcactgcaacctccgcctcctgggctcaagcgattctcctgcctcagcctcccaagtagctgggattacaggtgcgtgccaccatgcccggctatttggaatttttaatagagacagggtttcaccatgttggccatgctgatctcgaactcctgacctcaagagatccacccgcctcggccttccaaagggctgggattacaggcgtgagccaccacgcccagtggattatggtttttattataaagcgcaacttcctaagtatgtatgcttcgttatttgttgatgggtaatctgggctagcagttaattcacatggtaacagataaagctagatcacagtctttaataatagggaaatagagcatcctctttaataatagggaaaagatttactgacatttttaggcataacagttttctgctgacagctcctcagctgcttgtccacgttctccagaaccctggggctttagttaaggaatactcgggtgttgtcagtaaattaatttgtttttacagttactattcttgtttccagtgtttaatttttaaatttttcagttatctttccatattaagtttatttaattattcaatagctccctaaaagtagaattaattcaactaaattaaaagggacaatttttaataggcatctaatttgcatgctatttacagaaaacctttttagtgtttcagttttagaaatttgctttagattttgccatgttagtatgtctttatatggtgtattgttttggttttattttggtaaaatatacataatttttttgtgtgtgtgacaggctcactctgtcaccaaggctccagtgaggtggcgtgatctcggctcactgcaacctccgtctcccaggttcaagcgattcccctgtctcagactcttgagtagccgggattacaggcgcccaccaccctgcctggctcatttttgtatttttagtagaggcagagttttgccatgttggccaggctaatctcgaactcccgacctcaggtgatccacctgcctcggcctcccaaagagctgggattagagacatgagccaccacgcctggccagtatgtttttatatggtgtgttgttttcattttattttggtaaaatatacttaacataaaatttacacttctaaccattttgttttgtttttttgagacggagttttgctcttgtcacccagactggagtgcagtgctgcgatctccgctcactgcagcctccgcctcctgggttcaagcaattctcctgcctcagcctcccaaagtgctgggatgataggcatgagccaacgtgcctggccagaatatgctgtattataaagaatcttacatgttacttgatgcctgtgatctattttcttagtaagaagagaaacttctctccactcagcctcagtccactgtacccactcttttgtgtgtcaggatgttcaggggagaagagggcttagcatctctgtcctgtgttgagttgtggttgcccgtcactgggctgtaaagtgccttgcctcgtcttgttcttacttgggagaaatttcactgattctgggtgccacctggatttatttggggtgtgatattgacccaattttctggaaataacaatatatagaaaattaggggatagattctttatcttatgagggtttgggcaagtcaaatacttagtttctgagccttattttgtctctagagcaagaaaactgtaaattaggcagccggtgaggggccctcacagctttggctgtgggttcaggacaccagatttctaccactcactttcttcttacttctcctgcacagggatcatggcccaagttgcaatgtccaccctccccgttgaagatgaggagtcctcggagagcaggatggtggtgacattcctcatgtcagctctcgagtccatggtgaggccttctgttccatcattccatagttgggtaggcctgcactgtagataaggttgatttgtttttgtggaagatagaattttatggtttttagttttaatgagtactttttctttacttttttttttttttttttttttttgagacggagtcttgctctgttgcccaggctagagtgcagtggcgagatcttggctcactgcaacctttacctcccgggttcgagcgattctcctgccttagccttccgagtagctgggattacaggcgcctgccaccacacctggctaattttttgtatttttagtaaagacagggtttgaccatcttggccaggccggtctcgaactcctgacctcttgatccacctgcctcagccgcccaaagtgctgggattacaggtgtgaaccactgccccaaccaatgagtagtttttcttcttgaatagttatgggtttaagcctttcacatcacagtcattcattcattcattcatttatttgagacagagtttcgctcttgttgcccaggctggggtgcaatggcatgatataggctccctgcaacctctgccccctgggttcaagtgattctcatgcctcagactcccgagtagctgggattgcaggtgtgcgccaccacgctcgggtaattttttgtatttttagtagagacagggtttcaccatgttggtcacgcgggtctcgaactcccgacctcaggtgatccacccaccttggcctcccaaagtgctgggattataggctgaggtcaggagttcaagactagcctggccaacattgtgaaaccctatctctactaaaaatacaaaaaaattagccagcgtggcagcgtgtgcctgtagtcccagtaacccgggaggctgagacaggagaattgcttgaacccgtgaggtggaggttgcagtgagccgagatcgcgccaccacactccagcctgggcgacagagtggaactctgtcttaaaaaaaaaaagaaaaagatgcccataaatattttgttcccaggttgttatggtggtattatttttaggggggaaaattggaatcaccaaccttttaaataatgttatcagtaaatcattcaaggtatattcattaaatggaatactatatactctgtaacattttaaaagaatatttaatctcgtagaaatatgcttagtaaaagtcagtaaatactctgcccacctaaaagtgattctggctgtgtgtacacaggggaatacttctggaggtggggattatgtaatgaatgctgtagtgtgggtttcagacccccaccctccttttgtactgagggcactaattgcccaggtgccatggctgttcgagcaccttgtacaagattccaccctttcccaggggagggccatgccagctcccagctctgggtgcagctacatcagtgttcagtgcttcgtctgtccggccctgcctgccttccgcctcccaagtgctgtaattgacagtgccccccagcaagcctgtgtaaactctcagtctactacttggagaatctgacctataagagattacaagggaattgtgttttttttttccttataaattctgtgttgtcttttgtttaaaatcaggccaaaaactatctcgaaagagaagtacctttaaaaaatgttgttagtttttttaattcatcgagcagaaatgatgctcttaaacgtccgcctgtaacatgatgtttgctgtttgtattgtagtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtaagcattgtatttttatcttttgcatttcattaattttaagcctaaatatttgtaggtaagacaagttatattattttctttctttctttctttctttttttttttttttgagatggagttttgctcatgttgcctaggctggagtgcagtggcacactcttggctcaccacaacccccgctgcgtgagttcaagtgattctcctgcctcagcctcccaagtagctgggattacaggcacgcgccagcacgcctggctaattttgtatttttagtagagacggggtttctccatgttggtcaggctggtctcaaactcccgacctcaggtgatctgcccaccttggcctcccaaagtgcagagggattataggcgtgggccactgcgcctggccaagttatattttcttctaaaacagaatgaggtttaaactaaaaaagattttctgaaatgtttatggagacatttcaaaatgctcaaaaggaatcactgaaatatgtcaggatagatactgaagagttaagaaaaatggtagtgtttgttgtacggtgttccttgcttggctttactctgggttaatgagatgcattagagagaaggtaatgaaggtagagaaattttgaataggttaaaacttttactcagataaggagttattttctttttcttttttttttttgagacagagtttcactcttggccccctgggctggagtgcaatggcacgatctcggctcattgcaacctccacctcccatgttcaagcaattcttctacctcatcctcccgagtagctgggattacaggtgcccaccaccatgcctggctaatttttgtaattttagtaaagacagggttttgccatgttggccaagttggtctcaaactcctgacctcaggtgatctgcttgccttggcctcccaaagtgctaggatttcaggcatgagccaccactctcggctttttttttttttttaagagatggggtctcgctccgtcaccaggctggagtgcagtggcgcgatctccgctcactgcaacttccacctcctgtattcaagcaattcttctacctcagcctctggagtagctgggattacaggtgcacaccaccatacctagataattttttgtatttttagtacagacagggtttctccatgttggccaggctggtcttgagctcctgacccgaggagcccacctcggcctcccaaagtgctgggattacaggcgtgagccaccacatccggccgggagttcttttctagataaaaagttggtgtgttgaaaaccagtgattcactgtgcaagtttgtttaagcatattgcaaaattaaacagttctcctccactccctcacagatacgagtcaccttatcacagtcttcagtgagttttgtaatctgcatttagagcagtggtgagcttatttgacattggaacagtgttgaaatttactatagggttttaatacccacagcctttcacagtatgaccattttcatatctgtgtttaacctaacactgtaggttttatgttaactgattgatacagcattttcttaaaaacatggaaagggaacaaaaaaagctagggtatctataggcacatattatatatgggcatacctcattttttgttgttgtcatttttgtttttttgagacggagttttgctcttgttgcccaggctagagtgcaatggtgcgatctcggctcaccgcaacctctgcctcttgggttcaagtgattctcctgcctcagcctcccgagtagctgggattacaggcatgcaccaccacacccagctagttttgtatttttagtagagatggggtttctccatgttggtcaggctggtctcgtactcctgacctcaggttatctgcccgcctcggcctcccaaagtgctgggattacaggcgtgagccactgtgcccgaccgggcatatctcattttttttttttgtgccttgcagacactgcagttttcacacattgaagatttgtggcaaccttgtgtcaagtctattggtgccatttttcctgcagcatgtgcttacttggttctctgtgttgcattttggtaactcttggcatagcattatttgagactttttcatgattattgtatccgctgtagtggaattttttttttttttttttttttttttttgagatggaggtttgctccgtcaccctggctggagtgcagtggtgcgatctcggctcactgcatcccctgcctccttggttcaaggtattgagatcagtgatctttgatgttactattgtaattgtactgggagtcctcgaacgcacacatataatatggcaaacctaataggtaaatatgtgttctgactgcttcaccaatcgcctggtcccccatcattccctttcctcaggcctccctggtccctgagacacaatattgaaattaggccggccaggcacggtggctcatgcctgtcatcctagcactttgggaggccgagatgtgtggaccacgaggtcaagagatcgagaccatcctggccaacatggtgaaacaccatctctactaaaaatacaaaaaattagctgggtgtggtggcgcgtgcttgtagtcccagctatttgggaggctgaggcaggtgaattacttgaacctgggaggtggaggttgcagtgagccaagatcgtgccactgcactccagcctggcgaaagagcaagactccgtctcaacgaaaaaaaaaggaaattaggccaattaatagacctatagtggcctctgagtgttcaagtgaaaggaagagttgcaggctgctcactttacatcaaaagcagaaatgatgaagcttagtgaggaaggcatgtcagcagctgaggtaggctgaaagctaggctgaacaggtagccaggtggagaatgcgtaggaaaagttctcgaaggaaatgaaaactgctgctccagtgaacacgcaaatgataaagcaaaacagcttattgctgataggaagaaagtttgaatggtgtggatagaagatcaaaccagccacagcattcccttaagccacagcgtaatccagagtgaggccctaactctcttcaattctgtgaaggctgagatgggtgaggaagctgcagaagaaaaattggaagctagcagaggttggctcatgaggtttaaggaaagacacagtcagctgggggcggtggctcacgcctgtaatcccagcactttgggaggctgaggtgggcagatcgtctgagctcaggagttcaagaccaccctaggcaccctggtgaaaccccgtctcttctaaaatacaaaaaattagccaggcctggtggcgtgcacctgtagtcccagctgctctggaggctgaggtacgagaatcgcttgagcccaggaggcggaggttgcagtgagctgagatctcgccattgcactccagcctggactcttgagatctgtctcaaaagaaaaaaaaaggaaagacagagtctctataacataaaagtgcaaggtaaagcagcaagtgtttgatgtagaaactgcagcaagttctttagaagatctagctgaggtaattcatgaagatggctacactcacaaaacccgattttcaacgtagacaaaacagccttatattggaagatactctctaggactttgctagctagagagaagttcattcctggcttcaaagcttcaaaggacaagctgaattccttgtgaggggttaacgccgctggttactttgaagccatgttcatttaccattctgaaaatcctggggtcctgaagagttacactaaatctgctctgcctgtgctctattgatagaacaataaagcctggatgacagcacatctcttgatagtgttgttcaccgaatattttaagcccacttttgagacctactgctcagaaaaaaagattgctttcaaaatatgactgctcacagtcactcacagagtcctgatggaggtgtataaggagatgcttgccattttatttttattttttatttagttttttttgagacagagttttgctcttgttgcccatgctggagtgcaatggcgcgatctcagctcactgcaacctccatgaacactgttgaaatgataacaaaggatttagagtatgacataaacttagttcataaagcaatggcagggttttggaggattgactccaattttgaaacaagttctaccgtgggtgaaatgctaccaaatagcctcacactacagagagacctttcatgaaagcaagagtcaatgtaacttttatatgcattgggaaaccaaaacatctgtgtgactttactttatacttgtattattgtggtgatttggaaatgaacctgcagatgcttgtatgccactaaggtctaaagttaaacttctgatgtcagtttagattaaattggtgatacattcagcaacttattagtgaacaaaaagttttgttaattcacgaattttaattcccaattgtatttttagtttgttttaaaaactatcccctgccactgtattcctccccctgtcccttacccccatgctgtaatcttctaagctttatgttagtaacttatttttaaaatgttgacattattataatgttgagaaatgttcaagcattgattatgtttctgtgtttctttatactaataatgctgttttgattgtgtgtgtatcagctgctgtctgccccaccaataccataagcccgcctgcagctgtacttattctccccttccctgtcctgcctggcttatgtggttctccactggttagaactaagcattaagggcgctgtcctcagctgcaagctgtagtcactgtccatcagtattcatactttgtttttattgctaataattttttttttttttttaaggagtctcgccctgtcacccaggctggagtgcagtggcgtgatcttggctcactgcaacctcagcctcccaggttcaagcgattcttctgtctcagcctcccgagtagctgggattacaggcacacctggctaatttttgtatttttagtagagatggggttttgccctgttggcctggctggtctcgaactccttacctcaagtgatccacccaccttggcctcccaaagtgctaggattaccggcgtgagccaccgtgactggcctcattgttaataatttgatccatggagaatggtttctgtatctaattctccttcttctctttttttttgagacagagtctcactatcgcccatggagtgcagtggtgcgatcttggctcactgcaacttctgcctcccaggttcaagcaagtctcctgcctcagcctttctagtagctgggattacaggcgtgtgtcactacactcggctaattttttttttttttttcgagacggagtctcgctctgtcgcccaggctagagtgcagtggcacgatctcagctcactgcaagcttcacctcccgggttcacgccattcttctgcctccgcctcccaagtagctgggactacaggcgcccaccaccatgcctggctaattttttgtattttttagtagaggtggggtttcaccatgttggccagactgatcttaaactcctgacctcaggcgatctgccctccttggcctcccaaagtgctgggattacaggcatgagccactgcacccggcctaattctcaagtacctcttacttgtttgtgtaaagtactttgcagataaggagcaataatggtcttctggaaggtaatcaataggtttatgaggcaatcatagaaattcttcaggagaattctgagcgcttttctgggatttagaaaagcgttgttcagcagaaaaaagtatcatgtgagtctctcacataatttaaaactttctagttagaacattaaagaaaaataaagaaaaacaagtgaaattcattttactggtaatactttaacttattatatctaaaatatttcaacatgtaatcaatttaaaaattattaatgggccgggtgtggtggctcatgcctgtaatcccagcactttgggaggcagaggcaggcggatcacgaggtcaggagatcgagaccatgtggccaacatggtgaaaccctgtctctactaaaaatacaaaaattagctgggagtggtggcgcgcacctgtaatcccagctactcgggaggctgaggcagaagaatcgtttgaacctgggaggtggagattgcagtgagccacgatcgtgccactgcactccagcctggtgacagagcaagactccgtctccagaaaaaaaaaattattaatgggatatttgtcatactttttttgtaccaagtcttcaaaatccagtgtgtattgtacactcatgaaacatctgaatttggaccagccaagttgcaagtgccacatgtatctatttgttatcgtgctagactttgcaagcctagaatttttttgtgtcgataatcttctcatatttaaatttgtaaccaatacaaattttcttttttaaagtagtacaagggtactggtatgtagtatttttagctatagctacacttatttcagagatggtcaccatttcatattactttcattcatctaagtattttagatttttatttgaaaagttcccttttaaatctccatctccctgccttttattttttatttttttgagacggagtcttgctctgtcgccaggctggagtgcagtggtgcaatcttggctcactgcaccctccacctcccgggttcaagcaattctcctgcctcagcctcccaagtagctgagactacaggtgtgtgccaccatgcccagctaatttttgtatttttgtttgtttgtttgtttgtttgtttgagacggagtctcactctgtcgcccaggctggagtgcagtggcgcaatttccgctcgctgcaagctccacctcccgggctcacgccattctcttgccccagcctcctgagtagctgggaccacaggcgcccgccaccacgcccggagaattttttgtatttttagtagagacggagtttcactgtgttagccaggatggtctcgatctcctgacctcgtgatccacccgcctcggcctcccaaagtgcagggattacaggcgtgagccaccgcgcccggcctaatttttgtatttttagtagagacggtggtttcatcatgttgaccaggacgctctcaatctcttgaccttgtcatctgccagcctcagcctcccaaagtgctgggattacaggtgtgagccaccgcacctggccttttttttttttttttttttttttttaatttaagagacacagtctctatccatcacccaggctggagtgctgtggtatgttctcggccccatcatagctcactgcagccttaaacttctagactcaagcagccctcacttcagcccccagacagctaggactgcagacatacaacactatacctggctattttcatttttttgcagagatgtgtccttgttatgttgccaaagctggtcttgaactcctgggctcaagcaatcctcctgcttcagcctcacaaggtggtggaattacaggcgtgagcccttgggcttgtcctcttttttgcttttataacaaatcacaaatgacttgctattttgttacaaaataacaaatcattggttacaatgattaataaatgttaaagaatggttaggaaatagttttttcctgttagaatacatgataaaagtagttttccctgttaggatacaggaaaacgatttttactaaaaaccaaatattaaggtaatggatatggaccttattattatttttttattttattttttattttttttacaggtgttgaagaagaagaaaaagctgcagagatgcataaaatgaaatctacaacccaggcaaatcggatgagtgtagatgctgtagaaattgaaacactcagaaaaacagttgaggactatttctgcttttgctatggtaaaaacaatagatttaatttttctaaaagatacattatataattgaattttctaaagggaagcttatgtaattgattcgaaaatcatataacacacattttcagtgactgaatggattagcaataaccttactttcttccacttccattttgaaggaacccaggaggaagtgtggccagtagagctgtttctttctttctgttttttttttttgagatggagtctcgctctgtcgcccaggctggagtgcagtggcacgatctcagctcactgcaatctccgcctcccggtttcaagtgattctcctgcctcagccccctgagtaactaggattacaggtgtccgccaccatgcccggctaatttttgtgttaaattttagtagagatggggtttcaccacattcgccaggctggtctcgaactcctgatctcaggtgatccacccaccttggcctcccaaagtgctgggattacaggcgtgagccaccatgcctggcctagctgtttctttctaataagcatgctcatctctctaattccatgcaaagccaccttttcttactcttgtcacatcataaaacaaagctcttacaagaaaacagtcaaaggaggagattgaggttttactgcagggtcataggtgaaaatcaattctctggaatgggattttcagtatgtgtgaggctcgctgcccaataggttgacagtatatactcatttgtaaatgggaagtttgtatttacctgataagttttcaatgagaatattagccaaaacattcctggtattttatggtaatagttggatgtgctgggcttctgtattctgaggccaaattgtacctgagaatatgccaggatgggaccatcttcaagaaagacaatagtgcaagaaaccaaccattgctctctctatgtgttttttaaagtaaaatattttatctacttttcattttggcccttcggatcagtttcaggtttagaccttctgctgacatggggagatagaatgctgtagtattaattaattttgaaatcatatattataaaaaatcatggatgcccttattaagccacaataagctagcgatgatttcattttgtaatcttaccattgaatgatgttcatccgcttttcatctgccccagggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagaggtgaagtgctttctccctttgtacccatcaacagttgattcgtataaatttgaatatttagcttacgttaatgtatttttaaaatttatatttaacacagaagtcatttaaatgtatgctttacaataattttgcgtattcatacgaagttttgttttgttttgttttaatgcagaccttttttagagccaaagaagcatgtaggtaagtaagtgctttgcttccttgatagctggctggcctccgttttgctagattttcatacactttaatggtttctgttttattgtctttgagaatatgatgtcagacattttcggatgggctgtttagatgtttatataatccacaaaaggttcattgagctaaaaaagtggagacttgtttttttgttttcagcttcgctgcttgttttctatagaagatcatacatctgccctcacttaccagaattatgagtaggatttaattgacctaatgtcatcgactcggcaagatgttgttgggcacagcattgggtggggaggggatacgcagctgtgtatcagcattaccacttttgagagctgtgagtctcatggaagagagaaaattctgtaaaatgaacatggcaagaacattgcatccctacggcaagaatggctctgagaaagtgctgtggatgttattggaggttggattcctttatagttcaggaaagagttcatgaggaagagagcatttccaggaagggcgtttgaagaatgatgcggatttcagcttcctttagggaagtctagccatttcatttgaagggaaaacaggataaagagtaataccctttagagccaggtttatttgagactttcggaagtaaataaccagtatcattggaatacttttaaacatgtaactatgaaaggaaaaaattatatatacataaacatacacattgtgttttctgttaacctttgtcttattctcattgtggtgaaaagattaattttttagcagctttattgaggtataattgatacaccataaaattcacctgccttttttttttattattattttttgagacggagtcttgctctgtcgccaaggctggagtgcagtggcgcgatcttggctcactgcagcctctgcttcccaggttcaagtgattctgcctcagcctcccgagtagctgggattacaggcacatgctgccacgcccggctaattttttgtatttttagtagagatggggtttcaccatgttaggatgatctcgaactcctgacctcaaatgatccacccgccccggcctcccaaagtgctgggattacaggcgtgagccactgtgcccagccaaattcacctgtcttaagtatataattcactaatagtagatttacaatcttaaaatgtttttaaggggtttttacccatcatcacagtcttaattttgggatgctttcatcgtccctgtctctgttatttcatgaatgttgtagaaatggaatatgtagtatgtatcctattgaaatgagcttttttcactgagcatcactcactcgaggctcatcgagcttggtaggtgtagccgtagcttctttttattgctgagcactaactattctgtgacatgaacatactgtctgttgatccagtcatcagtttatagatattttggttgtttccacctttgggtattgggaataatgttacagtgaacatacttgagcaaggttttgtctggacatattccttgatatctcttggatatttacgtaggagtgcaattactaggaatagggtaaatttacactgaacttttttttttttttaattgagacggagtctcgttctgtcaccaagttggagtgcagtggcatgatcttggctcactgcaacctccgcctcgtggattcaagagattcacctgcctcagcctcctgagtagctgggattacaggcacgcgccaccacacccggctaatttttgtatttttagtagagacgaggtttcaccatgttggccaggatggtctcaatctcttgacctcatgatcaagggaggcctctcaaagtgctgagattacaggcgtgagccatcgcgccctgctacactgaactttgaagaaactgacaagctgttttccaaggtggctataccatgttatattctcacagcaggataggagggttacccccacattgctgccaacttacttcttgattttagccattgtaatagatgtgaagtggtatctaattttttttgatttttaaaaatttctctagtgattgttgatgtgtttttacttttctttctttctttcttttttttttttttgagacagggtctcaccctgtcgcccaggctggagtgtagtggcgccatctcagcttagtgcagcctcaacctcccaggctcaagcaatcctgctgcctcagcttctcagtagctaggactacaggcgtgtgccaccatacccagctcatttctgaacctttttttggtagagacaagctcttgccgtgttggccaggctggtctggaactcctgagctcaagtgatccgcctgtgtcagcctcccaaagtgctgggattacaggcttgtgttatcttcaattgtgcttattggtcatccatacatattttttggagaaatatctatttaggtccttttcccatttaaaaattgggtttgtttgtctttttattattgagtcttgttttttatatagtcttgatataagtctctaattgatgatttgttaaaaaaaaattttttttttctttttgcaatggtgtcactctgttatccaggctggagtacaggatttgggaatattttctccaattctaataaatctacattatccttattgtataacttgtcttcttcccttacttggtagtatcctttgaggcacaaacgttttaaattttgataaaaataagtttattcttttgttaacttgtgcttttttttttgagacagagtctcgctgtgtcacccaggctggagtgcggtggcatgatctcagctcactgcaatctgcctcccgggttcaagcaattctcctgtctcagcctcccgagtagctgggactacaggtgcccgccaccatgcccggataactttagtatttttagtggagacggggtttcaccatattggtcaggctggtctcaaactccagacctcaggtgatccacctgcctcagcctcccagagtgctgggattataggcgtgagccactgcgcctggccctcacttaagcttttgacttcatattcaagaaaccattgcgtaaacccaaaggcatgaagatatgacttctgtgttttcttccacaagtcttatagcttcaactctcacatttagatctatggttcattttgaggtcatttttgtatattatacaaggtaaaggtataaattcatctttttgcacgtggatatccaatgattccaggacaatttgcagaaaagaccgtcctttccctcaagatatccttgtcatctttgttgaaagtcttttgactctttgtttatttctgggctttctatgtaggagatcatgttgtgtgagaatcaagacaatttacccctttctttgcaatctaagtgcctcttatttcttcttcttgttgctctgactagaatataaatgtcacacagcattggtgatagcagacatcaccttgtgatattagtaggaaagcattctgtctttgaccatgaagtatgatgttagtggtaggatttttgtgtaaatctcttttaagatggagaaatatttatcatgtttatgttaaatttcagacttaaaagttttttttaaacttaattattatttttatttatttatttatttatttatttatttatttttttatttattttgagatggagtcttgctctgtcgcccaggctggagtgcagtggcatgatcttggctcactacaacatctgcctcccaggctcaagcaaatctcctgcctcagccttctgagtaactgggattacaggcgcccgccaccacacctggctaatttttatatttttttagcagagacgggggttcaccatgttggccaggctggtctcaaacccctgacctcaagcaatctacccatctcagcctcccaaagtgctgggattacaggtgtgagcctccacgcccagcctaatctcagcattttgggagaccagagtgggagtctcccttgaggccaggagttcgagataagcctgggcaacatagcaagatccaatttctacaaaaaatagaaaacaattagctgggagtggtaatgcatgcttctgtagtcccagctactcaggaggctgaggtaggaggattgcttgatcctcgagagttggaggctgcagtgagctatgatcatgccactgcacaccaacctgggcaacagagtaaaaccctgtttctaaaaaaaaaaaaaaaaaaaaaaaaaaatctgtttcatcatttatatgtcagcagagtcatattctccatattccatcttactagacaaatggtatgtttctgcatttctctcactgatgaaaataagagctttttcattcaaggaggttgtggttgggtgaagggatgaaaagcagtgtttattctggtgtgatccagagctgcaaagcctagttctaccccactaattctatatttaaagcctttagacatattatatttgaaatgttgaaaaactaactccaattttttttttttgtatgtaggtggtcgtgtgatggtaacagatgctgacaggtcaatactatctccaggtggaaggtaaaacctaatttcattactgctgtttaactcccacacctcaaaaagttttagttgttagataattgagatatcagaatattaaaaaggcctcatgtcacacatcttaaagtttaataggcaaggatatcatttggggatcttgtgaacatgccctctttgacttggtatttctgaatagtagagttcctgggaaaagccagaggcattggtcacactgtgaattggccttagagtggtatttggaagttaatatgctattctgtagtattttattatactgttttccccaaaagatagatagaaattaaagtactaagttcagttggtaactcttttttttttttttatttttgagatggagttttgctctttttgcccatgctagagtgaagtggcgcgatctcggctcactgcaacctctgaccccctgctgggttcaagcgattctcctgcctcagcctcccaaatagcagggactacaagcatgtgccaccatgcccagctaatttttttgtatttttagtagagacggggtttcaccgtgttggccaggctggtctcgaactcctgacctcgggtgatccacctgcctcggcctcccaaagtactgggattacaggcatgagccaccacgcctggcccgataagtcttaatatgctactctgtagtattttattgtacttttttccccaaaagatagatagaaattgaagtactaagttcagttgataactctttttttttgtggagacagagtctccctctgtggctcaggctggagttcagtggcatgatctcagctcactgcaacctccgcctcccggattcaagtgattcaggtgagcgccaccacgcctggctaatttttgtatttttagtagagatgaggtttcaccatattggccaggctggtcttgaactcctgacctcgtgatctgcccgcctcggcctcccaatgtgttgggattacaggcgtgagccactgtgcccggcccaataactcttatttatgcaataaataaatatgtcagttttaagctgagtcaggtttgcacccaccttggtcaagggagggatcttaacactttgagacccagagactttgaatgctgtgggaatggctgtcaccagcacgtggcttgatcagggctttcttctccttgcagttgtggccccatcaaagtgaaaactgaacccacagaagattctggtatgtactagcacttttagaatcaatggtgaaattaaggaagacttttccttagtgtagaagtttatagtttgactcaattattgttttgttttgataagaaagaggcagtcactactaatgtattccaactgtgacactatttgttaatgttatcacattaagacccagaaaggtaatttgctcagtaagtggtaggcagagttctttgccagttacatatgtttgtagataaaatgtatttttttttcccgttgtacagacatataatgtaagaggtcagctgttctatagtgctttttacaaaaatcaatagaatgcccccttcgtctccaccttccttctctgcactcctgttttccactctccaaggagaccattttcaattctcaaataaaattgctatttaattccttatttatttatttattttttgagatggagtcttgctttgtcacccagactgaagtgcagtggcacgacctcggctcactgcaacctctgcctctgggttcaagcgattctcccacctcagcctcccgagtagctgggattacaggcatacgccatcacgcacgactaatttttgtatttttagtagcgacggggtttcgccaggttggcctggctggtcttgaactcctgacctcaagtgatcctcctgcctcagccttccaaagtcctaggattacaggcataagccaccgtgcccggcccccgtttataattctgttctgtcctagaaccgtggcacccagatgttctcagcatatgtatttatttcatcatttcccagtgttatcctgtgtcctagtgccactgtcaagcctcccgctgctcggccctgtgccccttattcacacgggacactccttagtgggctgtcaccgccctgcctgccccctcatctccctctgtctgaccaggccctcggcagcttccccagccccttccccggccctttgtcagccttctcattctgccatgcttcctgggcagccacctgccccgcttcaccccatctaagggcatctcgaatgagttgttggggaggagggtagggccgcgttaacgtgtgtgtgcgtgcatgtgaatgagagcttttatgtatgtaagtgtattttgggagagctgcaagaaagtgttgaattatccttttttggaaaaggtatttgagtcttttacactgtttgctggttttacagaaggtttttcttttttctttattttcactccataggaaatctcaaatttttgtgtggttttcagtagattgtgccaaaaaaaatcatcattttgcaaatgtttccccttaattcatatattcatctcctgaatatttagtttgcttctaaaaagaaacatgctgaattcagaaaccccatgtgtttaattgaattctttcaactgtctttatgtacacatcagcatcattataggtttttttttttctcttttacactttgcatctttgtattcttaatttatcctgcaaataagatgtacatttatagccagggtgcagccaggagacagaaaccatatcagttattggaacagagaaaatttaatgtaaagattgttggccgggtgcagtggctcacacctgtaatcccagcactttgggaggctgaggcgagtggatcacctgaggtcaggagttggagaccggcctggccaacatggtgaaacccagtctctactaaaaatacaaaaaaaattagcagggcatggtggtgggcgcctgtaatcccagctactcaagaggctgagggaggagaatcgtttgaactcaggaggtagaggttacattgagtcaagatcgtgccattgcactccagcctgggcaacaagagtgaaactccatctcaaaacaaaacaaacaaaaacagattgttaactggttataaaattgttaactttgtaaccttaaggagaatactaaggttttttttaaggaacaattctaggcagtggctgccaccccatcagctttccatctgacttctgaggtggggtagtgtttggctggtgctggtggctgaggggcatggtgaggctgcttctggtagtgttggagacattgccaaccaggcacagctgttgtgatgggagggcctgctttggccaggctgaacgagggtaccaaggagtgacctttttgggatgagaatgcagacaagaagccaaaaggaaggcccagatctcttctcctcctctagcctttctctctgtagtgtatctttgtggcagagactcacatggagccagctgctatgcagagctcaaacttcagcagaaacccagaggatgggtttgcaactgagagacatcagttttgtgggtggcccaggctgttctctttggctgctcagcatatatacacacccttccctgcacatttgaccttctgtacaacaacgagacaactgttccatctaaagagatgcaactttacttcctacaaagaaatccatttttactctctcctcaaaatggggggacacagtgttccagcagtcacacccatcgctgggagactgactgaaaatccagtcgcgagctatgttacctgctctttaaatgcagtgcaaacctatttgagtaatctctagtctaatggacaaatggaaaggaaacttccagccaaactattgtgaaatactaccacacagaagagaatagttagtatatgcaagcatataatcttcacacaaacacatttgtaacagacaaggaagacaataggcatagtcgccacagtctacgtttctgcagcttaccagacttttttttggatttacctttttatttttatttatttatattttttgagacaaggtctcactctgtcgtccagactggagtgcagtcgtgcgatctcggctcaccacaacctccgtgtctcagattcaagcgattctcccacctcagcctcccgagcagctgggattacagacgtgtgccacccagccaatttttgtattattcatttatttattttagtagagacggggtttaaccatgttgaccaggctggtcttgaactcctgacctcaggtaatcatccgcctcagcctcccaaagtgctgggattataggcattagcctctgcacccagccagtatgtgtaaggttctttagccaattggagtgacccaaatttttattcctgaagggtctgaatccccagtggatctgccttttttgttagctgtaatgctgtgattttctttctttctttattttttttttttgagacggagtcttgctgtgtcgcccaggctggagtgtagtggtaccatctccgctcactgcaacctccacctcttgggttcaggtgatctttgtgcctcagcctctcgggtagctgggactacaggtgcgtgccaccactcccggctaatttttgtatttttagtagagacgaggtttcaccatgttggccaggctggtctcgaactcctgacctcaggtgattcgcccgcctggacctcccaaagtgctgggattacaggcacgagccaccgcacctggctgttagctgtaattttctattaacttttactgatggacatgaaagtgctaagttagcccagagagttgcaaaggtctcagatgcagtgttctctgccaccactgtgtagcagcaaaacactttccccttggtgattgaaggcaatggagtaactcctttttttgcttgttgcttcagggatgcataccctttgtatatcaatttaactctctttgagctctttctctagagttgaaaatattctttacaaagttgcccaagtcagagctcacgatttcgtttgtgttagggttggtatgactgtggttgaatatctcagtctgaaatgtgtatgtgcacccatgcattgttcatttctttttctttttttttgagagggagtctcgccgtgtcacccaggctggagtgcagtggcacaattttggcccttcccaaagtcaactttttaataacatcgattgcttttgcctattttgaccttcatatgagtggaattacacaacatgtactcttttgtatctggccacaaaggtctgcttcaaatcatctgtcctaattgtgggcaaagctttatgcagaaaggtgtgctttgtacccttacacaaatccctgtaataaaagggatgtattaggcagaaaaaaaccaatgtatctcattattgaaattgttgaccattatgctatctctcctttggaatactgagttattaaaactgatgtttataagtgtgtttcaatggtttataaaagtatttttaatattaagtgaaaagggagtgtggtaaaattttctttgattctaaagataagaatttgctggagaaaagagcagcacataattgcagaatattaataaatggttaaaactttgcattggctgggattatagtgattttttaccttctgctacctagcaaacttttgtcttttcaaagacgtaaagtctttacttaaaataaatatgcattgctgtatttatagggagggcagagaggatttccctacacaatctagctgaaagttctcacatgcaatcatatcattgcatttgcttttctaggcatttccctggaaatggcagctgtgacagtaaaggaagaatcagaagatcctgattattatcaatataacattcaaggtaatttgaattaatgcaatttttctttctaaaaattattcgtggttaaaattaaaatttgctcatcaattgctttaatttcttaaataatattttattgatcagttcttgattgacatatatattgtaattcagtcccggggataaaacatttaaaaatggggctaaaagatcaactcagacaatccagaggggatatgtaaaatagccatttgtgttcttaaaaggatgagcaaaagttgtggcacaatttagaattcaatcccaggttctagtgttgcaaaataaaacaaacctattaggcaaatgcagataatgtcagcttaattttttctcactgcataattatagtatattaaacacttaaagtaaaaaatctggttagctttgccatctacatatctaatacaccatcttcattgcatccaagataatgaaatatctataaccccaaaagtttcctgtgtccccttgttattcattgccctgcccagtattcaggcaacacggatctgttttctgttttaggttagtttgcattttctataaagtcttatgaatgaaataataaaatgtggactattttcatgggccggggagcagtgtggcttctttcatttcaaatgattgttttgaaattcatccacagcgttgcacgtatcagtagtagattccatttgattgttgatttgtattctattgtatgcctgagtcaaaatttattcatctctttgtctgttgatagccatttgggttcttccagtttggggccattacaaatagaggtactatgaacattgtgtagaggcttttgtgtggacataggccttcatttctctcttttttttttttttttttgagacagagtctcactctgttgcccaggctggagtgcagtggcgcgatcttggctcactgcaacctccacctcccaggttgaggtgattcttctgcctcagcctcccgaatagctgggatagcaggtgtgtgccaacacacctggctaatttttgtgttttttagtagacacagggtttcaccatgttggccaggctggtctcgagctcctgacctcaggtgatccacccgccttggcctcccaaagtactgggattacaggggctaacacgcttttttaaaatgaaatatttaaaacctaaaagcatagtatcagtctgcccaggtttagtgaaccatagtatttgtctcttctctcctccctccaagaaacaacgtgtaactatttcattgaagcctttctttgggctcccccaaatccccacttttctctctattcttaagttaaccatgatcttgaaaactgagaattgtccttcctgatggtgatgtgctttactacgtaaatattctcccgggagtgtgtgtgtgtgtgtgtgtgtgtgtgtgtgtgtgtgtcatgtcatatttattgttttatatatgccacttcctgagtgaagcttacacagtggtacactgtatgtgttgttgagtatagtctgtcactcaatttaagttttcaagatttatcttttttttttttttttttggcgtgggggtggggatggatttttgctctgtcgcccaagctggagtgcagtggtgagatctcggctcattgcaacctccgcttgccgggttcaagcaattctctgcctcagctgggatttatctgttttgtcacaagtagatttaatcatgtcatcatggtagttacactgtgtgattataatacagttcgttttttcgttcttctacataaagacattgatgttttcttctaaaacttttgtattccaaaataggcttggatatatttctctgtgcacctcagtgctcctgtaaaatagtgacattcaaatgtgagtgttgggaatgtgttgattttctcaatgagtggtaggcacctcaagcatttgagaggtggaggttaagtatgttttagggtgaataaaatcaagtaccatttttagggtgaataaaattcaaatatgggacattaaaataatttgaaagtatagtgatacgtgaaggtattttgagtaaataccaactaaaaaaaatatagtttagcaatattggaagccaaaaacagtagtagcaggatagaataagactatgtcgtatttaaaggaattggtcactaagttgatataacaaccattagtttgtatgtgcctaactatgtatcctcacagtaaaagtaaaaattatttacaaattataagtctctatagatatgtacagtcatgtgggagattttaaccaatgatatacgtctagctgatgaatactcttttaacatttatatgctaaatagaatattttcactacagttaatatatgtaagctaactatagaaaactgtgtacccaagaaataagtttatttacaaagcatgaatcatttataaaaattgactgtatacttgttcacagtcttaataaattctctgaacatactgaaattaaattattaatagaaaacatacacagtgggaatcctaggaaacatgcttgtaattgacttaatgagggcctcattaaaaatatttagaccagaatattgagaatgccacatagttaaacttgtgaagagcaactaaagcagtacttagaggtcaattagtagccttcactaaggttgcatttttaaatcctgtaaatagcacatcttccttttcttgagctctgtatattttactcagagtcagaagactaggaagcagtggatctagcatttgaatttaggagtctacattccaagacttgctcttctttgagattccaaatagaaactatttctttatttctcatgcaattgatttttttctctgatgtgtcctttgcctgtaatgtgtagtgtggtgcatctttgtgaaatttcttaggctttagagaatgaagcctttcaaacaacttcggatgttttcccaattctcttcagagatagttaactgaactgtggtcatattaatgccaaaatgtgttttatattaaatagccattgaaaacacaatgttttgttttctattttaaaactattattattttaatcattaaaaagtttgatgataacatgtaaatgtgttgtcaaaatatagcagtttgtgaagttgaatttaactcagagtactttctgtgttttggaaagaaccttattagaaaaagtgcccgctgtgctggaagaaagggagaatgaattaatagctgttagtttgtcacatttctatttcagtagagattcaaggagatggtttacgttattttagagattctaaggaaggtatataacatttggttctgcatttttcttcagtatgacaaaagagtaagcaaatatttgccaaagaagaaacaaataaacctgtgagataaacctgcatttgtaatctgtatgaagtaaaagttacagtttactgttatgaacattgtactgttttaaaaaacccacatcttccattttagacataccattcccattcaatccatatgtccagtcatcttcaaaatttcttttgactgtttacatatgaattcacctgattacatttttccattcaccaagaccataaattgacattgctcatcttgtcagtcttttttttttttaatttttttctttttatttataaaaaggccattccatgtatctcacccaaatttgttgactaaagtcaccccacatttttttttgggggggattacttttgaagtattatctttgtatcccaaagcaggcccttctgaaactgatgatgttgatgaaaaacagcccctatcgaagcctttgcaaggtataatcttttcacttccattctcccacatactgcttgtgtttaatgtttccttatattgcacagactgtgttttaatatttataagtacagtattacttttctaaatggaaaaggaaaaaaatgtattggcctttttttaacatataaatgaacttcacaagcaacaatttttcaaaaatcaattttcccttttgtgaatctagtaatgaatctcgaaatgggtacatgacacactttcctattgaaggtaaagtacacatttataccttatctcagaacagtcagaagccaggttactgttttattggttagtgatgcaaatattgataaggtcaggttgatacttagtatttagaagaattctgaaatagcacttgttaatctgtaagtttcgaattgattgcctttttggcaattttttacagtgttcccaaacttgatactcataggctattagtaatggcatttacttctatctattctggctttgagtgcataagatgtattttctttaggcttagcatataatgtaaatgtaattgtttatttcagattttaaaagacatacagaattattgcttacacgaacaatcatcttaactgttattctttgctgaaattttactttttacctactggcctcatcatttcactctcattcctttgacctcacatctcttttttctttgacttttacagtcaaataacttaatgctccataaattcaaatattaagattaaaaaaagagaaaggaagtgtgtagagaaagcatattttaaaaatgaattaaagagtgactcataggtataggtttgtagatttacctagagtttgagttcaggtgagttttcacaatataaagtaagtggaaaagaatccccagataattgtgacatgctaaagctagatactgagaaccaaaaagatgtgacctcagtatgggacttttaattcaaggatattagctaccaaatgacagtttttcagaccgtaagcattgctttttaaaaatcaagataaaatacatttataacatatcttacttttagtatagcttctgaatttagttctcaatagataagacaaaagagatgaacatctgcttcctttcccctcaagcgatgtattcttactaataggtaatatgtttttttttggtacttaaaggcagtgtttttcaatcttttccatgttagtagctcagatctttaaggacagaggatacaaattagggggcagcttgcgttcttaatcctaagtggctctctgatgtcttagattcttcctttcctttttgtgagtaaaacttctgctctagtaggatgagcctgttcaccttgtgactgcctaactgatcattgctttatgttccagtttttagaagcaggcagattatattacctgacttaaaatgcttttgagactaaaggtagtatcttaaattttaacttacgagtttcctttaagtacaactttgatgaaattatggggattgagtttccatggctttcaccatagtgaaaatggaaagcatgaaacattccacagcaaaccctgaacttatttatagggagttaattaagtgtctgatcacagcaagcatttactctgatctgtttgtgtatgtgtgtctttgacagatgagcatggtacttgaagcataattctgcttcctcagattccaatatctagtaattttatcatgtagttatagtaactaatattaaatccccaaacctacttaggtctactctgtatttgtgttttcaaataatttttttagcttccaaatagaagcgttgtattcttttctgaattagaaaacattgttcgacttaactgctaaagagttagacaatcattttgcatatgtttattatgtcttagattgtttgcattgttacctagattctctttcatctttcaatgtcagtttttattggtttattatatgttgtttattttctttttaggaagccaccattcttcagagggcaatgaaggcacagaaatggaagtaccagcagaaggttaggagaaaaagagattgcatattttccactatttgttgtatgtttattctattttatagattctattatccttaaaacaccttatttggaaataaaaggtgattcccttggtatgccttcctagccaacaggttattatttttttaaaaattctaagatgtaatatacttctttgaccatactgattaataaagcctatgggaatgaaactaagtggtaagtaaagctcttacatgatgcaaaatgctacttttttttttgtcctggttttcttgtgccatattaaatatcttttaaggaagaatagcttcagtgtttcagaattaaaattactagctccattcatattttattttcaaatgtattttttaatactttagtctcttagtagggtaggaatttagtctacataaaatttatacaggagagagtttctccctttattttgtactcacaactactccataaatgactttgtcagtttaccagctctacagctttggttttagaattgaacgcctgactgaggtacagttctttttgtttagaatcctgagttcaacttatcatgtagggtggcttcttatttccaaggtgtttaaacggttccacacaaatttttgtagatttctcccaaggaaaatgactggtaaggtaactgaatcttgttttagaattatttctctcataaattggtcatgttatcccttatttttctagaatgaaaagaggagtctgttatgtaactgcttatattccattgtatttacatttttattttaattaaaaaaaaacatttgtttgatcttttaccttctttgagggaaaggcaatcttaaaagttccccagtataggctggtttctccaaattcaattatagaattagggtttctccctggaatacatttctctcaaaaatactgatatgctcattgtaaaccgttggttacatttccctgtcagccctttttatagaagattgtgtgggtgaatgttgtatgctttactgtgtggaggtgggtatcttctgtgtgacagagttttcagctttgaataggcgggatttagaacaacaagacctaggtaatagatcatgtgcagtacgagggctcattgggcagtaccgatggctcaccgccttgcagccccgccggcaggtactgcaccttgaagactgcgtttttaggacatttttactgtcatattccagtgttaacaaagttgaatcgaatctgggttctggcctttattcctttactaacaagtaaacataatctttggcaaatcaattaatctctcaacctttgcacaatgaaagagaactaatgaaaatactctataagcttctagcactaacactctgatgtacatttgtcttgtgtaggaacaaatatgaatgaactttgtaatttttgaaatatgttgcatacaaagccagaggatatagtcttgtgtgcacttgtgacactcagtctcttgataggaaagtctccattgtaaagcctgggttgtggttttattgaacagtagaaaccactcctcacatttctgaaaggagagaagaaattctaaccaaagtagaaagcatttgtttctatccgagcatcttctagctgtggcaggaaattcattgtgactttgtcatatcctcattcctccaagactatgggatttttttgagtcaatttctgcaggtaacatgttatcatctaaatttttccagagtttttctaatttttgttttcttttatccctatttataatgacaagggtcaaattttaatttcattaatatgaaatgaatgaaaatgccagtggatttttatagtaggctgcttttggagtatcaaatcagtaaaatgttggaacatatggaaacatgcttaataatgaatgtcattttagaattttatttttttcaagattctactcaacatgtcccttcagaaacaagtgaggaccctgaagttgaggtgactattgaaggttagttatctaaaagccttgattccaaagtttacttctggtcataaaaatacttgtcacattcacattgctaaatatgcatttcattcatttttaaaggagacttgtgggacgaatacatgtgtctgtgtggccaaagcagcccactccccagtgctttgggagttttagatgacagaatgaggccgtgagaattagcattggcccacgggtggcccaagctatccttgctatcagtgggagttgaaaagagaaaaagaaaattatgaccagacttgatacacacaaaaacagattctataatctattgggttgtgatagaagaagacttatttggagctggaatccctaatttctaattaagtaaagtggaggagaaagtgttgatagtttagtgagtaatttttaaagcaagtccctgcccccttcaacgacccgcaaatactacttagaggctgacatacaatttatctttcaaaactgttttgaagcaatagctacaaatatattctacaatactctctatagctaagattgcttcaaacctgtttttttctccaaagataagcttgaactcagctgagccagtttatcctgaattatttgaaaattcagctaatagaattattaactatcacttcatattaatagttattaaatgagcattgtgtttttccttttaaattaatgtctcacagctgggcacggtggctcacacctgtaatcccagcactttgggaggccaaggtaggcagatcacctgaggtcgggagctcaagaccagcctgaccagcatggtgaaacgcccatctctactaaaaatacaaaactagctgggtgtggtggtgcatgcctgtaatcccagccacttgggaggctgaggcaggagaatcgcttgaaccctggaggcagaggttgtagtgtgctgagttcacgccattgcactacagcctgggcgacagagtgaaactccatctcaaaaaaaaaattaaaattaaaattaatgtgtcacaatacttgtgtaagtttcttcccctgaaagtacttctttcttgtggtaaaatgtgaaaatggtacagtaaattgtacagtggaaagttttcttcaccctcactctgctcccaagtcccaatactgagggatgtatgccagcttattgtgtctacttagagaaataattgcagtacatatcttgatgcgaaaatacacagatgctttcagcatacattacaatgcacattttaaaatattacatattccataggcctccccctcccataactgcacatcttggtactttattagtttttttttctagctgctgcgtaacctttcttggtttgctgtctgtctctctttctctcttaataacctgtcacctactgatgtcacttggttatttctagtgtttgactactccaaactactcaacgtgtctgtcttcattgcttctaaaatataagtcaattagtagcttccacttaatacaagaaatcttttcatacttcatgtgttaacttaatatacagatttcttttttcataaatataatttttctaatctaaaacattttgcattgtttacagtctagcattaaatggttgaaatttaattcgtttttagtgagaaacctcattaacaggaaaaaaatttaagaacatacaaatattacaactactcagctgtgccctttctatggagatattaataggaggttattaaaattataaaaataaagcttttagggtaggactaataaccattttgatttgtcaaatcttaaagcagatagaagctgtattttttttttttttttttttgagacagagtctggctctgtcgcccaggctggagtgcagtggtgcgatctcggctcactgcaagctctgccttcctggttcacgccattctcctgtagaggctgtattaaaatggtttagaatgtaaatacttgcttttatagtataagacttttaaagaaaggttacgaaaatccagaaataaatggctcatgaacctgaagcttatgtcagccttttgaactttaactgttttggatggagtaataaatctcttttcttttcatttatttgtttatttatttatttatttgtttttgagatggagtttcactcttgttgcctaggctggagtgcattggcgctatctcggctcaccgcaacctccgcctcgcaggttcaagcgattctcctgcctcagcctcctgagtagctgggattacaggcatgcgccgccatgctcggctaattttgtatttttaatagagacagggtttctccatcttggtcaggctggtctcgaactcctgacctcaggtgatctgcccacctcggcttcccaaagtgctgggattacaggcatgagccaccgcacctggccattcatttcttttaaactaagacattgtgccataagcctgatttaatgttcacatttgtgattaagtagtagaattttgctagtagacctctttcttttcagaagaccagtgaaataccaggtctgagtaaagtaatccttttaaaaggtagcattttccatgtcatatgtgcatatacacacacacattttatgtattatatataaaaaatatgtatattatatagaaattacatcaacaattaaattcctcatttttttaagaagataaaaaactgtctcaatattaacaaggaaggtcaagtgagaacttacatgcacacctctggttaataatgtgtatcatatattctttctggaaagattacttccaaatggtaggagctatttagatacccgtagttaggaaataaaattttggtatatcttcataacagaaaaatatatagccattgaaatcctgataatgttttccaataatctgaaaaaagatctctaatataaaatgttcagtggaaaaaaaaaaaatcctgccttgagaacaaggcaacttgaaaagcaaaagtgcatctagaggataatcttagttttgttttggaaaatactcatgcttggtaggaagacggacaaaaataaactgagatattcctgcttgcttggagacgacttaattttctccttttatatcttttcacatttcccaaatcattggtagaaaaaaaaacagaactttgttatcaaataagtctgtccgatttttcacagtgttttcacctcgatatcttcatttgcaattatgtggagttctgaagtggctaatttgacaccgacgcggacgtgtttgtggatacagggtcattacttacccactgccggtgcgctctgagctgtgcacttccatttgtggcgttttatttgtacttggagtcggtggtaaacatttaaaacatacgtgacttaggtttgggaaatcggccttggactaataggaccgcatgcctcagttttcgtaaacaccgtgactacatttctgggttaaggtgaattgccgtcaggtatgttatctctaatgtgtgcagagaaaaccttatcagacttgtttcaggtctagctgtcatgggagtgctaagaaccgtgtaaaggaggtttctttcttgcgcagttctctcttagggcctagcttcccaaacctgagtcacttacctgttacctgtgttccttctgctgtggcctaactctctgttcattacttaacctgatttttttcccttaaattgattttaagtaaattcattttgtgatgaattttacgtcttcctaagtcaaactctggcttttttatttctcatattttgaaaggtatatgtaaataatttcaaatataattgactcacatgaccacacgtggcacacttactgcagctggtactgtaggttttttaggatctctgtaattgaggaggttagcgttggaaaacttctgtgttttttatttttatagctgccaatcagacacttaatgaatacacaattatatatgtaaaaaaaggagtctcagaggaattatgtactaagatttgaataatacgtttttagagtttcagtattttagtagggtttatgatgggcagttggactacctaccatccctttcttgtggaatttatgtttaagatagtgccagatacttgactgcagcatataattagggactaaactattcatatgttcatttaatccctccacaaatactgagcacattgtatgtaccaggtgctaagagttttttttttttttttttgagacggagtttcgctctgtcgcccaggctggagtgcagtggcgcaatctcggctcactgcatcccctgcctcccaggtttaagcagttctctgcctcagccttcctccgagtagctgggattataggcgcccgccaccatgcctggctaattttttttgtatttttagtagagacggggtttcaccattttggccagggtgatcttgaactcctgacctcgtgatccgcccacctcaccctcccaaagagctgggattacaggcataagccaccgctcccggcctctttttttttttttttttttttttttttttttttaagacggagtcttgctctgttgcccaggctggagtacagtgacctgatctcggttctccgcagcctccgcctcctgggttcaagtgattctcctgcctcagcctctggagtagctggaactacaggcacacgccaccatgtccagccaatattttacttttagtacagacaggggtttcaccatgttggccaggctggtcttgaactccttacctcaggtgatccacccgcctcggcctcccaaagtgctaggattacaggcatgaaccaccgcgcctggccacggtgctaagaatttagtagtgaataattcagtggcaaatcctcgggagtgttttgaaaataagagtgacactttttgtccttcacttctaggaaacgtggtgactatgttgagaaaagggggaaaaaaaaaaaaagagaagacctagagcagtcaatagttttttgacagaaaactagcttgggagcctcttggaactacctagggcacagagaagagtgctttagagcaggttggtggcaggggagataagaagttgttgattctggggagattttgaagacaaagccaccaggctttgctgtttattgtttaattcttgtattttcttaaatgtctctgcagcacttttaaaatggacataattgcttaggttagcacttgaacactttgttttaaattttttttattgctgccaaatagtcatttaataaatacccaattgtttatgtaaagagttttagaggagctataagtggtatccatgggtgaaagaatgaatccatttatttgaaatgtatagggtaattaatggctctagttttgaaatagatatattacctggtgttgattgtttttttaactttgaatagatgtcagattgtatgataacacattcccagtctgattatgttgaagctaagagtatcagaacatattgtaacatagtctatttattgattcaccggccagaatgcagtgataaacagctttagctctgaagcctgtattatctttaggtgtattcgttaatatgttgcaaaaaggaagttggtgttttctaaacacaaattttgagttagggacggtgttgccaacttgaaggtattggcggagtgcttttgttagtgtgggtagcataactattgtaaattgatgaatagcaccttttgcatattaaaatatcttaaaatgggccaggtgtggtggtgtaatcccagcactttggaagaccgaggtgggtggatcacctgaggtcaggagtttgagaccagcctgaccaacatggtgaaattccatctctactaaaaatataaaaattagctgggcgtggtggtgggcgcctgtaatcccagctactctggaggctgaggcaggagaattgcttgaacccaggaagtggagattgcagtgagccaagatcgtgccactgcccactgcactcccagcctgggtgacagagcaagactccatctcaaaaaataaaataaaatatcttaaaatgtattttaaaagctttacattttgattatggaaacagagtttgggcttgaatttgaagcatgctgaaacgtgtgtcttgttaaacaaaaatggttgtttatactttggaaacggcagataattggaagagcaatgcccagtatgtgagggcaggccctagagctttagttgatgttttatgcttcagagtaaaaagtaattttgatcctttgtggaaaggattttaggtcgagaaacccattttttttcttactttctcaaaaccaattaattgcaacaaagagttaattgcagaaaaaattgaggatgtggtgaagtttatagctgttctgatgcctgaatgccatgttccatatgacttaaaacacccaaagattaattaataagtttatgaaacagggtttttaaaatagaatatatggtgtgatattttatcaataactacatccagctgggtgcggtggctcacacctataatcccagcactttaggaggccaaggcaggaggatcacttgaggccaggagttcaagaccaacctgggcaacatagggggacccctatctctacaaaagttaaaaaaaaaaaaaattagctgggcgtggtggtgcaggcctgtagtcccagctatttgggaggctgaggtgggaggatcacctgagcctgggaagtcgaggctgcagtgagtggtgctccagcctgggtgaaggagggagaccctgtcttaaaaaataaagtaactacattcatctctatatatgttcacatttaacagattgaactttattatttgtcagtgaagaggaaaatgtgatatccctgatattttcaatattttacagtctttgttgtattaaaaaagcactctagtagatttgcctttttctctttctttttttttttttggtttatgatcgattgggttaccttcataaaatatatttatgctattaaatctattgtggtctaaaatgtttgtgtgactgaaaaagtgaagtcttttcagtaaggaaaacctgtcttcccttcccctgggcctcagctgtgaagtttggatttggactgagatccatgggatggagctccacaggtgtcccttccattccatctacagctgtgtttcctttctcatgtcattctactctagcagctttcagtttatgtcactcaatgaatagtcagcttaaatgatgatctataaggatacttaggagaccttaacctataggggaaatacttttattttagaagttactgcttaatgtttgtaaaaaaatatatagtaatattaagcatttataatgctttgacagtattcataggtgaaatgagtgtattttgttttaacctttggaagccagcataaaaatactcttaaggtttctaaaatctgtttgggagttggaaaatcgggtttttttaaaagtatattttcagaattgaggtccaaacttacacacttctgttttccagattgtttctacttaggttggaaccttaatctatttatagggtgtcttgaccatttttaatccttacagtcatacaaacccaggtgccagtcaagttttatttcacagggaggttgtcattttaaaattgttttctgtcctggtcccgtggctcatgcctataatgtccgcactttgggaggctgaggcagaaggatcacttgaggccaggagtttcagaccagcctgggcaacataatgagaccctgtccctacaaaaaattaaaagaaaaatagccaggtgtgttggtcccagctatttgggaggctgaagcaggagaatcatttgaggccaggagctcgaggttgcagtgagctataatcatgccactgccctccagcctgggcgatagaatgagaccctcctgacagatagatagatagatagatagatagatagatagatagatagatagatagatagaatgagaccctgccaatagatagatagatagatagatagatagatagatagatagatagaaagaatgagaccctgccgatagatagatagttttctatcaaattttttcctagatttgaacatgtttttctaaagtagcattcaacacatcagcattttatagcgtcattagttgttactatgattatgtttttctgaaatagtatcctttacaaaagcacttctgtctttctaagcacatacataggtcctaaaatgaatttgtctgatgttggtgacctcggaaccattttctccagttgattagcacggccagccagtcaataatttcaggtcactgttggccttagaggaagagcccaaaggcagcaagcaagggtgctggtgtccagtcgccttctagaagcattttcaccttcccttaagatttcccttgattaacacagaagtgtctatagaagtgacccagtgctgccccgggcaacatcgtatattaggccaaatttgcatttcttacctttatgagaagcaccctcgtagtctagtggagttacacacacacagtctgatctcagctgtgctctccagagatacaacatagtccaatcaaataacatcctctgagcctgtttctttagctgtaaaataagaataacaattatacccatctaaaaagatagtgtcttgtacttgagtgatcttttttctatgatactgtctttaacacaataattattttcttcaccataccacatttgtttttaaataagaatttcttaaaatgatgttttcagtattttatagatgatgtttgagcagcaatattaatagcatgttacctgacactttgagggactagaagatgacagtggcagctgatatgacccagatgtctctaatcctaacatgaggtgtactgaagggtcacagcagagtgagttcctggtgtatccacaaggaaatgagcacggaactctcacaacagcgtgtgtgctgtgcgctgtgcttgaatagctgactgctcctttatacacagcctctgtgctgactgaatcaacagtatctgtttcatcataatgcagccctatttctttaagcccatacattttgcacttgttaaaagtatttgaacaggccaggcgcggtggctcacacctgtaatcccagcactctgggtggccgaggtgggtggatcacttgaggccaggagtttgagaccagcctggccaacatggcgaaaccccatctctatcaaaaaaatacaaaaattagccgggcgcggtggcgggtgcctgtaatcccagctacttcggaggctgaggcatgagaatcgcttgagcccaggaggtggaggttgcagtgagccaagattgcatcactgaactccagcctgggcaacagaacaattctctgtctcaaaaacaaaaacaaaaacaaaaacaaaaaaaaactatttacccaatttcccttgcttatgcatgcttaaattttgtataagcttaaatatcttttccatctaagctgtactctatccccttttataactttaggtggctgtctttattaaaagttttttcttgaaagtcttaaaacaatatagttcttggcaatttgaaagttatttgagaaggggaaatttataatgacaattcaaatgaagcaaactaaaaaataatgaagaaagacagaggaaaaagcagtattcacttgaacacatcccaaacaaagaaaatttcaaatgtaacaaggaaaaagcctgctaaagctcacaatacagaaataactattgatactcaaaatagctttaaagccctgctcaccttttgaatgttgggaattgaccaggaggtgactgtaactgtaagatggttcttccagtaatgaccattttctttttcaagatgatgattattctccaccgtctaagagaccaaaggccaatgagctaccgcagccaccagtcccggaacccgccaatgctgggaagcggaaagtgagggagttcaacttcggtaagttctcagcgaacgacgtgaccttttccttcatcttctggattctcagtgtgactgataaatgttgcaacatgctctgcagggggaaaatgctttagcgtctattactgcatcataatctcatctttggaaagccaggagcattttgaaaattacattacagacattgtttaaacatagtttggatttaccaaagcataggacattgtcttgtctgatgttaattagtcagctcaagattagtgctaaagacttagtaatttagttatttctcttagctttaaaatctttatttcagaactatttcacctcttggttttctttttttttttttttgctctgtgttactgcagctgctaatctgtgagctctcaatggatgatgtatcctagcaagggactgaatgagatattagcggcaaattatgttgatgattcatattttgaataaatggaatattaagcttgtatacatcttgaaaatagtactttaatattctactgtgtcgtagtcacaatgattggatatgaattgaatttttgtactttttaaatatgtttttgttctttatttttaatttttattattatttttttgagacagagtcttgctctgtcacccaggttggagtgcagaggcacgatctcagctcacagcaacctccgcctcccgggttcaagtgattcttctgcctcagcctcctgagtagctgggattacaggcgcccaccaccatgcccagctaattgttgtatttttagtagagatgggatttcaccatgttggccaggctggaatcgaactcctgacctcaggtgatccgcatgcctcagcctcccaaagtgctgggattacaggcatgagccactgcacttggcctgttctttagcattttaagttgcaactatatatccgtaaagtcttatttccacacaactgagacatgttttaggaagtttgctaaaagacccctggagacctttatcgtggtctcccttttgtcgtgtttcatttgcttgatcttttctgccctcctgcttttcagaaattaaaaggctaaaaagaggtgctaaatgttaaaacttctcgtgtagtctcccatgagactattaaaagtaatggcaaaagccacagttacttttgcaccaacctactaattctaagaaccaccaaaaaggggaaagttcttggaaagcagtaaaatgatatggacagttgggatgtaaaaatgtagaaaatatgtcattgtatgttcagtcatcccaagaccctagtgctgccccgatggtagggacttcttaatgagaattaacttttgctcaattttcagagaaatggaatgctcgcatcactgatctacgtaaacaagttgaagaattgtttgaaaggaaatatggtatgtctaaataggaaaattcctgtaatactttgttcatgagcatttacacaatggcgttactgttcatcatgggggtgatgtggacaagcccagcccagggctgccagtgaaccgtgccacactttcttacacgtctctcattgtaaggtccttagtagtgtctgtctaaatattagaaacagtctttgtttctagattacagtaaagctaaggaaaagttgtatttctatagttatcagctaacatttcttttaaacttccagcatggatatttgggaatttatttacatatttattacaaagctctggatcttgggggtttcattaaaaattatttttttaactgacagtttctgttaatctactttgttaaatccagtatttgctgagatccccctattgtctctacttttatctttttttttttttttttttttttttttgagacggagtctctgcattgcagtagtacaatctcggctcattgcaacctccgcctcccgggttcaagcaattctcctggctcagtctcccaagcagctgggactacaggtgcccgccaccatgccctgctaatttttgtatttttagtagagacagggtttcaccatgttggccaggcttgtctcaaactcctgacctcaagtgatcctcccgccttggcctcccaaagtgctggcattacaggcgtgagccacccttcccggccactgcttttatcttgatgtataactgagttgatgctagatttcaattccttctttgtccttttactattctgtcctatagccacctttatataatgatcaaagaaattcgcaatttgttattatcatttttattttttataaaatatttaaaatgatttaaaataaaaatcattttatttttatcatatttattatcatctgttatcatttttatttggatgactatttactttgccattaactagcaagcggtaaaattgtatgatatgcagttttaactgaattgctataagtgaaaatttaaatgcaataaaccatattgatggtatttgtgttaacaaacttaaaatgagcattttttcttcatcatgagtaatataacctacccctcaatgaaaatctacaattagagtaaatttgctaatgaattcagtaacttttccatatttttagtggtttacttaaggttctcttagtgtttctcccagtttttaatagcttacaccttttttgcccgtggttttttgttttttgttttgttgttgtttttttttttttgagatagagttttgctcttgttgcctagtctggagtggcacgatcttggctcactgtaacctctgcctcccaggttcaagcaattctcctgtctgagcctcctgagtagttaagattacaggtgcccgccaccatgcccagctaatttttgtatttttagtagagacaaggtttcaccatgttggccaggctggtcttgaactcctaacctcaggtgatccacccacctcggcctcccagagtgctgggattacaggcgtgagccgctgcgcccggcctcatgttttctattggttcattatgaagcaaaaacttcatagcatgtgctacctggaagcactgtaacctagtggtaagatcataggctctggggacacagtgccttgccacgtctcttctcctgtctgagtcttagtatcctcttttgtggtcatgagaactgaagatctatcctggagattgataagatagtaaagtgcttcacgtaatacctggcatacatgtaataaatgcttcctgtgtgtatatatatacacacatatacatatatatgtatatatacatatacacatatacatatatatatatatatatatacataaacacatatacatatatatataacacagtgaaacccccgtctctactaaaaatacaaaaaattagctgggcgtggtggcgggcacctgtagtcccagctactcgggaggctgaggcaggagaatggcgtgagcccgggaggcagagcttgcagtgaaccgagatcacaccactgcactgcagcctgggagacacagcaagactccatctcaaaaaaataaaaaaaaagttaaagagcactacagattcaatgatttattattcttttctacaaattgtgtttaaatgatatctctttctctttttgtccttatagctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaagtaagactcttggattcctgttgaactcttgtctcttttctgagtaatacgtcttttttattgttgaccaatattcattcaccactaggttctatgtgatgaagtttgagttattttatgtatttttatcttgcactttttaatttatctgggtccagcattgcatcagtcatgcagtgttggcattcgaagcatgaacagtgcccgcactggattggcatgcaactcacattttctttcacaattttctgctacttttgctaaagaacatagaatccacgccttgtttttaggcctgatatatatatatattttttttttcgagatggagtctcacactggaacccaggcttgagtgcagtgtcgcaatctcagctcactgcaacctctgccttccaggttcaagcgattctcatgcctcagactcccgagtagctgagattacaggcgtgcgccaccatgcctggctaatttttgtatttttagtagagacggtgattcaccatgttggccaggctggtcttgaactcctgacctcagatgatctgccaacctcgccctcataggcctgagatttttaaagcatgcgtgggaatatatgattgtttttatagatgtgcagaggaagatagtcttgaatgcaatatgacattaaaggatcccatttaagatttttgtaatatgcttcaaagacctgtgggttgcaaagttacctctttacttgtgaggatacatgctccatgaagcaccttatgagacaacttgcaattattagtttgctttttactctgtagaaacctcaaattaagatttagttgtgggctgggtgtagtggctcacacctataatcccagcactttgggaggccaaggcggctggatcacccgaggtcaggagttcgagacaagccaggccaacaatggtgaaacactgtctctactaaaaatacaaaaattgaccaggtgtggtggtgggcgcctggaatcccagctacttgggaggctgaggcaggaggattgcttgaacccgggaggtggaggttgcagtgagtcgagactgcgccattgcactccagcctgggaacaagagcaaaactccgtctcaggaaaaaaaaaaaaaaagatttagttgtgctcaagcatccagattatcttttcttttcaaaaccagccttactgactaaatgttaaatatgtactagtcgttattagtttgctgaatattacctagtgattattgagtatttattctcacctttcagacatgagcttctgaattcaacacgtgaagatttacagcttgataagccagcttcaggaggtaggtcttcaatctcgaggcagatcagaagattatgtgcaataattatttcacgcttaacattgatttcttctttatgttaccttccacatgaaataatatgtctctaactattaattatgtgccattacaggagaattcatgttgtcaaaattctaataatttctagaagaataaacgcatcttctttttattaacccattgtaaatacttataaatattgcatttatgggtagacagaagtaaaagaacaatatttgttctacttttgatgcaagatttatctggcataatgcattgaacagtttattattgaagtctacacgagtcaatggaacaagcattcattgaatgtccatgatatgcaggacataagaaggtttccttttagagcatggagccatttatatcatctcttaattgttagatgtattttgttttgttttgttttgttttttgagagggaatcttgctctgttgcccaggctggagtgcagtggtgcgatctccgctcactgcaacctcccgcctcctgggttcaagcagttctcctgcctcagcctccctgtagctgggattacaggtgcctgccaccatgcccagctaatttttgtatttttcgtagagacagggtttcactatgttggccaggctgatctcaaactgctgacctcaggtgatctgcccacctcggcctcccagagtgctaggattacaggcatgagccaccgcgcccagcctgttagatgtgttttaaaataaatagaaatataattgattttcttgcttgcttttgctctggagtggagtggagtgaggataaaacagaatggaatcaccctgttgatatttactaagatagaaggactgcagcaagatcatagccctaatcttcctgtagcaagtgttacctgctagctgttcctgaatacactgagttttgctttttcctagctctaatgaatgtttcgttcttcctctttttgtacagtgtcagcattgttttagaaataaatacattctagaatcttaggaataattttattattgtctttttttttttttgagacggaatctcattctgttgcccaggctggagtgcaatggcgcaatctcagctcactgcaaccgctgcctcctgggttcaagcgattctcctgcctcagcctcatgagtagctgggactacaggcgtgcgccatcacgcctggctaatttttgtatttttagtagagatggggtttcaccatgttggccaggctggtctcaaactcctgacctcaagtgacccgcctgcctcggcttcccaaagtgttgggattacaggtgtgagccattgcacctggccacgaatcttagaaataattttggccataggaaaaggaaaagttatacctcttattttatagtaataatgtttaataatcaagttattaaacccattaaattgagaacacttgtattactgttattttgacagtaaaggaagaatggtatgccagaatcactaaattaagaaagatggtggatcagcttttctgcaaaaaatttggtaagtctgttttttttaattaccccttcaactaaaatgtattactgagtaacatttttttaaatgttgttttattttaggaaagtaaatacagtgaataggactcagctttagttttccctgttttttttttttgggtttttttttttttcttgagaaggagtcttgctctgttgcccaggctggagtgcagtggtacgatctcagctcactgcaacctcctcctcccgggttcaagcaattctcctgcctcagcgtcccaagtagctgggattacaggtgcccgccaccacgcctggctaacttttgtatttttagtagagatggggtttcgccatgttggccaggctggtctcaaactcctgaattcaggtgatccacccgcctcagcctcctaaagtgctgggattataggcgtgagccaccgcgcccggcccccattctatgaattatctgtggaaagttatttcctttaaaatggcatgctcgtgaggttgaaggggtaaagaacattgatctggttgccacgcagatgaaagtgtagtcggaaatgtgttaccagtttgccatagccgatggaggagggtaattacggtcctgaacagttagtagcaaaaggctgcttccagatagtatttaggttgtgtcctctattgtccatgatgattttctttctctcttttcttcctaaggatattgaaaaacaaactttaatcttttaaagatctcagagctattaagattgtcttaggaccaggacacttaaatctgcccaaatctggctgttgatgatcggtcatctctacttgtctttgctgtattaagtctattcaatagttaataaatatgtttctagaaagagtttttttcaagtaaaacaaaattgacctgtgcctttctttggattgtactaaaatctgatttcaatacaaatgtagtctcccgaattgctttgatttttgtccagcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaaggtaagatgataatctgtagaaatagtttcagtgtcttccctgagaagaggttaatttgatgaagaagggccttttgtttaccttatgacttatttctattgacaatgaaggcattaatatttagattcacttagtgaacaaatattagtataagcatcagatgtgcaaaattgggtctaacaagaacactgtccttggggccttcatacaaagaaaaatgcactgaaggccaggcgcggcagctcacgcctgtaatcgcagcactttgggaggccaaggcaggtggatcacttgaggtcaggagttcaagactagcctggccaacatgatgaagccccatctctagtaaaaatacaaaaattagctggaagcggtggtgcaagcctgtagtcccagctactcgggaggctgaggttggagaatcacttgaaccctagaggcggaggttgcagtgagccgagatcgtgccactgcactccagcctgggcaacagagcgagactccatctcaaaataattaaaaaaaaaaaatagaaaaatgcaatgaagtgttattgagcgtttttaagggagaaggcaaggatggcacacccagctcggtcacttgtgcatccagaagagatggaaggtgtttcaagtgaaggaaatcatatgagtagggggaggaggtggcaaatatgcctgcgtatccacagaactcacccaccgtgtgtggagtgaggactgccacgtgggcgtggtggggttgcatggatcgacttgggtgggcaagtggaggaaggcctgagatcctacgaacacagaggcagtcacgaagtggtctcgaggcagatgcctctgaaaataatgtggatccgccctttagaaaggtaattctggcttgattttgaaggataacacaatggttagtttgggtgcagggttaggaacagaaggcctctctccactcattgacgggatgtggaagggtaaaccttccttactgattggggtcatgcctctgtgtgtttgttgggactgagttataagggataggaaacgtttaagatgctacagcgagctgcttctggctgtgctgtgggacagttcatgtaagattcagaaacagaattgagctggtttgggggaaaagtgactttcgcctgtttatcttaaatataggatgattttgaaggtctcacccgaatatctgaaaattgccattttcaaaataaactcgtcaccaaaatgatttttttttcactataaaatgaaggcaggatgaaccatatttataactaattggcaatgaacagctgtgtgagaaaggcctgtgagttgcttctaaatgctttattactaatatcaactctgtttctacagaccagaacttctgactcacagtaccactgaagttactcagccaagaacgaatacaccaggtaaactagttgtgaaatccttttttaaaaacacagatcagccaggctcggtggctcacacctgtaatcccagcactttaggaggctgaggcgggcagatcacaaggtcaggagatcaagaccatcctggctaacatggtgaaaccccatgtctactaaaatacaaaaaaattagccgggcctggtggcgggcacctgtagtcccagctactcgggaggctgaggcaggagaatggcatgaacccaggaggcggagcttgcagtgagccgagatcacgccattgtactccagcctgggcaacagagcaagactctctcagaaaaaaaaaaaaaaaaaagcacagatcaatactttttaagcttttaaaagttaatcttttaaaattatggaagtcccccttcccctgcctccccaaaaaatcatttgcagaagctcaatccagccactccttgatttatcaatgtgaacacctgcagtgcacagataactcaagctttgaccgtagaccactgctatccatgagaaaggcagtgtgccccacaaatgcaagccacatgtgtaatcgtccacgttctagttcagcctgtaatcattataaagaaatacacagggaagtatttcacggtctttatcccatgttctttatttgacagttggcgcgtctttcatactcacagcatatttcagttccaagtagccacatttcaaacatttcaactgctcggggatagtacctgctatatgcatttagaccttaatgtttattcatatgtatcgtgttcctaaaatggcagactgtaactctgacctgcacacaaatatcacagcctaatagggaagatctaagaagtctctgttcaatgaatgatgttattttctttattagagctctaagtgtgcctttatttctttcctatctttttttttttttttttttgagacggagcctcactctgtcatccaggctggagtgcagtggtgcaatctcggctcactggggcctccgcctcccgggttcaagcagctctcccgcctcagcctcccgagtagatgggactacagctgcacgccaccacacctgggctaatttttgtatttttagtagagatggggtttcaccatgtcagtctggctggtcttgaactcctgacctcaggtgatccacctgccctggcctcccaaagtgttgggattataggcatgagccactgcacctgacctctttctttttgtttgccgttgtgtaatgtcagaggaagtgaccacactctgtagatcatcagccaccttaggaacttctgttgccaagaaccaataaatgcccataccctgtagtgtgtaaatgcccataccctgtagtgtgaagttttctgttgttagaaataagtgttaggaatcaagtatgaaatttgtgtgtgtactaggtgtatacagattggtgcagttaatcatgctcacgactactaaggtgaacaaatgtttcaagttgggttcctgggtgtgccctaaaatacttctccttcagctctcacagcaccttgtggacatgagtgaaggtcagtcagtgtgccaaatagattttgtgtggattatggcatggaaagtggctgagaaattctgtagcagggtaacaaaattatcttggtccaggagtcctgtagtggagaagataaaagtcaatgcttaactcataggttaacctcagcatgcttttgatttggtcaagcaatcaaagtactggtgaagaattgaagattggaagtgacacattttttgctcagggaagtaatggagaaagaaaaatcttcctggaggtagatcttcagtttggattagtctgaacatgatgaaacctgtagaaaccttcatttctcaagacaaagctcaaattcaaggttgtgaggaatgcagtcaccacttttgttaggggcagttgtgacagtgagtgactgcaaaaactgagaatgcgaagcctctattgtaaaaagaatgtgcaagtgccatagaagtcactgcaaggattgggtgctggagcagtgccggacctgccatcgtcaccagagtgcagcagattcaccagaaggagaatctccactcttgtcgtcactaacagcacttgactttgtcccattcataaaagatcttggaaggaattaaaggtgcttggtggttcctcattccaacaacaccttacttggcctgcccgtggaacatgcgttagtctttggacaggacaactcgagtcacagaccacaagagaaaagaattttgtggccatcagaattgtctgcttaaacacaccacgggtgcacagtgtcctcagcttggtgaaagggagatgtcacacgcgagaaggcagcggagccaggcatgtgatggagtgggaggtggcacctggctctgtgaggaggctgtgaagtcctgcatgggaggagcaaggtgggggaggagggggtgggggtggggcagaagaggaggctgagcagttaatagaggcgctcgaccttagaggaggagagtccgaggtctttattggtagtattcaaatgtggttcatccagagttattttctgtggctgaatggcctactctgaaatccacagggaaaaaacaactcacattcaacccttgagatgctaagttttcttttaaagtaaaggaaatgttataagattttctgaaaccaccaacctttagcgatattgtcagaccttctccaacattttccactgcatttgtcagcaatcagagatgacctccacaccgaggcgaaccctccaccccccgacccgtttcctctttctctctttccctcctttgctcatccagaaacacttcagtcatcctgcattgtctccaagttgacctccatcctcatccgcacctcgtccacacctgaatactctgtccacatcagtgatattctacatgtctttataatagcttttttgtttgtttgtttgtttgttttttaaattttgatgcttaaaaggcaatggttgtcttagggataggaaaacacaccccactgtcactgtgagtgaagctgaataacgtctctaggtcttttaccattgctttcttttttttctgaagtgatttttccttttatgtccattgctttaagccattcgtgaaattgcacagtgatttctggagtggggacagaaggaaggcggtagtaaaagtcattggtgctgtggcccagttggctggaggaggtgcagggcagggcggcctgcgctggggcagctggaggagcacagatgtccccacgggcaggtggatgagttctgagagctggagggccggtacagtgtcctccatggttccagcttgtgggcttgatcaggccgtcacctgcggtggccactgagctggcgatgaactccgtggccttggagtcgccctcggcagagatgatggccgccgtcttctgctgctcagcccttgccaccacagatctggccctctcttcttcctgctgagccacctctttggttccactgcttctgcaaattccttcccgaaggtcagatccaaggtcacagcatccaggaggagcccaaaggttgctgcttgctccgaagttaattgctcacctgtctggagcccagctctccctgcgtgatcagttctccagcgtcagcctgagccgcccccagcttgaggagctccgcagtgatggatggcagcacattcttcattggcttctccagtaattggaagatgcaaggacctggccagcaacaaggtgggaagaggacgcccagtgtgatggtgacaatctttgctcacagtgatgattggtgcataatgtggtcaagagcagcagtcaaaaataattggtttcttttcccatgggatgagaaagtgcgttccttcccctatcacagtgtcctgaatgccatggaattggtcgaagatgacagacagctctctgtgcagcatcacattgtagaaggcagagttccccacacctcctgcagaagctaaggacagggcagacttggcagctgtgtttccatctgctggacccactcacgcctgcgtccactccaaccccccacatgaattccgtccctttatcattgatttctgatgcgaaaagtcactttgattagtgaagtgttgctttatgtagatttttaggcacacatctgttagataaaatgaggattgcctgtagagaaagcaaataaaagcaaagtccctcttgttgaaactggtgtgggagcccttgaacctcatgcagctggcctccctgctctgaccgagttccctgagggacttctccaaggaggaatgtgtgagaagcactgattttgagcactctttcatgtggacaaatttcactttatttacaatgtaaacttaaatttaaattctgtctttctaggctgggcacggtggctcacgcctgtaatcccaacactttgggaggccgaggcgggcagatcacttgaggtcaggcattcaagaccagcttggccaacatggtgaaaccctgtctctactaaaaatataaaaattagccgggcgtggtggcggctacctgtaatcccagctactcgggaggctgaggcaggagaatcgcttgaacccaggaggcggaggttgctgtgagctgagatcacgccactgcactccagcctgggcgtcatagcaagactctttctctaaataaataaattaattctgtctttctgcagtttttctgatatttggcaagtactggaaattattattttccttaagaccccaaattttcacaccaacatggcacatgtatacatatgtaacaaacctgcacgttgtgcacatgtaccctagaacttaaagtatgataaaaaataaataaattaattaatttaaaaaaaaagaccccaaatgtttgcttttaacaaaactgaattaagagaatcactgcaggccgggcgtggtggctcacgcctgtaatcccagcactttgggaggccgaggcgggcagatcacgaggtcaggagatcaagaccttcctggctaacaccgtgaaaccccatctctactaaaaatacaaaaagaaattagctgggcatggtggcgggtgcctgtagtcccagctactcaggaggctgaggcaggagaatggcgtgaacctgggaggcgaagcttgcagtgagccgagatcgcgccactgcgctccagcctgggcgacagagcaagactctgtctcaaaaaaataaaacaaaacaaacaaaaaagaatcactgcaaacaagagtactttctagcaaaatccattctgatttgcaacagcactgataaataacatggttattgggtttctttttgttttccagtcaaagaagattggaatgtcagaattaccaagctacggaagcaagtggaagagatttttaatttgaaatttggtaagtaaaagccagtatttatgtctttaataacatatcaacaaagggccatgtctgaatgaagtatagaagttcgggaccagccgggtgcagtggctcacgcctgtaatcgcagcactttgggaggccaaggcgggcggatcaggaggtcaggagatcgagaccatcctggctaacacgatgaaaccccatctctactaaaaatacaggaaaattagccgggcgtggtggcgggcgcctgtagtcccagctactcgggaggctgaggcaggggaatggcttgaaccccagaggcggagcttgcagtgagccaaaatcgcaccactgcactccagcctgggcgacagagtgagactctgtctcaaaaaaaaaaaaaaaagaaggaaaaaaagttcaggacctaaagaaggaaggtcccagaaactgggtttctgtttctttctaccactacacttgctactgaaaccaagcagatgacttcatttctcttggattccactttctcacgtgtcagaatgggagaggaagggaggtgttgggataagtttcagttccactgtttgtacttctcgtctggctaacacccatgtggcaaataggtttcatcatttgtttcagcttagatttgttgacagcggtttcctggagtgctgtcttgagaacgattctgaggaggctcagcaagaaagagtgtttcagttgattgggtgtgtctgtcatggagaaggaagtaaggagtgggcagtgctagcaaaattcccggggcacttctgtccattatctcaatacctggggttgacatttcctgtctcagatcaggagtcctgactaccctgcctctgaccactcgaactgagtgctgcttagctgtatcgtagacaccgcctgtttgtgaacagacaccctgcttcttgatgataacacaaaggccagcagggtccactgctgtgtggaatggccttcggtcatttctgcccagagcatagaggtcattttcactaataacataactctccttttgattgaaagtgttaaaatgttcctcctaaaagcacttattttttaggctcgttcttcagatttgccccatatcctaagcaaaatgccttcaatatgaagtggatattgcttgaccgtagggagcttgtccatactgtactcgagaatgtagacacaaagaaagaatgtctgtgtcaaatgttatcctccgcaacttaacgttctcttgcactttcagctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaagtaagttctttttgccactgtagtcgtttctggaatcaaaacaataaaatgacatttctgttaagatgtttttcaagctagaggtgacaggcgtggctgtaagtccttgatggcaaagcctggctgtgagctgcagtccgggtactgtccattgcccctgcccatactcaatcatcttcatccgtgcaaggaaaatagtgacaatcgcctccgcggagtcaccgtgaggccccgtggtgactcgcagcatgcctgagtacttgaatggaagtttaatttgctggtttttatctgctctgttattcctggtcaatcttgagagcgactaaatattgatgattgagtttctttcttttttttgagacggactcttgctctgtcgcccaggcttgagtgcggtggcgcaatctcagctcactgcaacctccgcctcctgggttcgagcaattctcgtgcctcagcctcccgagtagctgggattacagacttgcaccgccacgcctggctaatttttgtatttttagaatagatggagcttcaccgtgttggctaggctggtctggaattcctgacctcaggtgatccacccgcctcagcctcccagaatgctgggattacaggcatgagccaccgtgcacggcctaatgattgattttcttatctacatttctgcagaattttagtggctaaagaaagtacactagtgttttttttttcttttttaatgaaaatagtcacttatttactcttcataaaatggcttaccagtcatgggaaggaaaagtcagggtcttttgtccacaacactaggaattattgtgttacaggatgattctgtgaatgcctttagaaaaaaaaccctgatcacatcacgaccgttttactagctgtgaggccaccactgtgctggctactgtaacacttcttggttttctttctagacctgaactagttatttcctacttgcctcctgggatggctagtaaaataaacactaaaggtaagagacgacgtgtactccgtatcctatttgagcgcattaagacactctttatccgcattccttaaatcatacggaatcggccaatatctctgtggggcttggagttgtttactttgctttctaaggtattttatttaatggaactatttttctttttttttttaaaaaaaacaaaacatttcattggaaatgtcacatttgcaatcccagttcattcatgttttcacagctttgttgagcccctgtggaggattacactacaagtttaattctgcaggtttctttgaaaagaaccaaactgtatgaattttaatactctgctcttataaagcatctccttctgtatttttttttccctacaatatacaaaaggaactctgcttattttacagctttgcagtcccccaaaagaccacgaagtcctgggagtaattcaaaggttcctgaaattgaggtcaccgtggaaggtaagggccagtcctcggtatgtttctgttcattctctagttactaattatgtcagttcactagctatgtgtttatacaggtttatacagatgacgttaaccaaactagcttttaactgtgaacagctgcctgtgataaagctaaatttctgaatgcttctaattgaaaatttttaaatccttaatagaaaacagataacatggatcacatcataaacttcccccaagaaaagtcctaaaatgcttttcctttatcataacaaataagggtgcagagtcatgtggaatgttttatcttttttttcctcttcatttttttctattcttttaaggaaagaaagtttagggtggtttaaacagcagtgccttgaataaaagtattttctttttcttttttgagacagagtctggctctcttgcccagggtggagtgcagtggcacaatctcggctcactgcagcctccgcctcccgggttcaagtgattctcctgcctcagcctcccaggtagctgggattacaggcgtccaccaccaactccagctaatttttatatctttagtagagacggggttttaccacgttggccaggctggtctcgaacccctgacctcaagtgagccaccacgcccagctggttcttgtcttttcaggctcacagtgttaaaatactgcatacaatactaaagacaatctccaaccaactgtcaagtatggatatttcttccatctcttcataaatgcagaaggaaatcactgcattaggatcattctctacatcccaggtgtcaagtttttaaataagagtttgccgtactggtgttgagtggcgcagaagtccctatttagtcatgtggcacactttcagagagcctgctttctcataagatagccaacaagcatccatggacaacttacacctgattaattatttctgttcaaaaatgccaagaattaaaaatatattgaacccttgactttcctccttccggaagagatcagaggaagatctctcttatatacaagatgccagcctttcctaaagggcagagccaagttcacggggcctgggaggcctgctttaagaatacaaaattagggccaggcgtggaggctcacgcctgtaatcccagcactttgggaggccgaggcaggcggatcacctgaggttgggagatcgagaccagcctgaccaacatggagaaaccccatctctactgaaaatacaaaattatctgggcctggtggcgcatgcctgtaatcccagctactcaggaggctgaggcaagacaatcgcttgaaaccaggaggcagaggttgtggtgagccgagattgcgccattgcactccagcctgggcaacaagagcgaaactttgtctcaaaaaaaaaaaaaaaaagaagaagaagaagaagagaagaaaaatgggtttctgtagaaatagaaaaatggtttctgtggaactcgccggaatgacaagaatacccatttcaatttgaacctagctttgttttctggcacaggctggacttgaagattgtaacctagagacacttacgtcattaaatgtgtgttgattatcattattttttctgtcttttaggccctaataacaacaatcctcaaacctcagctgttcgaaccccgacccagactaacggttctaacgttcccttcaagccacgagggagagagttttcctttggtaagtaagcgttttatttttctttctttcatagttttaaatagaatacgttcattatgtttcattttaccaggtgaattgttcctattggtgagtcagtatatatcaaaggttaaaggaatagcccgtagagccaggctgcctgagttcagatctgagttcaaatccgatgccacttgggcaggcgaatacaccctgcctcagtttccctttgtgcaaaatggtaataacattactttctttctcatgaggttatggtgaggattataaatactgtcatttaaagtacttagaaccatacctcgcatgtagtagagactataatttgtgggggcattttgggggttttcatttgttttttctttattttagcatttgttcacttatttgtagtcaacataaaagcaatgtactaaaacagtttgcttatgtatcaggatgggagtagttgtcaagtcatatcatggtaaaagattatgcattttttatttcttcttaaagatgcacaaataaggccaggcgcagtggctcacgcctgtaatcccaacactttgggaggccgaggtgggcggatcacctgaggttgggagtttgagaccagcctgaccaacatggagaaaccccgtgtctaccaaaaatacaaaattagccaggcatggtggcgcatgcctgtaatcccagctactcaggaggctgaggcaggagaactgcttgaactcaggaggtggaggttgcagtgagcagagatcgcaccattgccctccagcctgggtaacaagagcgaaactctgtctcaacaaaaaaaaaataagatgcacaaataagatgaaacactcctgcctgtgaatgtgtattgataagtactgtgataagtattgcaatttaactctcttatgttttatatgcagaggcctggaatgccaaaatcacggacctaaaacagaaagttgaaaatctcttcaatgagaaatgtggtaagtctattttgaaaccttcttactgccacgcagggtgccttcatgggagtaggagggagcagagtgggatactgagcgttggagtatccctgtcattggcaacgtgtgggtttttcgggattgaatggcgtcatttcgcccatgttctgtttcgtgtacgcggctgttttgcaggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagtaaggaaactggatgaagtgggattagcatgagttgattgtgtttgacactgggagatgggtatgtgggtttgtgtttgtggcagggctgaattagctctggagtcagaaaaactgctttttaagctgcactcttgtatatgtttaaaacttctggccaggtgcgatggctcacacctgtaatcccagcactttgggaggccaaagcaggtggattacctgaggtcagaagttcaagaccaacctggccaacatgatgaaacccatctctactaaaagtacaaaaattagctgggcgtggtggcacgtgcctgtaatcccagctacttgggagactgaggcaggagaatcacttgaacccagcaggcagaggttgcaatgagccaagatcgtgccactgcactccagcctgggcagcaagagcaaaactccatctcaaaaacaaaaaaaaaaaaaaaaaagaagaagaaattttccttatgctgctggtagaagggaaggaggactccaccatactagagagataacgacttttggttgctaaatctacacagctatgttgttactatttgatgctgctggaatctgagcagctgtttagtttttcaagtccttttatttctccaacttaatagaatattttcaatttctcctgtttgcttgaacatctgtggattaggctaacataattgaaatagataggaatgggccgggtgcggccataaatcccagcactgtgggaggctaaggcaggcagatcacttgaggtcaggagttcgagaccagcctggccaacatggtgaagccccatctctacttaaaatacaaaaaaaaaaaaaaaaaatagccaggggtggtagctggcacctataatctcagctactcagggaggctgagacaggagaatcacttgaacccaggaggcggaggagatcgtgccattgcactccagcctggatgacagagtaagactctgtctcaaaaaaaattaaaaaaagaaataagaataattggaattttatagtacatgctaatgcacatgaattatttgaaatcaattgaaatgaattttaggtttcatttgcttggtgtcaggcttaattttgagtcacccagggatgctctcaagcaaagctggccactttttttttttttttttttttttttttgtgagacagaatctcgctctgtacccaagactggagtgcagtggtgtgtgatatcggcttactgcaaattccgcctcctgggttcaagcgattctcctgcctcagcctccaaagtagctgggattacaggcatgtgccaccatgcccagctaatttttgtatttttagtagagaaggggtttcaccatgttggtcaggctagtctcaaacccctgacctcatgatccgcctgcctcggcctcccaaagtgctgggattacaggcgtgagccaccgcgcccggccgccaccttttatgcttttggccaggtctgcagaggtttggcagcctctaagccctctgcttctgcttccggagtgagagcctcaagtgctcctgttttcacagcccatcttgtgtttccatgctgcgtttgtggggcgttttctctttccatcctcaattctggcgctgattcttttcaggatacattctaaccttggaaagaagatgccaataaaaccagtgtaggggaagggcagccaatgagaggcagcaatggatgttaaatttacaattgtggtttgtctttttggctgtggttctttagataagcatgtgatttctgttcttcatgactaagaattgaatttagactttacagagttactggtttgtaaatctttgagttgtttaaattttaatgttagagttttactgtttgatcagcacattttttttctcttttgtctataggcccgaaatgtttgagacggcgattaaggagagcacctcctctaagagccctcccagtgagtgtattttctgtattttcattgctatagaacacacgctcttaggcatgcattgtgcagctgtggtttacaaacattgtttaaagaatagccattgaggccaggcatggtggttcacgcctgtaatcccagcactttgggaggctgaggtgggtggatcacctgaggtcaggagtttgagaccagcctggccaacacggcaaaaccctgtctctactaaaaatataaaaaattagccaggcgtggtggcaggcgcctataatcccagctactcaggaggctgagacagcagaatcacttgaacccgggaggcggaagttgcagtgagccgagatcgcaccactgcactccagcctggacaacagagcaagactcatctcaaaaagaaaaaagaaaacccattcaaagttgtagttcaggctatttcacaatttttagttatttaataattgggtggctctgtgagtgtgtgatgatctcctaagtacccccaggaagagaaaaacagtgaaaggcagcccttcagggggcatcatgtcttcttgaaatgatctaccatggaaagaaagaaccttgaacaggactgagataaaacagtctcagacagcatgattattagagatgttgaccgtgttttctacaaattctgattttaaatgtatattttcaggaaaaataaattcatcacccaatgttaatactactgcatcaggtgttgaagaccttaacatcattcaggtgacaattccaggtatgagttctctgcttccatcagagtttttgggggtctcttcagggcctcttggactttcccaactagagaggtttgctcagctcatccggggactcggatacattacacgttgcctggtgctcctcccagactcctacagcagttgccttccaaatacagttgctctccaaacagcaacggcaagttttggcacttggcatgagctaaatcctgttaaccacccaaatggctagtctgttccttaaaaaaagtctatatgagaccgggcacggtggctcacgcctgtaatcccagcactttgggaggctgaggcaggaggatcgcttgaggtcaggaattcaaaaccagcctagccaacgtggtgaaaccctgactctactaaacatacaagaaaaattagccaggcctggttgtgtgtggctgtaatcccagctacttgggaggctgaggcaggagaagtgcttgaacccgggaggtggaggtcgcagtgagccgagatggggccagtgcactccagccttggtgacagagccatactccatctgggaaaaaaaaaaaatctatataaaacagcaggtaaaggtctttataacaagaataaatttgtagcatttttagttaggcattattttaaacaatttcaaatttaattagctcaaagtgctcaaatacttaaatcattaaaaaatggaaaatgcttgaaaacattacacagagctcctaaaaattgggattaaaagtgcatcattgagcagcggcttgtacctgtagtctcggctacttgggaggcttaggcaggaggatcgcttgagcccaagagttcaaggccagtctgggcaacatcgtgagaaaccatctctttaccataaaaaaaaaaaaaagcagtatttaagttttgggttttctctgaactgtttcagatgatgataatgaaagactctcgaaagttgaaaaagctagacagctaagagaacaagtgaatgacctctttagtcggaaatttggtaagttttgcatttgcaaagtacagttgctataagcaaagagatttgttttaataagatcttttcagcagatgatggttggatggttgtaatcctatataaaaggagttaaaatttaaaagtgagttgtttgtgctaaatttatttaataagataccattagtgttacactattgattgtcagtatgaaagttaatgaatttaaggttcaccatctggcagtgtggctcacacttgtaatcccagcactttgggagcccgaggcaggtggatcagttgaggccaggagttcgagaccagcctggccaacatagtgaaaccctgtctctactaaaaaattcaaaaaattagccgggtatggtggtgcacacctgtaatcccagctactcaggaggctgtggcacgagaattgcttgaacctgggaggcagagattgcagtgagctgagatcaagccaccacactccaacctgggtgacagagcaagactctgtctcaaaaaaaaaaaaaatttaaggttcatatttaaatttgtttgaagtgtacaaagaccttagttaacagcagagacagtctttaaaataaatgttgatcttgtgcttttgacaggctgtttaaggcggtgggttaatctgtgctgttgtgctgtttgtctcactgtccctgtaggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattaggtaagtgagagtttcctgcttagtcacaggagcgaatctggagctcatgaggctgactcttctaaaatgcagccacaggtagtcatcgaatccggcttcctatgctgtgcaatcaacaaatcaaaataacttgtgtcatcattagaatgtcagatgtgcttctacgaactaagctgactcttttaattctttggcaaagggttggcaaactaggactgtttgccaaattcaggctgcctcctatttttagagtcttcctgaaacacagctacacccgtattatccatggctgctttcctgtcacagtgagtaagtagctgggactgagaaggcatggcctccaaagtctaaaatatttactctctagcactttgtagaaaaaccttagctaggcacagtggctaacgcctgtaatcccagcattttgggaggccaaggcaggcagatcacctgaggtcaggagttccagaccagcctggccaacatggtgaaatcccatctctacaaaaataaaacagttagctgggcatgatggcgggtgcctgtaatcccagctactcgggaggctgaggcaggatagtcgcttgaacccaggaggtggaggttgcaatgagccaagatcatgccactgcactccagcctggacgacagagtgagactccatcacaagaaaaaaagaactttgtcaacctctgtcttagggcgccttgtcacaggcttcgggtcagacggattcaaccttgcatcagccatttgttagccaggtcactctgttctttgtctgtaaatgagattgatcgttgttcccactgagagtgtcagctccttcccgtagagcaggcatgatgattgtactcacctctgacaccattgtgagtgccacattccttcccacgtccttgtcactgtaagagatgcccacctgagcaccaaccccaggttatcttcccctttgtcttccagccccccagaaacagctacgactcaacctacccaatcatttcatcatcagattgccactgtctctagttcaggtctcttgggactggcactcagaaatctcataataaatcctcttgaggcttctcatacactcgtcttcttccaatcttctttccctcaaaatctcatattttggttccacttcacccaccgtcattctccatatcactcccaggagttaggcaaaaagccccttccgttcttccgtatgttaaacttagaatcactctgttccctgctctgcgtttctattttttgtttttcctccatttactagtagcttaacactttctaacagtgttcttattattgatacgtatctatctcttccataagcttataaggtcacggataatacttctcattgtagtacgtaaatgacgtgggctagatatgagttgaataaacagttatacctgtaaattcttacagagtgaaaataaattgttatactttacaatttgtttctctctttagaccatttccaggacttgtgattaataaccgtgagtattttgtgaagtgttttgtttttgttttttcctggggtctgacgtgtgtgcgtgtgagtgtgtatacatgcttaacgtatatcacgttacttcacctatgtcagtaaccaggccaaatacttgttttagccctcagtaaaaacaccaggcacttcctagttgtaaaattattcaagcttcttaacttcctatcctcgatgcacttaatcataaaatggtaataatagcaccgattttgggggagtcgttccagtagatggaaagcatctggaacaggtgtcagcaagctcctgccgacgtgtatgcataaagttttattgaaaccaccatcgtgtccatttgtttatggcagaactgagagatggcagcagcaagtgtgtgcctgcaaaacctaaaatatttactaattggctctgcaagaaaagagtttgcatccccctaacctagaacagtgtctagcctctagtatgtgtttagcctacagtatgtgctcagcgaatacaatctatatttattactgcttttatgactgttataattactgtgcttggatttcgttacaaagtaagtcacaatgtgcctgcttctgttagtatttcagcacagtgcctggcacacatggggctctcaaatattgctgagcgagtgaacaaatgtcctttcaattccttaacgttgatgtcattttcaatagtattttgagccaaacttaattttgcgagtgtgttttgttttcttaactttattattaaaaatgtataaaagtgaggccaggcgtggtggctcacgcctgtaatcccagcagtttgggaggctgaggcaggcggatcagttgaggttgggagttggagaccagcccgtccaacatggtgaaagcctgtctctactaaaaatacaaaaatcagctgggtgtggtggcgcgtgcctgtaatcccagctactcaggaggctgaggcaggagagttgcttgaatcctagaggtggaggttgcagtgagctgagatcgtgccattgcactccagcctgggcaacaagagcaaaactctgtcccaataaataaataaataaaatgttctcttttgttcctgttcttgtgcggtagtgtggtatagagttttatggtaattactgtgaattagtgattctgagggacatatcagaactctgaggtttgtttccttctcatcttgagggaaacagcaaatgtatgttaaaatgcttttccaagggaacaacacatccttacattatttaaaccaatctgcttcattttcagagctggttgatcagagtgagtcagaaggccccgtgatacaaggtgagcgaggcaggggagggcccggagctactcctgcctgcacagtggcacacatggcgtgcctgcgtgtggcttcggctctcagtcacctgccctgaggggactcagttacacagcacacacatgcttctctgtggttttcactcctgggtttgacagctgatcaaaacataaattcaagctgtgggtcctgattgagaactgggggctgcagaccatttgcaccccctatcccagctcaggcctaacatcaggaaccccaggattaatgggtaggatgaaatggcagagcaagagggccgtcactttaacctgactctgccatccatttctaatgtctgccataagtcagtgagcaaaatgttcttcagtagaaatgtacagattgtgctcttaaaaaattccttaaaaaacaagtggaatggcctggtgctgtgtgagtcattgaaagtaatgagactgggcgtggtggctcacgcctgttatcccagcactttggaaggctgagaagggtagatcacttgagatcaggagttcgagaccagcctggccaacatggtgcaaccccgtctctactaagaatacaaaaactagccagacgtggtggcgtgtgccggctactcaggaggctgaggcaggagaaccgcttgagcctgggaggcggaggtcgcagtgagccaagatcgtgccactgcactccagcctgggcaacagaaaggagattctgtctcaaaaaaacaaacatacgaagaaaaacaaaaaaagtaatgaaaagcttttattaaagggagtaaacagaaggataagggagaaagcataactaaggagcttgttttcatggtagagctatgttaagactctgctctttcaaacttcagttgtatatgtgaacttaggaccacatttgaaaaacagaaatttgaaagtacacttggataatcgtgtgctccatctcaagaccgtgagcattgtttcatcatgcacctgtgtttgtacagagtctagagggcttttctcctcttcctcctcctgggttctttacatagtataaagcagctgttgaacaatgtggaaatcagtctctgtgtttctctttagaatcagctgaaccaagccagttggaagttccagccacagaaggtaaaagggtggggtggtcctgcaagtccttaagacttcttctttcttcttcttttttttttttttaaagacagagacttgctctgtcacccagggtggagtgaggttgcgcgatctctgcaacctccgcctcccgggctcaagcagttctcctgcctcagcctcccgagtagctgggattacaggcctgcaccaccatgcttggctaatttttgtatttttagtagaaacggggtttcaccatgttggccaggctagtctcagacttctgacctcaagtgatccgccagccttggcctccaaagtgctcggattacaggcgcgagccaccttgcccagccaagacttttttatcaggacaaaggattgtgcatttaaactatttcactagaactgggtggtggttttgctctctttcttctgggtgaattggatttgcaggttatgctgttgagtgatgacgcatagctgcttttgctccatttcccccagatgacttggtaaattctccgtgaatgactctgctacataacctagataacctaacgtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctagggtaaatcagcttctgtgtcagggatgctgtgtggtgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggatttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaa

SEQ ID NO: 37459 - DNA, 211183 bp, Homo sapiens
cccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagaggtcagaggccctgcggggcggggatctggggcctcgcctcggggtagggagccggctggcgcggcggacgctgcgggtgcatctccccaggtcccaccgcgcgccgcctccatcccccgcgacgctcctcctttaggcgcgcggggcggaggccgcattcggcgggcctggcgggcgggcgaggggccaggcggaccggggtccgagccctcgggatgctagtctcggggagccccttcccagcggttccttcacctgcagggcgcagccgagacagaggttgctgaacgactgtttcttggctttccgtggaattgaacatgggagtaagagaacaatttatcgtttgccttgcgtgttttggggagttgaaaatgagccaaagtcagggaaagtgagttcctgcctaaccagcagcgtttcagagcaactcaaaggaggtgaaaatgggggcgccggggggcagggggagggaagaagttgggagtgatttgaatgctctcagaaattattttaaatatttttgcttgtatgtagctttcttaatatgcgttgcagttgcctttaaaatagaatgtcatgaaatactgaacgagcgtctgtatttttaccacttttacttaaaataaaaatcgattggatattcacctttctcctcgtccgtgtgcatatccagcagagagaacagatttttaaatctgtttcgtctcatatttcagtgattcttggtttcttttatacttcctttgactcatatttgggatattgaaactgcaatacacatgtgtatggaatgtgagctgtaaacttcacttgaagtgatttagactctttgttttctgagatcttcagatcatgcattcataatataccaagaaaatgaatcagctatagtcaaagaagtattttctttatagcacttgtcactatctgaacttgtcttattactttcatgtgtgttgtctttggctcattctctctgtatccccagctcctagaatgttcctttcccataataggtgctcaataaatatttgagtagtgaatgaatgaatggatttaaatggggaaagtagtgcattaaatccattgcacaaatttacattctaaggactaatatttgtattctaaaagtaaagatgtagacacagtttgaagttcaatgcaagcatattaattcacctttgacataagtgaaagtttgtgttcctttttcacttgttcttaaatgtcacttacttaaacctgcagagggatagattaattgcctcagccgactgaggctactcttttttaacatccctaaatgagaatgggttcttctcattgtgcctctaagggcactaagcagagaaagctgatgaacaactttaatgttagttgttttcaaaaggtttctgtagctatttgccagagaagcatgtcttcgttccatttcatttttgtgtttatgaggagagggctgattgcatctgagggaagtcactttatatggcctcttattggtgagaactaatactgggaaatgtgtctcacgtttctagacctaccccataactatttgaagcattttaacaggcaagagataggtttagaaaatgcagtaacttaaattaacttctcctgactttcatagtcaggcattttagaacaaactctgcccatatttgaggatctacagccttttaagcattttacacgttgattctctaatagtcatgaaacagacatagtatgtaaaagaatatgtaaaagggaggaatgcccgtgatacgaaaacaaaagttgatattggaaccctgcatgtgacgtaatgagtattctttatccgcatatccgcaaccttttcttttttttctccagtagatactgagttcttactgtgtgccagatagaaggcactgggtatggaaaccatttccttccatcaccctaaacagttaaagtacagtgtcgtgtatagtaggctgtactcgaaagataaagccggcttttcttttaatgctgtttacctggtcattaaagtacggacgttgtgcgaaccatttccttctactgggaaaatcaaagactttttagcagtgtcatactgtgagacccatttagtttcctgctcaaatcatacagatgaggaaattaatgcccagagaagttgccgagttcattgaaggttgtttagttcatggaaactcaactaattactggaagaaccgagactaagaacccaggttttgttattcattttgccatgcttgaattttaggttctctagtatgtaattggagttgaactagattatcaagttttcttctggctgtctccatgagtactacatttaattattggagaaaactatgcttttgtcctatcaccaattacatttcccttgacaaaaattctatttgaaacactatttgaaattttagtttgagaagaagtatatgtgttcaaatagtacgttttttgatatgtcttacattgagagtcagaaaatgacggcattggtcacattaaacattattatttcttaagttgttgtgtaaacgtatggggaaaaaagaacccagtcatttgaaacatgcattttagggaaaaggtgatttcttttttttttcctggccaaactttatcttggtggtttttttgctgaaaagtgatgtttggaagctggaatttggggaatttatatcacagatttttaaagcaagtgtctgctttttattttcttcagcttaagctgaaaaatgataaaatggttttctacagagttcaattttacttttttttcagttttactctttataatataaaagaaacatgaataaattagacttcctacctttattttgcatatagaactggacttgcatggccagttgggcccaggggaagcctttttcaaatttattgatttgaaaatagtttgacaaagaaggatcatgatgtccttttgggcttattttgtagacactcgtatgtgtaatgttttctgtttgtttgtttagtttttcccttttgagtatcaccccttaactccctgtatctcctagcagctttccatctccctgtttattttgtctgggtgtcctgctactacattaacttttgccactaggtgtcactgtagaatatatcccccttttagtttgaagcttggggttatgtaacagcaggttttaattattatttaatccgtctgtatatactcaaaactattgatagataagcacttaaaaactcttagctactttttaactctctcaaggtgtctcagtagattgagcagcctttttgtttaggcttaattagaatgaaatatattcctgtactgcctgtaaaacattaacagcttcatttgatgagtatttgtcatttagaaacacacttctgagtttagtttagcttcctttttctttctactttgagtgtctcttagattactaagtaactgagggattcaatacactgctgattgcattgtggagcccttgaatgaagaggccctagcaaaattttctttctttagccaaagaccatcagagccaattgcttaatcctccattactcattctaagatgaaaacataggaggaccataattcttccactgcaagaaccgtcagctattttgtgttcagttcaacagcattttgtccatcctgaccaaatcatatgaaaccaagcactaaataatgttctgagggagtttatgaacacattttccagagaccagttaacctctggtggtctgtggaagtgaaagttctatattttggactatattttagtcttgctttaaaataatctgtctcatagagattattagaaaatgaatgtatgacattttcattttcagccagttatcaacagaggaacttggataaaggctcatagggtctatccatcttgttgttagttaatatcagatacttagcccctgagctctctggttccaatagaaaaacccttttctccagaaagctagtgcagtttgggagaaggaatatgatgacctggatcatatctgtgtaagaatcagaaccaagaatcgctaaaaatctctgttcccagcctccttaaatgtaaagaattattatctactttcttttcagagttttgatatcactaatgctgatttcatatggctttgtgtttctcagttgtttccgttaaagtacgtctaatagtaggggtgagtgcaaaactttggagactataaaagtgtagatgtcatcaggccattgcatgctttgacttttttgatgatttattcttatttatttatttattttcatgttccatagcatctttgtgttaagtaaaatgtatattcttgagatagagtttatactatgctttgaggactgctcgatacatttctctcagcttctggaggtgtaagtatccatttgcacatcaactttcaagttggtgatttgcccttaatggctcagaaatctgtaacattattttatcttacccaggctcagatatatttagtcttttgaggtaactccagccactgttttaatatcatgaaaatatgcagcttagtttgtggcttggatacttccatatcacctctaaatggcttgacttcattctgtaccaaggtacaaaaatgtttttcaaatgaacttctctttaataaaccctgtatgtacatataacctatgtacaccccacctaaacctccggggaaaagcctcagccatctatcgggaaatgtggaggtgcaagggctgcttgcttcattatctgctgccagtgtctgctctgcactgcacatgtgggtgtgatgagtttctctggttcggtcctgcagctctggccatttttattagaggactaaggattcaggatgttcttttcttccctgtgtaccactgtgggagtatagtctggaggccagtgctttaacttttttttaattatactttcttctggtactgctgggagccaagatggtattttcttgttagtcattatttttaaaattttagtattttattcccctgatgtgagggatgcttcaggcttttgtcctgcatttgatctttgtttttcagggatgtgtcttggttacctttggctgatgtggttatcttttaacggcaaatcactgaatgtaattcagttcctatcaaattggccacagctgaggacaaatttggtttagataacctattagactcaaaggaaatgttgagctcccttggtgaataactctttttaaaaagaaaatcatcttttgaaggatctgggctattcggccccctgtgagattcaggtcacttgcctagtcatgtgactgtcatcatctgccgtagatactatgtgtgctccagagcggagagcattggtgaattgacttggttgaggggtggggggctggggggtgggagtggttgctgtccagttatagtcaggtttccaagggcagccactatctctgtacttggagaaatgccagcacttctctcctacatgtgtgcccacacgttgaacccagtgactcatcctgtacttaagaccccaaggatcagtcttaaatttaaagtaggagaatatcctttgataattttatttcacaaccagcattgttgtaactgccttttctcatattttacataggtttgacagccatttctaccattccatagtgcagagtcactattattttgttgttctatcctgtctgtaacttctttttcttatttattattcttctaatatacagtttttgtccctatctttcacaggctgctttcaatttcaattttcttggtatactggaaagactcttttggtcttagtttcacttgtaaattttatttaggacacttaattttttgacttacataaacctcaaaatctgtgttgtaaatatttgttgaaagaatatctagcatttaactacttttccattctttgaatcaagtcaatttgtataagatgcttgtcactgagtttttgtaagttgtttcatggatttgctttttggcagagagctagttctctaacctttataataaaaatatttctgtgtattgctctttaaaattgtatgtatttgaaatagtacatatttaagcctataaataattgtagagagtaatgcagtggatgcccatgtactgaccatataggcgaagaaatgaaacattatcagattcctagattttcctctcctgtggtattccttcctaaccattgttaaacattttatggtagtcattatcataaatacaggtatatatgcacaaaataatatataacatgtagcacatacacattatgtatccacacatgtaaactgtatctattattaaatcaatgtatttgaaaactgcccaggaagtatatctatatccctatgtgtagaaatatacctatacacacacacacatatatgtatatatactgtatagcacgtattaaaagttttgtgaacaggcttctacttggcatactattttgacagcatttgtttgaaattcctccaaactccagttctttattttcacatatgtagttctacaccatatgaatatgccttgcttttcatttagccatcctatcgcaggccactttttttctttcaaataatgctgccctgtacatgtatgtgcctatctctccccatgcatacatgtctgagtgtttttctagggcataatctggaattggaattgtgggtcatagaaagtacacacattagactttactggatattgccattttttaacccccaagtggttgtatcaacttacagttctgcccctaatgaataagagcttgttctgtgccatcatcacattgtcaacatttggtgaagtttaatatttgccagttgagtggctgtgaagtagtacttgagggtttaaacttgcatttttctaattactagtgaagttactggtaagagtagccttgtgtttcctcctttgaattgcctgttcgtatatcttgcctattcttctgtttttgttttgtatttgtagtattgataggtagattttttttttttaatatcctgaaccttttgattatttttgataaaggacttctcctagtctgtgtttactcacattttcattttttatggtatacgttgttgaacagaattttaagattttaatatattaatagaatttttccattttgtactttgtggttcacacctttatactttttgtaagacacataacacagatgttatgaattattcttgtattttcctctaaaagatctgaaacgttgcttttttacatttagatctctgaaccacctggtgtagcattttattgtatattttgttattagggatctaattcagtattgttttttaaaaagggccaatgagaatgtcctgtactgttagttgatttgtcatctttttaccgtagtctgcagcatcacctcttgtgtatgaatacgtcgggctctattttgttccaggcatgtagaagcaacaccaaactgaattgctcactatagctttgtaatgagtccacatatctgatagggcatgtccttctaccctgcctttttcactattgtgtttgctgctttgggacctttcctcatccatttctctagattttagaatctgcttatcaaatatgttcatgaaaaatatttgagaatttttactggcattgtattgaatctatagaacaatttgggacaaatacagatgtttataatactgaatcttcttatacatgcacctggccggctggcctgctttctcttctttcttctttcttttttcttctttcttctttcttcttcttcttcctcttcctccttcttcttcttcttcttcttcttcttctttttttttttttttttttttttttgagtcatgacctcgctctttcacccaggctgcagtgctgtggcagccttgacttcccaggctccggtgatcctccgacctcagcctccctggtagctgggactacaggcatgcaccaccatgcctggctaattttcttatttcttgtacagatggggttttgccgtgttggcctgtctgctctcaaactcctgggctcaagtggtctgctcatctcgacttcccaaagtgctgggattacaggtgtgagccctgcacctggcctataatttcttatgtatttaagtctgacaatttttataatcttatttgaaagtcatatacatcttttattagattaagtctgggtactttgtattttaaaaaacattttcaatagtatttttaaattaacattttttaatgaaacttaaaaaatatgtatccaaattgaaagagttctgtaatgactccaccatgtagatgctacagcggttaacattttgatagatttgctttgtcatgtctattagtcaatcttattctttcatgcctttcgaagtaagttgcaggtattagtatatttcactttcataaacatttacatgtgcctgtagctaactagagcttagcatttgtttttttttccctctgaggtaaaattttcacgtagtgaattgcacaaattttagtgtctgatctgaggagtttttatatccatttctacctttgtaaaacaataacctattaggatagagaatattttcatcaccctgtaaagttctctcaagcccctttcttgcgtccacctctgccaccagaggcagccattgtactacattttttgatcatagattagtgttttctattctagaacttcttttgcaagtacttttttttgtaaagtctcctttcactcagcataatattttttagttcgtttatgttgtgtacacggtcacttgttcctttttattgtcaaatagtattccagtgtctgactatagcacaattttttttaagcttttattttaggttcaggggtacatatacaggtttgttatatgggtaaattgcatgtcacaggggtttggtgtacagataattttgtcacacaggtaataagcttaatacctgctgagtagcttttttgatctgcaccttcctcccaccctccaccctcaagtaggccccagtgtctgttgttcccttctttgtgtccgtaggtagtcaatgttttgctcccacttataaatattaataagaacatggttctctgttcctgtgtcagtttgcttaggatagtggcctccagctccattcgtgttgtatagcacagttttttaaccccatcttttattggtggacacttgggctagttttgggttattatgaataaaattctatgaatattatagaagccttttttgacatatgtttttatttctcttgagcaagagagggattactgggctatagggtaggtgtatgtttagttttattaagaaactgttcaactcttttgcagagtagttgtacaatatattttatactcccactaaccatgtgtggaattggttgttctacatatgtaccaacatttggtggtgtcagtctttttaattttagccattctggtgggtatgccgtggcttcttactgtagtttacatttgcaattccctgatgaataatgatgtcaagcactttttcttgtgcttattggctacacccattatctttagtgaagtttcttttttgcccatttctaattttattgttttttgttgctgagcggtaattctttatgtattctggatagaagttcttttcagatatatatagcacatatttctcccagtctataacttacctttttatttttttatttttaatgctgatatttattttttcttttctgtttttgctttctgtgttctaagaaactgcacattctcacgtctcaaagctatcctcttttattttcttctagaagttttatagtttcagtttttatgtttgtctatgagcattttcacattaattttgaattagatttatatttttctatatggaatttcagttctagcaccatgtgttgaaaagactttgctttcattattggattgcttttggtgcctttgtcaaaaagcaaatgacagtgtaagtataaatctgtttctgagcccctctgtttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtccctctgtttttttgttatctgtttgtccttatgcctttactttatcacagaatcttgattactctagctatacagtaagtgttaaaactaggtagtgtaaatcctcctactttgttgttccttttaaaatagctctaaatagtgtagatactttgtgtatccatatacattttagaatcaccttgtcaacttccacagaataaagcatgctagggtttatgattaggattgcattgactccgtagaccaactttgggagcattaatcacagtgatattgcacattctaatttatgatagtggtatatttcttcatttgttaggtttttagtttctttctgcctttttttttgtagattttgctatggagctctttttacgcatttttctgttaaacatttttctaaatattttgtattttttgatgctattagaaatcgtatttttaaaatttcattttcccattatttgctgctaggatgtagacatagaactgttacatgcaccttatatcatgtagctttgctaaattcatttcttctagtagttttttttaagaaaatagattctttgggattttctatgtaaatatcatgaagcccattaatagaaacagtcttacttcttttccagtcttttcttgccttactgcactaattaggatttccagtatcatgttgaataccagtgatgagagtagacatcctggctttgtttctgattttagtggcaaagtatttagtattttaccattaagtaagtaaaatattaactcagggtgttttgtagatgcttttcattggattggggaaatttgtatttctaggttgagaattttgtcaaatactttttctcactcaaagtcccacttggttgatttgaattgtcctttttatatattgctttatttgctaatattttgtcagcaattttgcgtctgtgtttatgttagatgtgggtctgtaatttccttccttttttcctctcctcctctcctatcctctccccctgcttctccttctcctcttacttccttaagaattgtgattagtacggaatattttctctgcacctattgatattatatatttggtttttctccttccatactttagatggtaaatgataacaatagatgctctaatttaaaaccatccttacatttctgggaagaatccagcgtggtggttttatatattttcagtattattggattagttaatagatccatgagtaaaactgacccgacattttctttcctggttttgttatcaaggtcatattctagctgcataaatgaatttaggaagatttcttctttttctgttctttggcatagtttgtatagaagtagttattggggggctgggcgcggtgggtcatgcctgtaatcccagcactttgggaggccaaggccggtggatcacaaggtcaggagatccagaccatcctggctaacacggtgaaaccccgtctctactaaaaatacaaaaaaaattagccgggtgtggtggcgggcacctgtagtaccagctactcaggaggttgaggcaggagaatggcgtgaacccgggaggcggagcttgcagtgagccaagattgcaccactgcactccaggctgggcgacagagcgagactctgtcaaaaaaaaaaaaaaaaaaaaaaaagaagtagctatttggtaaaactcattggaacctttttgtcattttaccccaacactgggtgaggtgtgggtagacatgaggggaaactgcctttgctttttaaatgtttacaggactacttaaaatttctgtgtcttcttgagttaggtttgctatgttatattttctcttggtaggtacatttgagtaagttatattttctaaaacgttttctgtctttgaagtttcaaacttactggcaaaaagttgtgtatggttttagtgcttcttgtaaacagaatatagctattgtatgtctagtattaccttgtaataaaattccatttaaaatgactaaatactaagtttctttaaattgtaactatttcagctactaagaatgttttgctaagtttattaaagtaaaaattctttataaaatacatgggatattctaacatctgtgagaaggtaagccatttaatactggtaatttggtttaattgacttgatatgctgctcattttcctccttaaatggtaataactagcaataggtacattggtttgttaaaaattgaactttcttcatgactaaaatataatgcttattttcttgaatcttaagatttatttgattatttggtggtttctagctggtccatctgtttagttgtaaccagtaaatatacctggagacctagggagcctggcatggatccaaacatagcccaatgtttcaatcacatatttgctttgtaacattattaaaatgaaattaacttatatgaaggtggaaaactcttaagccccttgtatttattttatagtttttttctagaagtagtacactatttgtgttaataagtacccaagctaatttttagaattaccttgttatcagtgagacatttaagatgactgggtaggatagagtaacattgagtaagagcacagttcactagcttaagtacttttactgatttggagtaaacttgaaataaactatgtatgttcaacaccttcctgctcagctggtccttcaccagtgccttgtggtcttagtgtgcttttagcttatgcttattcgtattttcaatgccagctatttcacatcttcaccaacttcagccaatatcttactatttatctttcagttgtggcagacggcaaactacagtgagaaaaaaagcagaacagtggggccacctctgaggctggggatggggtgcaatggaaatggccatgagggaatttaagcagaaatattgatgttctagatcttgatagggatctgggttacatgttgtatacacttgttaaatctcagggaatgtatacttaaaatttatgcatttcattttgtgtaaatttcactttaaataactataaagaaatgtgtaactatagtttatgatactcatgccgaattatttaggagatgtgtgctgatgtctacagtttactttgcaatgcattatacaaacaaggtgatgatgtaaagggatgaataggtatgctacaaacaatataataccatgttaatattgtagcggaatctaagtgttatgaatcctttcagctttgttgtgttttgcaaattttcatagtaaaacattggggaaattcttacgttgtttgtttcctgtgaaatagccatttttgtgggtcagaaactgacaatttcctgtggttgagcccgacatatggaagcacattttgtagccattttattgaggcatctttatctgcctggatgctaacaggaaatagcttcatttttctccattcgttgtgcacagttgggatagattaatctgtttgctcttggtagcagaggatcttgaccatctttgggacagaacttaacatctcagtcactctttttaaaagtctgtctggattagagctgatctcattttcggtgcttatgttcctgtctcccctttgcagcagggcaggaggggaaggagtgagtgtgctttcctgtggtttgcctttggggctgtgctggggaggaaaagggggtgaggcccctctcagtctcctctctaagttgataagattgactggcatggttattcacaagtgacaggtgctcaaacactgcccatgtgagttctttgaaaggcctggtatggaccctccctgtgacacatgacttggtccaccctcaatcccctgggcctccactcctggcagaatacttcatccccccttgctcttgggagcccattgtgtgtcagtcagcccttttgagtgaggtgctggcaaaatggtacaaacgctggtacttccctgctgccctcttggatttgtgggaagctgacattttgcctggagcttgagctcccttgtagccgtcacctttctctgtagccgtcattccccagttccctctgctgttcaactaggcatagggtgggccatggagtccgttgcttgagtggacatccactggggaatgagaagtcaatctccctgcaggcacccttggtctctgacaggcattctcctgcagagaactcttgatatctctcttagaaattttttaagtttttattataaaatggaattttttttcacagtcttgcaagtaaactatgtgccttcctctataatactgctttttaaaaatttttcttaggattttctagggttgatagagtgaaactcacagttaagagaaactttttgattttttttttctcattgcaactgtctggtgatttaatttaaagagtcgagattttgtgaattagaataatgaatttttagaattagaagagacatgagataatatacttcatttattcattatttttcattttactgaggcccatgaaacaagaaacttaccttgcagtacctgcagtacccctctctcatttgtcttatggcgagggatttttggaatttataaacaaatatttgtaccttaccaagtagattgaaatatgagattcactattctacagaagtgtggttatttagcttttggcaaagttgtgaaatttttactgatctgtatgtaggaaaagtcagacttcatgctgttagggtgaaggccgctgttagggcatcacctgtttattcagttgatcatgttttctgcaagaagttaggcaaaccatacagtctgaaggaatagttctcacaagactgccctcacttcaggcaccagctataattttggggtccccagggtcctctggagatcacaactgatatggcatgtcccagcgcccacttggttaggctgtccagtggccaaagcccccaggcaaagacactgttatcaggcagaacattcctgggatctggagaccccactgaagtaaccaagggcaaagaccagacttctctttgggtaaagttaattgtttatgcaatttttagttgcagccattgttggtgtttattactgttactcacttttattattaatttatttagtaagagcttgttggccatctgtgatattgtgaaatatatatttggtcttcttcttgtttcctgacatacatctcctaaaacccttgtggtctcccagagtcttaagagtgtctttcgctaataattgactggcggctaacagcccctagatagcttcaggatgggtgccggtcacaggaaagacaaaggcatcgttagaagattggaactttcagccccacccccaacctctgggaggagagaggggctaaaagttaacttgatcactagtgaccattgatgtaatcagtcattcctaagtaatgaagtgtccataaaaaactaaaaagatggttcctggagcttccagatagctgacaaagattaatagaggagacagtgtgcccaaagagggcatgacatgtgtttaagtttagcctaaagctgcctccttgcctatttcaagttcagcctaaaggcttttccatatgtagtaaatcgtaacgtaactaaatgaataaacagactgtaacctacccttgtatcagtcacagaattttagtcagtcacaggggtacaactgttcaaactatattcaaatatggcaaacactaagctgtagccaatccagctgtttctgtgcctttttctgtccataagtattacctgaccttgtggcagccctggagtctctgaactgcttctgggtcctgcccaattcaacaattgttctttgctaaattaaactctgtaaatttaatttgtcagccaggtgtggtggctcacacctgtaatcctagcactttgggaagtggaggtgggaggactgcttgaagccaggaggagttcaagaccagcgtgggcaacaaagcaagactctgtctttacaagacattttttttttttctaattagctgcatatggcggtgcatgcctgtggtcccagctactcaggaggctgaggtgggaggattgcattcaaggctaggagttcaaggctacagtgaactctgattgcactactgcactccagcccgggaaacacagtgagactctgtctaaattaaaatcaaataaaataattttaatttggccaaagtttttctttaaacacatggaaacttggcacttcttcccacataccttgccctatgcatctcttccatctggctgttcatctgcatcctgtgtaatatcctttataatcaactagtaaatgtgtttctctgagttctgtgaacccctttagcgcattaatcaaactggaggagggggtgttgggaactccgatttatagccagttggtctgaagtataggtgacaacctactacttgtgactggcctcagaagtagagacagtcttgtgagactgagccctcaacctgtgggatctgacactatctgcaagtagatagtgtcagaactgaattgaattagaggacagccagctggtgtctactgcagaattgattggctgcagaattgattgcttacttgctggtgaggagaaatccccacatgttttagtgaccaggggctgcaggaatattctgtgttgactgtggggtgagagtacagaaggagaaaatatagagttttcccaatatccttataatatccccaagatgtattataattcataattgtatcaactgttttttgacctatggttttctactaactcaactgtaagacgtgtgttttataatttacaggattcttctgtgtatgctgtgctaatgaatttttgtaatccctcactttcctccccatttgcatctgtagggcactttattttaaatgctggattcttttgctccagaaagtgggaactggtggggaggagggccatggatcttttgctgtcaaaataggttaaagtcaaagagtcttcatggacacagctgtaaaccagtgttagttgtccatattggcagtgtgtccttgtctcattgccttgaaatttagagttaaagcaggattaagcttttttgtttcttagttttgaaaaaataaccttttttattcattgtaataacttttctttcaccacctcagagtttctcagtggacatagctcatcttcctttacaccttttgcttctctcaggccagtgagagactgtcttattttgaacaccatgctaataattatcacccacccatgtggacaattgaatagctcagaggaatgcttttttttttctatgagaccgtcttctctattgagtgctctgtagggagaaataattacgtttgcagagccgactcattaggcctggcttgaggaactagcctgtgaggttaactactatttatattgtgtttttatcttcttatcagtggtgtttgggtccatcacaaattcgtatgacaggcatgggtggacccatattttgattcacattctctgctgcagtaaatcggtattagcacagaggtgtgggctagggcagtagctccttagctgggtattctaaaggatagtaaaggttccaaaaatacctggaggctgatataaatgggtattgctgatatttcactttcgtttactaatactgatgaaaatgcaagcagctttctcaattttgttttcctaagttctaaaactcatggcgccccttgtcattcttccagccatggtgcctttctacacagggacagtcaagagagcagcatctggtgtttgccaggacaggtggaggaggctacagagcctgtcctacctggccccactcatgtacagcccatgtgacagtcatccaagatcaatcagggaggaattcacctgagatagaactgtgaaaacttggtgaagggacgaatctgagtctgaaatcagagtctagaaaccactgggctgctttctgaatttctctctcttagctatttgtaggtcttttcctctagtgaattaattttaggatcattaaattcatggagatggggaaacctgaagtgacttgacagcccaaacaactaagcaataagttgctcccttatttctaaagtgttagcagaagaagtttgattactcataccatatcaaggatttgggaaggaatgtatccacttatttcacaagtgattattttattgagttcctagtagatagatccaagggaagtgtacagtaatgaacgtggcagattcagttccttgttgcatgaaacttacattctggaggtggaaagagattaagaaatcagttgttgtatagttgtctaagtagcagtgtaataacgtggtaaagaggtgcacactgctgtgagagtaagggaagtgaggaaggcttccttgaggaggtggtttgtaagcagagtgagctggcaatagctggggtgtgggggttgtatgtgatggtgcagctttgacatgggaaaagggaaaagtctgggctgagagcccgagacaggaaagaccatggtcaggtattttgggcaggtgtctaggcagctaggggggtgacacaacactaagactggagccacgggctggggccccatcacatggagccttccttgtaggccacatggaagatgttgtattttatctcgaaagcagtattaagacattaaaggatttttaacaggtcagtgctataatcagatttaaaaaatattttgtctgctgtatggagtagaaaagtgtatgctaagttattgaaatcacctaggagatgatgataacttggattttgatgatcacagttgaaagaacgttggaacttgagacagagtttctcactttttaatgtcatggcacacgcaaatgcttttaaaaactatgctgtggtaaatggacaagggtgacccaggtgctgaggagaatccatatcttggcctcgttgtaatcacccgtttgcaacagccagatgataaactcaattttgagaggtgagtttttgggacaaaagtcaaggatgaatcctggtgtttttgtctaagcaactggcttcacagaagtgcttctgagatttaggacactgaacaggaaaggggaaagaccatggtttattgtgtatatgcggaatttgaggtttttgtaagtcattcaaatgggatattgagtagacacatggttgtggagctcaaaggagagaaaaaggtaagtcatgtagatgatagctgaagtgaactagagaggtggcataggaacaagtattacagaattttcacacttaaaaatcaactagatgagagtgagctagcaaaggagactgaaaactacgaagtttaaagaggtgttaggagtgccacaagattctgaagtcatgagagtcgagggaagagagtgtggaagaaggagggagagttctgctgagagggtcaagtcagatgaggactgaaagttttgcgttgggtttaatgacatggaaatcattgatgtgacattagagccactatgctggagccgtgtgcagaaaccagatggaagcctacaggttgtaaggagtgagtgggaggttagaaaatgaaaacagagaaacagcggctctgtggagaatttcatctgtgatgggaagagcaagatgacatgggggctagcagcgggatggagggaaacctggcaaaggcagtgaggctgggggagaaggggcgagaagagacagtgcagagtgcgaggtagctgaggagaaactcggaatggatgcaggctagggcaggtttgtgtgctgggcattgggcactcaggatagcttcctgctgagggttctgttttctctgtgaagtatgaggctatggcagtttgagtatgaggaggtaggatacattgggggcagagaagtttgacatagtcatcataaagaatggcaaggtgagtttgtagagaatatgggagggtggcaggcagcaccgaggcccagctgaggctggctctgctgtgttcagttcctgatcttgattccgtgagcccagctgcccttgcctctgtggcgggggatacttgtgttcacccagggaggcagtcacggcagtccacgcagtgaactgatagaggagcaacaaaggctcatgagtcgctggagtgatgtaaatggtcaactgtggagtctaagatggccactgatggatatgaaggcaggaggtgaagaggggatatgcaggaagcagaaataagagaactacaggatccaagaagaaaatgttgaggaaacaaagtggagatgtaggaagttgtgatcaaagagtgaatgttcccattctgtgcgtcgtgtggtgagagaacctaaacccttgcatgtggaggtggccttccccagtggtggtggccgtgggagtctgtctaagcaggtttgacttgtgtctgcagagttgcattttgttatttggtaatactggttgtttagtgttagtttgaaaatgttataattctctcctgttaactttgggtacgatgtgtagatgaaaaaaaatttgtttttgttttaaagaatcatattttcactatcttgtgacactttacagtcattatgatggagccaaaaaagcagagccttcttagcagggttacggaatctgttaggatggccgcttgtgtcatccaacaagaaacaaggtgtgaagaggaacatgaattaggttgcgtttatgatgaggtccatggtaagaatgtaagaatgagtgttggatataaaatggaggcgaacaaggtctctggggatgaagaaatgaagcaaaaagcacctgtctagctggccacagggatagacattgaaatcacatggttacggctggacttggggtgtagaagacttccctgagcatggggtgggagtgggaaagtcactggaggtggtggatgacagcaatgaggcacagtggagggttggataattagatgtcatagaccacagaggagcagggagcagggttttgttgttgatgtcatcgttttctttttttcttttttttttttccttctggtgggtaaggaaatgatggtctggaaattggtaaaagcaagaactacttcccttccttgagaccctgagaattagggaccgctggtatagtattctttgtatgtggtccctagaccagcaacatcagatcatctgggacttagcaatgccaattccagggtcccactccagacctacaaaatcagaaactctggggttaaggtcggcatcatgtcttaacaagccctgtttgactctgacgtgctcagagtttgagaaccattgctgtaatgatagctgatccggggtgaggggaaggaagtattcagtgctgactcatgagaaggctgatggattttcacctggaaggtttttggagggaggtagaaccctcgactcagtgggcatatgtcctggctcccctggttgcgagtggcattaggctgatactaatggtctcagaacacacgttggaagtttggtctttgcttagacttggagttgctattagtaccagtagctgttacaaggaatagttaacttagtgtcattttagttgcgtttgctaaagttttaaaaacatgatttactatatgcaaattaagtttatttttaaacttttcataaacattctccatcataaaaatgaattgtcattataagaggcagttgttcagaattcagaatttattgttctttaaaaagtgttatgatagattaaatgatatttcagagggttttctcctgatctccatatctaaaatatcaggtatgtcattgtcattgtgaactgaggaggaaagacatttttatcaaaataactattcaattattgcaaaagacaaaagattaactagaggacttgtgaaagtgcttgataaagatttgtcaaggagaaataattggagctgtgttgaagaagtcttggggtaaggtataatcacattttaatagctgtgattcctacagtttgacgtttagctgtagacattctgtaatttggagtggagctgaccttgcacaggccagtaaagagaggagaagaaaccctaccagctccagcagttgcaggggcagatgggattatgaaacgagctctaaattgggggtaaggttatttatgcactagtcacgattgaatcaatagaagtttgtttcactgatgactccaacaaatatttgcatgcctagtttgtgcggagacccattttataagcaaggaaattcaggcctagaagtttgatgacttcccccaaatcaaatttaatggagaagccgtgaagcaaatccaggtgtctaagtatgaaagcataccaagctgcctgctggatcagtgtaggggtttggtttctagtggtctcacccatgggggtatcgtgttgctgtcattctccctccaaaaacaacacaatgaaaggaagcttccagaatatttgtcttaataaatttgtatggtgacgaaatggtgggtcaccttaacccctgtcaacaagtgattcattatcatttaacaatttagcaagcactaagtttagtgggacagatctttgaagaaaataatgggggaaaggacgcttggccagagggcacctgagaccattttgtttagttggccatgatgtctacctacttcactctgtcctaaacctggaccatcaaatgttggtaccataggttgcagactatggtaccaacctcttaaggctttatcttaccatgcattcaatagtttcactggacagaaactgatcttccctttgagactaggcacaccatatttacaaagtgacatatcaagagtatattgtttgcttttgataaaaactgcccctaaaacaggcatctgaggaaagaatcccttctataatttagtgttttgttcctttttggaactagtaaatatcaatagtagtaaggttaataatactagagtaacacctcatttatttgatattataaaaggatagataaaatattgctaataatttaatattgtagttaacatttagctttgaatatatgtgtttcagtgtacacacacacacacactctcagacggatttaatttttatggccctttttgaaaaattgatctagtggtgtattttttaaaaatgtgcatatccttttaacaagaatttcattttttcttccagaagaaatattggcaatatattcttgccgtaagccactggaaattactagtagtattcaaagcttttaaatttttaatttgcttgtgaagctttaaatttgagtgaaaaatttagtcttataaacaacttagaaaggttgctgcctgctctagatactatttgtgctaaattaatttagtatactaatcagaactctaatgaattctgtgaactgctaatgttagatcagtgaataaatggctgattttatttcccagaagagaatgtttggagatgaggttggggagaagttgaaaaaaaaaatcagaatgtggttgtgtaatcttttcctagttccctttcaagatgatctttcccaggtcattattcttactcctgaagatttttctttccctctcctcacctcccagccttccttctatttctttccttcccaccagtcctctgtccctccttttctagtgaaacattttatgttggtgctttatttttgctgttggaggaattattcctgggatggtgtctgtgagtaagaattctagagcattgattaatttcttactatgtatggttttgtttcattcaagcaatctaatggtctttccttgtagccattttattagattctgaagggccaaatcaaactgtttctgggcttggggccatattttatagcaagacttgtttgagttttcaatgaattggtgcttaagctaaagccgttaaagcctgcttccaagaaaacaaaactggcagcacagtttgttccatttcattttttttcagcatgcttgattttttaggggttggagttagctaggaccaactgggaaaagaatcccgtaagtgggagaaaggctgtggtgttgttagggagtgcacttcagcctaagtggtgattagcagcatttagcctctaaaaataactggtgagcagagtttgtagtcaggtccaatttcagttctagaggcccttacagtgcagggattggccagtctcaagctctggtaggcaagtgcatgcagtgtgcctaaaacctgccagcagtacttttgagtttttttttttgttttgttttactttagcatttattattcatggattgaagaaatcaaaatggctgaagataaaggtatatttttgttatttaggctaaaagtggctttagatctagctgacagcttttcactttattttcagtggtgctctgttaaaatatttttggctaagtgctttgactgtactgtctacattttctattttgaactcctggagatactgacttttcatagtagctgaatatttcattgaataatctgtctttaatccgaatatgttttagtgtcttaatttagatgaccttttagtatgttgtactactggaggctgcattttacaaatttcaaaaaatgtacaagctctcttcttattcttataagttaattacaatgaatttaaagaattatctatatttagattttatataaaattataggagatataaattcagtctcatattaatgaacagacttacctggttcaagcaaggacttaccatttatggaaagtgacctacttttatgtgaagcagacaataaatgcaaagaaaaaacacaagggttttattttgattttaaattgactctttaactttgaagtattctttaactatgtattgaatttaatgttttgtatatatttgcttttgctttactttgtaaattaagatagtctttccattaattgaaagactgcattcactcattatgttgaagatttataaaagaaaagaatagatgtatgaaaactgcttctaactctcagctgtctaatcagcaactgaaaggattctttgattaggatagagaatataagcatgtactatgtgaatattatttgaataattggtgagaatgggtcacttgactcgtctgataaagtgcttcatgtagccatgaagaagaatatgagatatgtatctgacttttagttcttttggaagacatttctctcctcttgtggattaggtaatccatgtagttaggaaaaatcagctgttgcatctgatgcacttttaacagtttttgattcccaaagggtgacattttatagcatggaaaaataatcagtttgatgagttgcttgacagtttttgtgtttttcaaaaaactttaaatgtgtagagtttatgtgtaaatatgaaattcccaacataatgctaactaaaacttataaatgatctataattcagttagtagtaggccagtgaagtagctggtgactgttcaagtgctggggttcatcttcttgtctccctttcctcaaccaaataaataaaactacacattgcccttcccccggcttttgttttggagagtcttcattttggactgttgcttgccatagtaatttctgtgtttggtggtatgtgggaacattttctgatttggaggtcatgtacttttgatggaataacatgggaaaaaatgaatcgcatcgttcttgcagtattcttaaaccccagtaaaaatccgctttgactgatcccagaactacaggttgaacatgaagccagaaaatgaaatgaagacttagatttattctgatcttagaaaatagggacatctactagatgttcttcccaaatacctttggaacaagatactggtttcagatttgcttagggagttgtaaaccctcttaagggtttgtcttaccatgcgttcatcagtttcattggacagaaactgatctgccctttgggactaggcacagcatatttaccaaatgacatatcaagagtatattgtttgctgtcgataaaaactgcccctaaaaaaggtgtcttaaaaaagaatcccttccataacttagtattttgttcctttgtggaactagtaaatatcaacagtaataaggttaataatactagagtaacagctcatttatttgatattaaaaagggatatataaaatattgctgataatatattctagttaagaaacatttagcttttaaagtgataaatctctttactacaaactactttgaatgaaaatcttcctaagatttattatacatttcttctatgttttaatggcagaatcaatgtgaaaccagttactgtcttgtactgaagattatttgaaggactgtcagggattctgcctgaaagtttcatcataaatgacttcccaccactcagcttttctgacttcctgggcctgctcttgctgagagatctgtgcactcgataggcttttcctctgtcaccactctgttgctttgactcattgggttagattgtgtctgaaatgtagagttttgtgcatagagctagaaaacttaattgaagttgttagaatcacatctaaaataaaaatgtaaacaaattctaggtaaaggtgtattttttactgtgtttggctgtctccttcccatctgaatcccttgctgttttggtgcatgcattcattttttagaaaaaatattttgtctacttttcccttatatttagtgttacagtcaataacttaaatgagtatcactgagttaacttggataaatgataatttccttttcagaatctcagaaatttttctcctccatttccctttaagagagatagaaatggagaaatgattaaaatttgaattcaaactattactttgttttattagctatttcattatagactttttaattttttttttaagaaagggtcttgctttgttgcccaggctggagtataatggtgcaatcatagctcactgcagtataggcttattttaaataatatcatcttgggtatctgtttggccacatactcattataaaaacttaattattgggtaaaattatctgatattcatgtactgaataaaaatgttggatgaatgaaaagatgaactatatttgtttagccttgctgttttccagttaatgaggaaaaatacaagagactggtatcagctacagaatgttcaagaggacataagacaagaacccagttttactgaagttttagcattccttttgccaaaaaaaaattcaatttgattcttagaggcaataagtagcaaaggcaggaaattcttagtcattagctactataattccatatttagagtatgtggatattttggaaggtagtatttttgttaaacttagtgttgtacgcaaatggatttgtacgcatatgtctgtatgttatatagaaataagcgttcttttttggatacagtgttagaaaataagtctttctgtttataaaaatgtagtgaattagacatacaaaactgtttctgaatctgtggtgcttcctgacctcacagaagcttactcactttcgtaaatctttttttcttcaaattttagtagtggtttaatttgtatttttctttttatatgcttacaacacataaaaattttggaaaccaccatttccctctaccaacattgcagacattctcacccaatcttctcctgctatggctgtgtttcaggtaatgatacctatttgaagttgatttaatctgcaacaataggatctatgcccagcaagtatttttatttaatacataaattacgtttttatatagccagcttttatatagatcacattagaaacaaagttgatggccatttgtcatttggtaagcatactttatgaatttaccatattatttacaactctggttctgagggatccattaatatttaaagaatgtcagaaaaaggaattacttgacgttttaagaattacccagcactttgagaggctgaggtgggcagatcacttgaggtcaggagttcaagaccagcctggccaatatggtgaaaccctgtctctactaaaaatacaaaaattagccaggcgtggtggcaggtgcctgtaatcccagttactcaggaggctgaagcaggagaatcccttgaaccgagccgagatcatgctagtgcactacagcctgggtgacagagggagaccatgtctcaaaaaaaaaaaaaaatttatctacatgtaggcatgtagataaatatatgtatatgtttgagtgtacatatatatactcagatggatttagtttttatggccccttttgaaaaactgatctagtggtgtatttttaaaaaatgcatatatccttttaacacaaagaatttcattttttcttccagaagaatatattggcaatatattcttgacttgagccgctggaaattactaatagtattctgtaattagaactggacttagaagtcaaagggcaagttctagattagagctagtggggttttttgaaatcgtgtaatttggcccactgattagagattaaggaactcagagctgtagagatgagagtatgttcttagttctacccaacttgtactggtgactttgggagaatcatttcatgtttcacttataaaacagataattattcctgtccttcttcctgttggttctcacccaggaactgcccctgaagggaacatgtggaaatgtctggggatgttttttttgtcataagccttgacagctccttgcctttgagtccaggggaaaccagggatgccagaaatcttgcaatgtgaggaacaggtgcacaggatgaaacattgtcctgcataaacatccagaaatgccctctgtagaaatagtggcaggacaccgtgaggatcaccggcagcaaagcacatgaaagcactttgatggcgactctacctgccacacaaatgggagacaccgccctggccttccatcatctgtttgataaacttttcctcttctcagaaggcattttgggatattatttattctttttatttattaatattgatatatgtattatattcctttttatgggaaatttgaatattgtatatctttttaagggcagtgttgactattttctgttaatatcaaatcatttttgtttatttttggctgtaagaagaatatttacaaaagaatataaggtatattaagcatatcaaatgcgataaatgacactttaggtggacagcagtttacaaagctgtttcctgcagtgagaccaattgtgaatgagccttttcctgtttccttaggcctcaacggatcttgtaaaggagtaggaatggattgtgctgtttcacttttctgtccttttctctctggctaagaatatggaatggtttagggggagatattttcttctgtgtgttaacagagtttttaagattctgcagaaatgaaatgggacggagaaaaggatttggctacatttttatgtgatttcattaagttgtttatgtgctctgcctttggaaagaggtaatattcaggtcattttgatgagtaacttggatggaatatacatattatactaaatctttaaaaaaattcaggagtttatttcctgcactacttcaaagttagtgttgcatctaaacaatcttttctgttttcagaaatattttgtgtgacgtgttttgagaatttaactggaaactgtttttgaaatgatctatcattgtacataatcccaaattattggagaaataattgtgagaataagtgttcagtaaaatgttttcttcttatgatatcttacatttatttctaaacagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggtaagaattttgatatccttatgtgaatttgtaagagagtaagtgacatctcttaggagtcttgaatatttgttatcatctttctggtactggtaatttctatagcctttcagtggttctcaatagagtgaggctgaaaggggatatgaagaaggttaccttggagtattgtcttttgaactctttaaatgtgacctgtaggtttttgaaaaaaggctttatattgtatgtctgtcacacagggagaagttttatcaaacagtactcattctcactatatgcagtactttttgatttctattcaattttgttatattataaattttaaaaatacttgatcatgagccattacatttatttaaggacttgctaatggatcataaccacacaatatgcaaaactcttccttagagagggttttcaaagtacacccttctgtgtctctgttgggatgggatgagtacgtgtgcacacatataggtactggatgggtgtgctgagataggcgtttgtagatattattgtgtgtgtgtaggtgtgatctgtgtgctgttctgaggaagttgctgtggtccttctgatagtgtcctttctccacctttttccttttctgtaatcactgaagtttttcatgattttttacattaatgattctttgttatttttggagtcacattctccttcacttccccaaaaatctttttttaaactgaaataaaattcaatattatatatatttgaatgtgtacaattcagtttttttttactatattcatcattttatatacccatcagcattatctagttccagattatttttgttacccccttcccctaaatacccaaactcttcctctttccctctcctgggaaacactaatctactttctgtgtctgtgcttttgtttattctgggcatttcatgtaatggaaccatacattatatgatcttttgtatctgcctttttgcacttagcataatgtttttaaagttcagtacttcattttatggctgcataatattccatcatatgggcacaccacattttggttatctgtttatcagtgatggacatttgggttgtttccactttttggctgttgtgaataatggtcctcctctttagtaatccagtgaaagatgtggacctgtcactggaaaaaatgcacacttgtgtctatgtacaatgttgcatgggtgatatccccttgcattggacttcctgtgcttctgctttacttgtcaaattatagacatatttttggggagaaagggcaaacaaatttttggctgtaggaataacaaaatatgcttatttgtaatctgtctttcattgaagtttttcattttcattactttaaagaaagtgtctctggatagattgacagaccaactgagggagaattttagtctggagacaaatttctgagtagatctatgctttgactgacttacagtgatatgttgttagggaatgtatcttaaaagaggacactttaagtatttgtacctttaagcacaaataacagttttcatgtttttacatgcatgcagccaaagcaaaggacttccgttataacttatcagaggtgcttcaaggtaggctattggagttgcatttcaagtctacgtgtgttactctctaatggctcatcctttttctactaatttaattattatctacatcagaatataagtgataggaccaatttcccattatgggtttgtcagaaagggtagtattttctatcttttactgtttcttgaattctgtactctgcatagccttgattagtactttttgttttcttagcagttgaaataacatccttatctcttctttcatcataatcattttaaatgtgtatgtgtttgctaagtcagacttctatatagcaagttaaccattttcctaggtagagcaagggctctggggagataaagattgatcagaactaatctgagccaaaatttctgcctgttcttctgtaattttttaatgtactttgtgttaaagaaatgataacaattgccaaaatttttttttagtactaatgctgtatttgagaaagctgtttaaaaaattgctgtacattaacattattatgtttctccacagtcattgtccaataatgaattagaatcatgtagattttaggatgcttttttagggagttgaatatatttgactttttgaaatgctaaacaaaataacagtgttccttatgataaagcactaaagcctaaaaacgttttctgttcatcaggaggaaaggttttggtagtattgtcttctcagcatatctgttttaagccctttttttcttagtatagattgcctgtgctgattaagttaagtagaataatcataagttttcctttataatttccgaagcctccagttttatatactttatttccagaatgatcttttatttttaaaggttaattcatgatatttctgttataagtcatcattgtaaaatataaaattaatgattttttagtttttagtacttagattctatgttaatctatttacatttggtctttatttgaggcttggttgtttcttttggttcagatattgatagtgtgatgaaatttcatgctttagaaacattaaatttcaagtgacttaggaatgcatcaatattatttcatatatgctaaaaactttaccaagaatatttttagcagtataataaaaattattctgaactaattagatcaggatgttgttcaatctttaaagataatgctgtgtcagttttatttcatagcatttattagctgaacatttcctgactctcttaactgaattgctcgctatttttaggtaagatattcatttgacactgctttgcaggattaaaagagcaaagaattgtattaattggtaacatttatgactgagttgcatgacttcactaagttataataccttattaaatttcttttcttttttattcccatatccatcatttctgccctattataggaaaactaggaatctatgatgctgatggtgatggagattttgatgtggatgatgccaaagttttattaggcaagtacacattttatgttttttgttagtggtgataaaatgctggaaacaattatttttgctttaataatatctatctcaatagtatatatcttacaggagacttttctcccttaaatcatatatttcattactgttaaaattttaaatggcttatttttccacactctttcatgtcaatttacttttatcaatgaataagtgtatatctcttacacatatatcttttgataagtataataatttcatgtgtgtttccagatttaaagtacttcttattctgaacttagaatttgaatagataatatcctagtctgtttttagatatggtaattatagccatttttcattaacattacacattcacttccatttcaaaatgtaaatttctacaggcttacataaattaatgatgaaataaaagtgataataaacatcttaaaatgtcccatgcatattttaacggtagcattaaaatatgaactcctggtcttttgacccagtgtctttattttggaagtcttggacccttctctttcattatcagaattacttgtctttatcagagatgtttcttgtaataaataacaatgtggtattcccttatttgttttaaagtgctgtcttgctggaaagaatggtgttaatttcaatatgcaaattttatataatctggcctggtgagacttcctttgcttttgtatgtagcataatatatgttaaaactttttatataagagtctttagaaaaataatggatatggcatgatattatacactaagcttataaaataatgacccaaacaaattcttcttagttaacattgttttgtgtatatttattagatatgaaaacatggtaggatgccacatctgtaactagtgaaactgcttttagtagattaattccacctccttatgaaataaagttccaaatatgaaaatagagttttagttgtgattaaaggtaataaaccttcctaatgttgacctgtgttggtgttttttgttttttttttttttttattattgcccattgggaattagtgtttgtgcattgaaacttattatgaaatttcttttcttgtcttaactttaatgaaattttcaatgtagtcctgtcattgtgtatctatatttgagtttctctaaatatattaaatcctcagatgactataatcttaggcatgtaaaagaaacaaaattatgtagaacttatcagaatgatgttaatttgcttgcctataaatggtttattacttcattatattactttaaatgacacattctgaatagcaaagctttttattttaaagataaaataaaatgtgggccaagttccctcatttttagaaataatattactctcatctactgcattttattgatttttatttgtttgtttgtttttgcttaaaaccagctatgtggtctgtcaggaaatgccattagaaattaaaatgtggtatttctttgataaaacacactgatttctatagcaaactattaccttaacttgatttttagtgtatttgagatttcaaaaggtcatcccctttaagttttttaacctaccattaagaagctaattaattgtaactttgaatattgctgtttgcaggtatagtgtgaggaactcataaattgtgccatttataagaattatacacttggaggtggaactaaatttggtgaatatcaaggtttattttggtaactttactaataaatgcataaagacagatcagataaagctacataaatacttttttactcttcctgtactagtttgcagttggcttgtggcttcagtacagatgaaacaaaccaaaggtgaaatgttaggcttacttatcacctctaatcttatttcatagcatttgagttctctgcatgaaatgcaaccttaacttgaattgagttttatgactgaagttcttttctggtttgtgagattattgtagtttagtggtgcctctgttactggaaggttactgcaaagacagcctggtgaaattgttgggagtacagaggctttaatgggttctttgaggtcaggtagaggttatggggggagcactacagtgagcatatacccaaaatgaagccagacttccaaggtacgttctcactggagagggagcttaatggtaaagtttaaactttaagggtttaggttttagattaaggcccaggagatccaaggggaaggaggagggtaggaaatcagagataagaggagctgttgtcatcgcaggtatagtaataattaagatatgttaaactttcataggattttgcatttatttcatcagtttttttttctagattcttaaatctgcatatatctaaatcttataaatttggggaaatgtacacatttacatggtacatttcactcaattttagagtttggcttttcttgtgaaatagaattaaatatatgtgagtaaatcaagacccctaaccatcattaattttattatttggttatttctggccaaggcccttctgattctttgaaagcgtgctaagcccatttttcttcatttacataccttcttatttttgtggccaaattaactaaaatataggtatcttttgttgtagttcagattattgaaaactaccttgtttgaaaatacattctttaaaaacttattttccaaataaaatcaacaggaaaatgacccaagaactaaatgatgcgaggactaaatccttagagtgacaccacctaaggatcatgtggttgtccttttgtcctatggctagcacctagctggcatcgtatcaggtatgggtggaaagcaaaagggaagccagtcagcacttgctacatcctggaaaatcatttgtagactgatagatgcatgagtgagctgatgggaggagaagaccagatcttgccaagccaaaggcattccctttggttgagccctgttcttagaggttcagaaggaatcacatgccgagagtatatatttttctctctggactagtacttttgtcttgagaaccacaggaaggttgcttggctgggtaaacagttttgttcaaatgcttttgcatattcgttgcatatggtcatctgtcatactgaaggatggaaaagttttatatgtaatacttggaagtacttataatatattggcaaatggagaaaagtaaagatgtttatactaaatatgcagctatagtgttttaaggcaggaagaagaaactgttattcccatagggacttagttgggattatagatctttgttcacagcatttgtctgctgctaaattcagtgaaaacattctaggcttgtcaaaaagtaatttaaataccaactgcaatttgcgtttttcctaccaaaaacatgaacaatgacataatatagttcttttgagtaaagcagagaaaattcactataatctttaaaacttttaaattagttgtcgtcttatcctttatctgcctatcttgattgctggtagttatactacatggagacattgtgtgttgccaaagccttaaatgactgaattacgtggttccaaccagaaaagctcagtggtcatggatgttcacatttcttacagtcagaacaccccaccctgttattcctcctcaaaattaagggcttggtatacagcttggtagattctgatacctactagagctaagaaacctttgctacccagagccagttcttcacaggaaaaaaacaaatgatgaaaacaatatatactttgatttatttctatcctaaggcctgtttggggtccaatacttagttgtaaggggtcttagcaatagaagctaatttcacaggcccatggggagaggaatttggaatgttcctattgcaagtgaccagctaaggccttgatcacatttcatatcggtaggcaaagtgaattattattaatagctgactcttgtcattggccagaattacaggaccatgagtcagttgccagagttttatagagctaccacatttaatagtgttaaaatttaagtgttaaaattatctgagttacataatttgagtgtatttttgcccacctatggatgctataaatggtaatactgctaattatattaactccagaatttcctaagtcagctccaggtcttaagtggggtggtggtggggggaggggagaagtttgaggaaataaacctttctagtttgaatgaacaaatgaacgaatgtgtgtataatcaactctcgataaaatctggttggtaaatgagcaaatctggaggttgtcagagtatatatctttttttccctgatactgcttttactcactcttccttttactgtcaactgatttttccattactgtccattgatttttgatgataaaattttgtctttcaactcaacactctaatgagagaaaggtaaacctgggtaggggctggtaggagtggtgaggcttggtcaaattgtggctttcttttgacatttgattgagagttgattgtaaggtgtgcattttaatggacttctttattttccaaataccgtttctgtaaacctctctgaccttgatgcacctcgcttttgagatcacccttcctccacttcttttttccacctaactgctctccttattttctctctctcttcctttattcttatgtaggcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagctagtcccttgctcgctcagctcccccaacttctattgaagaaaatggtactcctcattcttgtagtcagctacaaagtacactgaaaatgatgttcttggtggtataattggtttctgtatcgttttgtttcaactcatgtattcactgaactaaatttggacacttaacagcaaattgtgttgtggttaacccttgatgcttgtctttctaacacactattaattatgatgattctaatggatttcattataaaaatatttctggcatgatttttaagttaaatgcttctctgttctttaacatgactgatgtataaaatgatggttctttactaagctgatattttttattgtaatttgtttaggtttgtcagataggttcatacaaatttctatgtaaaattctgtgttaatggtgcttttaaaataatttaaaaataactccatgtttttgccttagagtaagttaacttactgttttcagatagtagcatgacatatttctgtctgtgaaagcaaaatttattttaaattttatttccaaatatacatccagagaaagtaatttgtattttttttaaagtaggcatattacacaagagggaacatgtgaatatgtatcttaatgttgtacatattaaaattattcatcctaaataagtctttttccattttttccttcattaacttattaattggatattgattttggcttagatgtaatgtgatttttagaattataaacttattgaagtggtaattccatttagggcagtaaacttttcccattagaaagccttaaaaacatatttgaatcaattgctttaaaaatgagtttgcttcagtagtaaccaaaacaggtgtagcagctatatacaaaatgcatttcttaaaatgagatttcatcagtttcccctcaagcaaagctcttctagggataaggaagataaggaaagggatgttactttttgaaggagtgatgttccgtggttttaaatctcttccagcttctctaggattttgcttagtgttagtttgtcagagagctaaaaatttgaaaatgcttgcacttcctcacgttttatttaactataatttctacttttcaaatatttcttgtcttctatatctaatcaaattactttcaataagtgtatcattcatccatttattctgaggggactatgacaaatttaaattgttatgaattactcttgtaggctgtcataataacagcctgaaagtagcagcctcaagtcagcatgggacatccattccctctgcccaccatttacctgtgtcagcaaatactgtccaatttgctaatcttattaaaaagcaaacattctgtagctacttttggatgtggatatacacactggacaataatctcttaaagtttaaatgactattaaagtgactattaaagctcttgtttgtcttgcctgcactaatgggcaaatatgttttattctgttaatgcagaagatagtctgttaaagcttctgtttccaaatattcaaggacttcagttaagctgtcacttagtagcatgttctgcaacaaatgagtatcattcagtaatgttccttctgaaaatttattcaatctttgtatttattgtgtcttctgctttcatacttgggtactatgaaatatcaaagtttattaggtttaaattctaaaggaatcttcagccccactcaatgaaattcacccagcctaatttccgggatatactttttaaaggaatcttatttgttaacgtgttgttactactaacactagaagatattcgattaattgataagaagtaaatgattaaattttgtgttaaaaatatttgaaattactaatttttcatcaggctttatttgccctactaatgcatattttatgtacagaaattaattatgctttatttttgtaagtgaaaaacaagaatgtgggataaaaatttgctacttattttgtaccacctctcattagttcctctgaaagcctctgatgaaggtgacacccaggtagctgacgaacccctgacttctgtgacttccgtcaacttgtgcctaaggcttgtgtgtgtgtgtgtgtgagagagataaaataaaggtattttattttatctctgcactataaactgcactataaagtatctcaaagctgatcaaaattacttcaccttagtttgatttattatgtattgctaaaattcttaattttctaagcgtgtattttctgactttgtttcataatataagtcttttcctacctcatgtcttttaaacttaagaactaaattaaggcaaaatcatatcccattaatttgaatgtttatatagttatggaattttaagttatactgtatttactttaccttttcagagttgagaaactctgtggaacaggcttcgtgttgagatatagtgttgtctcctcagagtcactgttctggcttattcggatgtgctgacatttgtccgattgcaaagacgctgggttctccggagtttggcacgaaaacaagacagcagcactctggggattcttttcagccctttagcttccttcagcctgccttgctttgggacatgagtggtgggtataagtcagtaggggaagtgtcttctgggtgccaattttacccagtcctgaggcctggctgtcagcctgctgccctggggatcctgcagacgcctcggtgctgaggacatatggaatagtgggctgtcctgcattttcatcttgtccttgattctttctttattctagaaattacctccctgtcttatagagctgtatccagacatgaaagagggactattttctgtttgaattatttttatttagttagatagaacagattgtctaccttgatgtttgtgactttggataattatcaaaaaattagatctagcacagccagttattcttaatttggtcacttgacagttaactttttgggaattgatgctccatgaccctttctaaataatccgctgggctagctccttaagtctataaaacatacaagaaattttctgtgatttggctgtggaatctttgatcacaatgcatatttggaatgcttaaagaaactcagtgacccagactttattttcataagttaaatgatggaaccagtattcagaattcactgcctttgttatttgttgagatgaccctgtaatacttaggagttagatattaagtagtttgtggactccttgaaactaggaaccagatcttcggttttatttgaattctccttcaatgctaagccttgcatgtgatattcattaatatcatatgaataatgtcatatgctggtgtgggtcctgaaggatgaggagttactccttgcataataaaatactgagttttttttttttaaaaaaaactggtttaaataagtggtaaaattattggacatattttttgcaatagaaatgacattttgagtttctataacaaacctatgctaacaaaagtcttcaggtgacctttccaatctccaatttgtatttgaatctgcattttacctttttttctctgtctctggatgtaatccctttctgcttatttagtctttcagttttcttatgttctgatcctccgttccccacttactgtagagggttggtgggtttgtagctttttcttcttctttttttaatctgtactatattattacatctatttaaaaataaaaaagcaattggtgtagtgtcctgacatgcattttactaagagtagacatccattctagaggaacagtctgtctcgctaacaggatggttactcagacatttagggcctctttttgctatttgtagtcaatgttgaaatgattacgatgttccagtatgggacggaggaagatgagaaggcttacagtgactcacaggtctcactagaaatggtgagagtggctgaagtgacctgagtatgaagtgatatccagaccaattctagagctgtctgaaagtctgaagtagctacttgtgtatctgtaatgcagccagtcttctaaaatcatgtctattgcatgtggtgtaaccacagatctatccattggcttaatggttcaaacattttaatttcatagagaacatttgattttgaaaatgtagaataatggcctgaggcagttgccaaaatagcataaatttcctttaggcaactctcttacgttctaagggaagaatgtaagatcttttttctaatttctgtataagaattcccaaatagttgccagagctattaactatcatcactttaaatacttacatcaaaataagtataaaaggacgaaaagaaaataaatagcatggcagttgtttttcagcatgtattttaagcacatcctaatgctgctttgattatttcttaaattggaatatattctattaattaaaaacaacttttgtctgaatggattaagaaataccaagatgtttccatttttgctcgaattgatagaattttcttcctactacttggaaactatttttgaagagcctttgtgttgtcatgaattttattgattagtggaatgttcccttttttcttttttttccctagacattagctatggtactaaagatagaaaaggagaaaagtagtgcatgcttgtggcattttggcactgtagggagaatctacatcaaccaaagttgcaaatgataagaatttaattctgtcaagaattaggaagaatagaaaggtgggcctttcgtacctgccttgtggttttcccttaagtccacttctctaatgcccgcaaactaatattttttcccctctacgtgctgtcactaatcttggattaccactgacccctttctccattactgtatttcccattgttgctgggaaaaaaaaatctgttataaagttacctgtactgagcctctgtcgggggcatgctgctccaacagtttcccttgttagcagtcattctaaacttttccacaaccttccttcttccagggtcattttattcctctgtagagatgattttgctttctgctttcctaagataatctagtgtggcttcattccattattttcttctctcttccctttacaacattactatctcaggatttttttgagctattgtttcttgtctcattcactcacctttttttttcagacactgcatcctctggtttccaaagctagccctttcccttgagcctgtacatcctcctgacctcatcacctctctcctgttatgaacttagcttctttttcttacagacatgcctgcgtttcctcgaccttcaaaacaaaacccggataaaattcttcaaactttttccttttctgttcccctcagaatctagggaaattccatgtatgatcagttttcttctaaggaaatgaggaaggctgatgtgagcaccctagatttttggtcacctttccttccacctatgttttctcatcactgtggcatgactgccttctctactgcttgtaaaactgtattctgaagaaccttagaggatatttagtaagtaacataataaaatagtgccctcatcctaaacctttgttcatgtcttccttcctaaaactgatcatttcactttaaaaaaaaaacaaacaaacacatttccttttttaaaaaatttaatttcattttattttaagttctgggatacaaaaaaaaatttttttttctttactctctttttgtttcattgttacttagggactcttgttaactgtttttggtggtatacttttttcatgtctatatacttttcttcagaaactgaatgtaataattgtttaaattattagcttggtcctttttatgtcaaaaatattgaaaaattattggctatgtttttaagttcagaaaagcataagatgatcctttggagttttatatcatgcattgcactttgttcatgtgttcatttctatcactataaggatttatacccaaaccaaaaaagtttaaaataaagcacagcactgtttatttttatatgtttcactaatctgatgctaatctaatattttggtttattcatgacaaaagttaactctagtcttttcatccatatagctctttttacctagatcataacagtgggggtagggagagggcagtctgggtttcctcactctacgttttaataggaaaatctggttctgctgtgggagaacatgtaggagtcaggaggggaacatagcggtactagaagtatattttaatgttttatgctaatgtgttttacaccttagatactactcatatttaaaagtgggtattatgagaatagttttgatattttattctgaaataaactttagtggagagtgattggaaatagcactcattattgctgggttatacactgtttttggcagaggttaggaaagaatcaagttttgtctgggaaaaataatttttaaacacatgggaataagtactggttatggttacctatgtatttcatataagtggacaaatataaccatggtcacgtttccatttttatgttgtcagtggtaagagatactaataacatttttgaagaatattgatatttcaaccaaaataaattaccattctcgaatggatgacctcaattgatagatacaaattgctatcaatagtgaaaggggaggtttgaacaatataatagaacagacatctaatactgaaagtagaagttttgagaaacgtacaaagtgggttttacaatttacagctgcaaaaatgtcagatggctttggggactttcttgtgaccacaccttagaccttcgttctttagtgacaggctaaaggccacccttcctgaggagatgaacactacattgcacctccaaccctaatgtgcctaagaaatggattggaactttacaaagtttgccaatacatagcataaaccagcctttatgtgactgagagagagaattgggaagatcagttcattgggatgctaagtacagcctggttggaataagagttagaggtatattgttagagactcaaaaataaatctattatcagaactttcatttgccaagagaggaaatagaaagctattgcaaagtttttagagtgggtgaaaaatgtaaaatgtatgtacataatactgtcattcttacttgcttgtataattttttaaaagacagtgcgaactggtggaagagcagtgattgttcaaacagtaaagatgaactctatcaaaatatgctatccttttttggatggcaagtgtgattgagtagtgaagtaaggtccttggtccttcactctagtatttttaattgatcatctgtgacccaagcggaagtctaccactgagtagaaaatgcaatttccagtggcaattaagtatttctaatgccaacaattcttaaagatctaagccaaattgtgaagttggttaaatcataggctgattataatgcatttatatgttaaagatagtgaaaggaaagctttaaagtgacaaataagagagatattggagtattttttaatgatgaatttaactaacttaacatattttatagtggcattgattttacctatttaatagacacttatttttgaattcccttaaattttctgtttataacctattttcatcttgtaaatgtcaacagaaggacccagtggggtagccaagagaaaaactaaggctaaaggtattttcattttttcaaattagccttgagtgaatcaagtttaatgtttgaaaatgcatgacattttctgggaatgttaatattgctactaatgctaaacactattgcttttgggtcttgcttgggtgcaacttaggttataagtagttttatcaagatttcatcaaaggattttctgcttcaagcctataattttaagtcattatcttttcatgttatcaaagctttgtaatagtctttaaattaagaatgtatatattatacaaatatgttatatttgttatgatgtatatattaaatttacatgtacacatcttaccttgttccctaaaacctttcttactttgatttttttgaattacttttgggaaaaaaagatgaagtcttcagtaattgtttttatttctccaaaagctctcatgacactctgtcttagagcacagtgaaagctagtgtgattcaaatgtgtagttttcagtaaaatgaaaacttggatgtaaatgtataaccctacattacattgacatagaatttactgtgtttgatattttaattcattaaaaattattgtccgggcacggtggctcacgcctgtaatcccagccctttgggaagctgaggcgggtggatcacgaggtcaggaattcgagactagcctgagcaatatggtgaaaccctgtctcaactgaaaatacaaaaattggctggacttggtggcaggcacctgtaatcccacctactcaggaggctgaggcagaagaatcgcttgaacccgggaggcagaggttgcagtgagctgagattgtgccattgcactccagcctgggcaacagagtgagactctcaaaataataataataataataaataagttattatacctgtcagccatttgtagactaacagctcagtattacagcctgactttatatgccagtggttattcttgttcatatgttagtagtcatattctttgtgggtagaggcatgggggatgtgcatgcctctatataagcctgtttttctttataagcctgtgatattcttgtggtcatttcacgggcttggcatattgtttgtagtttgtttttttggtgaaatatgaacagatgagacttactatgtgattcacagggttttgtgatttatattttaagatcaggaacttttaatggtttaacctcctatctcttctgaataatttctggggatgaaaacaattttcaccatcttatttttatataaataatgatgaaacaaatggacaataaaatattttacttcttgatctagagaagcaaattaaacattaaagactgaattttttaaaagcagttttcagaataagacatgatagcattgcacatccattttacacttttgcaatgccagtatctatgttactgtccaaacgcattgaagtagaatgaagactcagcatgatcctgaatgaatactattctgtattcttaaaagactgtaataaggttttttaggaagaactgaagaatctcctggttgatcaccaggaaattcagttaatggagaaaccctatgtggtgtttttgtttgttaatcaagattttattagacagcctagaaagacatagtgcttttagtgagcactgcaaatctaatgctcattttgaataccatttgtgctatgtaagttttatgtgattttgatgggcaaaaacatctttcacattttattatattaaagaaatatttcattttctttgtttctgcttaaatgtggcattgcttctgcttaaatgtggcattgcaaacaccttaccttatgatttccttatgagagtacaaacagatgaaattcagagcttttgctaactgctttattaccatgtaaagcaagttgaaagcaataccttccatgagatttggaattagctgtgtgtttcatttaattgctctctcaacccaatgaactagaagacgtgtgttagcttgagttgctctacatgaattaacagggaaacatacttaaaggaatactgatttcatgatgaatataagcagaaagagaattctaatttttccttttaaatactacagataatgatttaaaaatgtcatacacatgacaattttttcctagttaactaataaaatgaaattatatttaattttatttacatatatttgtcttcaaagaagcacgtgtattttaaggacatatgtttttgagctaaacattttaaattatctttgtatatattcttacaaattatgaaaaatttgttcttacgttgccagtgttcctttaattatagttacaaagtgtgagttaatactttgtgcaaagcactgccttcgtggtgccctcaattttataatattgcatgttaatgttttaagacaagtcatactatatttcaagatggaaaatatgacaagcttctagcattttttaatagttgatatttgatagagatttgcacctatttttagccaccataaagactagtgaattaaagtaactttctgaatgtgcatttcctgtgtgtggagagataaaaagagaataccttttcactaacttcctgttctgtgattaagagatcctgtcaataaacattttttcctttaattggaaaatctgaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgtttttctctttcgtggacacctccccaggctcatgtgccaccaccttccctcctctccagccctcccagccctcccgcagcctttcagggggccgttcctcaggcttttcatgggttctccttccccttttccctcttatctccccttttctagtctccctccccaagtcttttactctctcctttccttcactcctcacctcaccgctgcccctcactcctgcatgcttctcactcctgacctccctacaacaacctcacccttctcccatcatccagtacatacttagtgcttaccatgtgccacatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcagaaatgagtatgtttaagtgtaaatatttctaaatgtattgtacacctttttcttaggttaacgccttttactatttaaagtcaaatactttacgacatttagttgacagaaacttcaactcaatagaattatacaacagagaagaaatcctagagaatatctaatatctccaatataatcctgttattttattgcttaaaaattaaggcctgaagatattgtaacctgataacttcgagttttatgttttgattagtcaggattttgccatttttacacattacaagaacattgtaaaccaaaaagggaattctacagctgctttgtttggcagatacagggcactaacttcagatgactagatcccaagtctagacctggaatcagagttctttttcctcttagctcacttcctaagtcttaactgtgctggtttctgcctgagttattctatttggagatgctaccacttgataaccaagatggccctcagcaggctccagaccagtctctagtttaccaatcccaatgcagatggctctgggagagataattccagttggcctggttaggcctggtgaacatctgggaccatttttgtagttgaggatggtgattcttcccaggcgcacacctgtgcacaaagctttggaatgggagttgagtgggtcccactcaaacttcatcaaatgtagggcttctgggacaagaaagtgaggctttgaaaactggacagaagaagaagcagaacatgtcccccaggcatatgaaagttacacgattctcaaaccatatccccgtgttagatcttttctcctgagataaatggaatgtttttttaaaacttatgtacaaaattttaagtgctgtcttcactaaagattttttgttctctcttgaagaagggcaaacaattataagtgaatttgttgagagcattctggtaatttttaccttagtttttaagttcaatggctatgtggcagaaaatacataaatactaaattctaaacaaatgagtgaaaatattttggaataacctaatcatcaaaagcacataagaattgtctattgctatttagtaaagtactttgaaatgttttggctatctcattgatttttcctttgactgttagctcaagaattgaaacacctcaactaaaacatttaaagatcctttaaaagcacttgtagactagaacttgatttattttttcccatctctcttcttttccccttctcttttctttctttttgtaaatgtttcaactaacttttattgaagttgaagtcacactttatccaactgcgtaatatttaagcttcaactaaaaacaagctttcagtcatgattagagggttaaaatcatgcattgcactctcagttttacactttttattcagtaggttgttatttctgtattgtttgcttcatattgttttctaagtataattaaaaccagaaaggttacctttttaaataagccagctacaacgggacaaaaaattcacaatactaggtagttgggagtcagaagctgttttcgggaagacctgaaaagggaaaattaagtactaaaaatgtaagtttattttgccatacccctaacaacattttatttaaattatattgtgacttgattacaaatcttttaaatgacattattggcatatttttcttaaactttgtaagaaaaagataacatttcacattttagtagcaaaatcattgttaagagatagtcaattttgtgaaaatatttgagtgctaatcaatttttccaggatgatcttctatcctttaatatttagatacttccttttgaagcacttacatcatcatcaaatttttggtcatttgttgtgtcatctaatttctgtttcattttctaatggcttcgtatgtgaatgaattttagttattcctaacgtcattggtagccactcttttgaattttttttttaaacaagtctttcaattttattttataggtaatttgcattgtatatagatgatcgtctcaaaatttcacaatgagagactgatgaaattgacataaatcaatcagcatgaacacttgaattaatccagaggactacttaagttaattctgtaggtggttgctttattgagaatattttgtattatgacctgcttagctatgcaagtttgtaacttcagaggtcctcataatgatacttggataataaagattccccatagacacttccattgaaaaagaaaagaagtaaacaagtgtcatttgtaatttgaaatgttttaagttaactgtcatgttactgtccatgaaatggatctggtgacttaggctctatctcctgacattgatttctttctcctgtgtcctcaattatttcttctcctgttaatgcccactggtaataattctcaaaatcgattgctcagaatattccattgtaaaatgcaccttggaaatggttgttttcctcatttgtaaattgaagacaatgcctattcctcaaggtggttgtgagaaccagtcaatgttgcatatgtgtaaacagccagcacatggttgggcattcagtttccctttatcattggtagaataagaatagtaatactcaaccaaaacgtctcagtcaggggttaaaaacttggaagcactgaaactgtgcttcctattcctacttaggtcaacagattgcaaaacaaatatttcagtcctttatcctttgtaatgaatgtgtctttgtgaaatgagtatagtggagcctgatttattctattgagatcattgagggggcaaatgcaaataattataaatgttgcacatgagtgaagccgtaagaatgcttaatttttaaaagaatattgtgacaacctgaaaacacaagatatgaaggctagaaaaaaagttatgaaataaactatagccttaagtatatggtacaatcgagaagcctaataaccagcctaattgtgaaaaacttatgtttgttttgtattcagaacacatttttccatagatgagattttatggtcttcagagattttttttttactctggtccacaaaaattgatttaattctaatatccatttctgcaactctcattgtaactatgtttctatggaaaatgcatttatcattctgccttgggatattaggaatatatttagttttacttctgaatgttctccagaatttctttggttacatccatggtgttaaatccattcagataccttacatggacaaaaatcatggattggctcacataattgtaaagcccaggagtagttttggcttttttcttttgttatgctggatctaggtgcttgaacagtgttctcaacatccatctgtctatggaccctcaggaatgttggctttcttctcgggcagagtctcgtgtgctcatcttcaaccctactccttatggggtgggagataagaaagctgtgattggtgacaccctgggatatgtgagtgcccacttttaaactgttgggtaaagaaaaattggagtcctctaaggaagttagtgtgtttttaccagaaggaggaggaattgatgcactgaaagcaggcagatgatggagtttgtttcccctttttctacccatcccattcctacttctccccctgcccaaatacagagaggtgaatgggatgggccaaaataggtatttcaaaataagaagctgtggagctaaacattgggtactcatgggcataaagatggaaacaggagacactagaacttctagagaggggagagagggagggagacaagggttgaaaaactaactattggatactatgctcattacctgagtgatggaatcattcatattctaaatttcaatatcacgcaatatacccatgcagcaaacttgcacgtgctccttgaatctaaatagaagttgaagttatatttaaaaattaaaaaaaaaaaagctagggagaagagagagatctcattccaaacaattattggtcaacaatagttttagaccattgaaagaatataagagaatgttgacttgataataaatattgccatttagatgtcaggtgataaagtttattttgttgttaagctctctccattttgccccattcagtttaaaaggaaagtttttgtgtttaggaaactaaaggatgggtgatatgtagcagacccataaggttattttcatgaaaaacctagcttgggctaatctgaaagattcctcaataacagtctttggtgtcttatcctttcttctccatttgcctaagaatataattgtataagctggatgtttattccttggctatcgtttttacctaggaatcaatttctgcaagagctctgtaagccttacaaagcagaaagtcatccatttcttttttctttgttctcatttagtgcctcatttgatttcactttgtgtatctatttattgctccatgttaagtcaggtatgcatacatcatagaagtctgcctctcatttccatcttctttgccttatgtatcacttctcttgtgtcctattagagggagatgatctatgcttaaagctgttgggttatttttgataattatataacaccaacatgctgtgtctatagttcccatttattgattcaactaatatttctgagtatctacagcatgccgggactgggcaaggcatgggggatacaagagattgaggtggctgcaatccctccagtgaaatgctgcaaaataagcaaggggctgagagagaaagtaatgagactgaaacgattgtcagtacagcccactagtccctctgcctagaacgtgctcctgaatgtgctcctgctctgtgtggtgggctgcctttgtctctcccacgggacccagcccagtcatcacctctgcactcagacatctctgaccctcccaagtggctgcatcccacacactccagttatcgcactcatcaccttgcctcattcttggactttgctgccagactacgatttatctcgagcacctatcctagtaactgacactaataggcattcattgtttgtttattgaatggtgactatacaaaataaattatctaaaaatatttcaggtgtatatatactgttgaagaatattaggaagaagaaaaccgtgtgtgtgtgtttttgaagaacccaaaagattgttcagtaattgcagtgttttaactaccttggaagttacctgtgactggcagggaggggggtgtaaagattttttttagaagaaattaatgaaatggtaaatttttggaaaaatacttatttaaattatctcatttaattcttaaagcccttcttaggggtcctgttttgtcccctttttgcatttgtggaaaccaaaaagtgtagctgtggttaacactgagatagaattcaaatggaattcaaaggcatcctcttgtcccaggtgcctgaacttacacaccatgctgagttgcatgtccttgaactgtatttttcatgatgttaaagtgagtccactctcaccagtctttgttgagtcccttcattggtgctgaaaccaggctcttgggaaccttattggcagtgtttaattcttttgtaatttatgtctgtttgaaatctgtctgtccagcttgggttacttgaagatgctttgaatctggaatggctcttactgcatatcatggggcagctttgagtacctggtagtctcagaattttggtaagttccgagactgctgttggtatactgaggaagatctgtattcactgattacacaagccaggagcgacaacgaggattaacgtggttacctagtatgcatgcctttctggtgtattgattttccagaatatttctcaaatttcatatacctatgagccttattcttgggataaattgatttatactgctagactccttgcaattgaaacagtaccacttctgagcactcaccctgagcacagataaccatagctggagtaacctggattagtaaggacacgttttctttcatctgtacacctttgaattagtaaaccaaagattaaaacactaattttaaaaaactttttagctttttaatgggctaggtgtatgaaattgtatgaaacaaagtaagtttataattgtttcccaggttttgttgagggagtggcttgcttataactcttaggagaagtaaatcctttgtgttccctcaagtcacagcccttggatccagcatccagggcctttctgatatgcacacctctcttggtgcctcagtcacctttcttttccttggtgccaaatatgtgcccagttgaggaatttcgtacagtcacatgcctcatgctatcattttggttaaggatggactgcatgtatgatagtggtcccataagatcatagtgtcatatttatactgtaccttttctgtgtttagatacacaaacactttgtgttacaattgtctacagtattcggtacagtacgtgctgtacagttttgtagcctgggaacaataggatgttgcatacagtctaggtttgtggcaggctataccttctaagtttgcctgggcacactgcaatgttcccacagtggtaaaatttcctaatggcacatttcaacatgtatttccacacattcctcagaatgtatcgctgttgttaagcaacacatgactgaacttgcagttccctacccgaaacacacgtgtaacttacatagccacatccctgatttccttcagggtctgttcacatgttatcagtgagtccttttgccaaagtattatgaatagtccccacccccacttttccctaatgtgctccctgttctgtgtcttccccgtactatctgtccccatccaatatactctaaatagttcatgtttcttattttttaagtttctctctcccccggaaggtaggtgtgttgttttcatttactgtagaataatgccttgaattaataggtgctaaatatttgttgaacgattaaatacaacatacaatttagtaagtttacaactactgcatatttatggaaagaaatatattgattctttctcattatgggcagcagtgaataaagtaagctaatcctgggcttgggtatttgtgtcactcatatttgctatgagtggttgatttaaagtgctgatttcatttgcatttcatagcttcatctaattttaattaaaattggaggggcaattatatagtgattaaatgcaaatgttttataatttccaaatttatctgattaacctaaagaactaaaaccaaggtatgttttaagggaattaatgtgttttccaaatcatgttgtggccattgctgtggactggcagtatctattcaccatacataatgactggaaggcggctgtggacaccctgttcctcttggcagcacaggaatggaagtgggtcccagtcctgatgattaacactgaaaagggagactgctggtagcttctggaaaaaatttcctcaagcctaagaaagaagcagagcaagagatgctccttttgcttctggacatcgccttgtctgaaaaagaagcttgcagctggggagctctgattgccagcctgagggtgaagcttgacctgcgatgcagtcagccgcctccgcacttcttgtttagttagatgataaatttccttcctacccaaccattataagctggcagtttggtaactgcagccccaggaacatcgaaaccgacacatctcatgtcataacctaattttgaatatttatttcattgctacttcattgccacttgtacctcataataaatccatttttgaaaacctttcctatgactgaattgagcttatatgcatttacttttcttgattcattttcgcttgctttttccctcaaattttagaactaaaatgagcttgggtggcaaaaagttttttggaaacactgaaataaaatcttgtacggcaaattcttccatatgggttgttaaagcaattatagtctagaatgtgtttttgttaagtttcaaaaagtttatagaggtctagaggaggagatacagtaatatgatctcagcttctttgaagtttacaatttttttttgtactgatttcatatctggaaatagctatgaccaggtattaacaattttataatacaccttccactttggacagggtaaaataatcaatattttttgctctgtgcttttgctttctcctgtttttcctatgttttgcaatttcaattttagagacaaataagttcaagttggttagagaaagctgactctcaggggcattgtatgtcggaatgttggtatactagtagtatttgaacacgtagcattatgacttttcaaatgaaacttcaaaactcattaagaatggggttttcaggcagtttagatctttatcgtttggtgagaaaacatttcattgcttgtataacacacggaacacagtttgagagcctgctaaagtggggtcagtgaaggatgaccctgtaatttttcattcagacagatagttttgagagtgaaataatctcaggacagcagacataaactgggagtgtctcaggcaaactagacttatgacactgaaatggtggatgctggagcagaaatacggatctctggtacataggagtagagaagtactaatgtgagtccccttccctcttctactcagctactggagtgcacctaagaagccctggccctgcagggaatctccacagccatttagacttagcagagtagtcacaccactgggtgtattcagcccttcaacaagtgttcattgagcaattgctatgtgccaagtgttagctgaggtgctgagagtgcaaagataaattacttgattcttgagattcttaagctttttcccattcattcagcagaacttggcaatgaatcattccatacctgttccattaacagttgagggatgtaaaaatgattatttaaatggtaaaagggagggcagccctaaatttgaatttgaaatgtgatgtcttttactaggccttcatctctaccccctcctccctgaacttgaactacaattaggacctgtgtataatccctttgcagcctgtcttacagttagaggtaacttaggtatagaacacaactgtatgtgttggtgtcaggtgtactagtggtgagttttgtgtggaaatagtgttgcaaatggtaactagaggaaatgtaagtgatgtggcagggtcctgtgtatctgtctctgtttcttttaagatttgggaagaggaatgtgggagtatgtttttgtccataaaagaaacatgaagagacataggaaaaataataaaaaagaagagtaatacatcgaaatgaaaattttccagaccacattagtgtgcatacatgagctgcacagagctgcttaagattagaatactgcccttcacatcaccttgaccttcctgccgcaggctgtccatgcacagtgactactcttggtaggagattcttaatgaggtcaggaggagtccaggatcagcaaacggaatctttgaactcttgaatttagctgttttctaaatacttggatttaattgaggacctattttaatgttccacatacaaaatatcaaataacttcaaataactaagttaatataatagattttagactggccttgactttaaaatcagtttcatgttaacataccctgctgtcttattaggacttgtaaaagggagaagaacttttaaattttcatatgttttagctgttatagaataatatgattacttgtaggggtttcctttagatgataataaatagttatgtatgatttctttttctttttaactgtttttcaagtagaataaataattatataagtgaaaacatcgagtgtacctgaataacagaaaattcaagtgcattttagttgcctcattgctgaattcaaactgcaggacttaggaattaatcgcttatgaaaacaaaaggagcttgaactcatattgaacttttggcaggtttagacatgactgttttagagattcatgaacatttaaacaatgattttgttttaatttgaagtgaaaagctaactaagacaaagagatatattcaaggctcatgtgaagttgaagagcaaactgttttcctacctcactttttaagcatacaattttagaaactattaattagcagcactattaattaaatgtttgaaaatattatttttcctggtttaatgtgacagaaaaccccacaaaaactcaagttaactttgtgaataaaaaaatgcaggacttaaagagagatctacttcagagccagcagtcccgccagaagaggctgagccacacactgagcccgaggagcaggttcctgtggaggcaggtaagcttgtcctcatcctcgagtctcgcccaggtgtgccagagcctgacaggtatccgcatttacagaatcacgttttacctggaatttgtttcacatcatttacagaataattaactactttttttctcttctgaaattatgtagtatttttctagtagaaattggaacaggataattttaatttttaagatcagctctaaggcagacagttgttctttgtccaaaaccacacatttaggaacgtcatgaactgaatgttgtttcttgattccaattccagcactactgtactatattaccttgaaagtaaaaatacacacaattctacactactagtgttatcatttgtcacgtgatttaatagagtagatctagtggtttctcagtcttttttacatgagggtctcgtttattttaaaagacttcccaaacctccctgtgggcatctatggagcctgttttgtgtccacatgggttcataaatcaagcatctctgtagttaccccaaagcctatgactataggtaggaaagtcgtgaaatattttaataagttagtaaatctaatacagtctctaaatctctggttttcttatgccacctattgaaagtttaaggaatgacactacatatttactgaaaacttaagtactgaatccaaatggtactttggctgattttttcactgtgtgctgaggaataatatttgattttttttcctttaaggccaatatgttgctctgagttttgttatttgttgaatttttaatcctaggacaatgtattctctctcattcctgtagaattgctatgatcataccatagctccagaatagatagtaacttttaaaaagttttataatttaatgtgtgtttggatttagcacctcaaattttactttgtactaaaataaaacccctcttgacccccacatttcttttttctgccatctaatccctctcccctctacaacagccacgattttgaaagaagaatccactattacttttttaccttatttttcattcattttttttaacccattacactccagcttctgcatcttccaatcccctccagaggagagaaggagtatttgcaaaattatggaaagttgaaatggcatggagtcctcactaagttcaaagccagtgctggtagcagatgattctggagaagtgtgtgaggactcagttgtggaggtattatattctgctcctaggaactgagactttcaccagtttgggcaaagatagccattaaagagtgagcagagtgcaccaccctccacttctagtaactcagattatattctctttggatggtgatttcagcagttatgaacctgggaatccagttaggaagctatcttaggctttgtgagagaggatggcgattggcagactctataatagcacaagactacatatataaatggcttgtgaaatataaacatttattaaaaataggcatttttatgctttggaaatgattttgtagtgtgattagcatagtagatattacatttaaactcttttccttcctgaagtctaaattaactttctattttttgtcatggaagattagctctttgacaacaaccgatgtcactggcattatctcacatgacagcatttatgataccaagtgtagtgctacttctattcactgaacatagattatatttattagagaacttagtatcaatgtagttatagcttcttgttcattgtgtgatgttgcagttaagtctaataatctgataagcaccacagtgtttttggaatgtcatcatttatgttcacttttgtaattcaatttatttgaatttatggatctcagtgtcagatgtggttctccaaagctgaaaggattgtcagttacaatgtaaggttttctactgacacttcctgacaaacctgagtgagagcagtcggctacctctgagtattcagtcctctcacctgcaggagtgccctttctcctctcagggaagataggtaatggttgaccagatacttcaatctgtattgaccttgtcttccacatttctgtctttatttccaactatttccctttatgaaagctttgttcttcccactttattttatcattattgcgaattttattaattagaaacaagtcattttgcttttaataaggctcttttttaaatacaaatctgagcctgagttttctttaaaaatcttattgaaagtattttaatgcttaagtctgttgacagaataaaacaaattttacatatctaccatgtttgccaacacagaacaaaaaaatgtaagctgatagagaaggcatgcagagttgcttagtcaaatatattcattttaatgtgtatgtaccaatgtcatatttgagtgttaggggtccatgttgatgtttgagcttttctacttagctatgttttgcaattattttagaaccccagaatatcgaagatgaagcaaaagaacaaattcagtcccttctccatgaaatggtacacgcagaacatggtatgaattaaaatctgctctttgttttgagttactaaaataacgcttagttatgtaaaatgacttggacatttgttttaaaatttaaaggttaattgggtgtttgtgttttttaaaaagtttttgaattcaaagttagatagcaggtgttgtttttgaaatagcactaaacttactttattctacttcaccgtggaggaactcactgcatacatctaagagagaactggtgggaataaatgagaatgaacagattgaaaacagtgatccatcaggaacagaaggggaggatggagaggaggaaagtgggacacaggcccacggtcgggttcatccaggtgttgtgctccacctcgattttgcttcatggttggctggtcaccacaacaaaaatgatgacacttttaattacataggttgcactaagcagacaggaaaaaaaacgtgagaatgcaaaacattttcccagtacttaaatttaaaaatttttcatggggagctctgtgtagaggatactaagtaataacccaggaactaacgttttaaggttttataaggctgcttcttgaagcatcccttgataaaaacagagatcgtgatcccaaaacgtatctcatgaagggattgtggagtgggcaggatgttctggaatcctgattctcctgatgctttggtgtgatccaagggtggcctaaaggaaaataaaattacgtttcttaaaaacaaacaatgccctgtagtttaaactgttttttgccagtggatgctaggggtgtaggagcctgtatgcctttatttctagcttctttgcagctcggaaagccactcatgggcctatatgagcaagtgcaggcttccccttcctcaagccttccttccccacggcaccccaactttaacttaacagaaggaaaatccaatctaaataaataagtgatttaaatataatggggtaagtgctgtcatggtaataaaatatgggaagctcttcaggtcttactcagaaggggggtcagaagaggctggtgtagaccttcaccaggccagtgctggtggtgagtgttttaagcagaaggcatatcccagagacaggaaaggacctgaaagtagttcagaatggctggcacgtggaatatgtaggtggagagtcatgagaaaaaggatattttttacttgattctaagagtaactgaagccattggggaaggtatttaggagtgttgtgccttctgtctgtagcatgaaaaatgcatggggggatgcaagagtgcagctgggagattagatggaggttgtgcaggtaacagtgattcaggatggtagcaaacttgcctcagccaaaggaggggatggagagaaatagaaagaaccctaagatgtttaggtggtggggggtgggcaggcagccaaaagagggaagtagtcaagtctagcaccgtgttctggccacagcctccttcttggacttgttcttttctttaatcacatttagaaaatcacatttatggcccatggttataaatattctttgtatgttgataacttttaaatatatagctgcagccctcattgctcatctaaactccaggtttacctaactgcatacttggcatctccatttggatgtcttatgggtgtttcagacttaaagaactcatgattcttcccacaccccatagctcctcctcaccccagttctccccagattgcttatgctagtcttttatattttagttaatggtcctcctaccctcttacttgcttaacttgaaaactcgagagttttctttgatttttcttctcccctcacatctaatccatcagcaaatcctgtcagcattgccccagcactgattttggctctctagggcctcggtgtgaccgtggcttcttgccatgactgttgcagtagcacagtagcatccagctgggtctccctgtttccatacttgctcctctataacctgtgcttaatgtggcccagccagttgtgccttgtctgatcccagcctctttttccccttcagtgacttttctctagcccagctgacctctcttttccttgtaattgccaagcctatcactgctttagcacccctgcacctggtatatcttttgctgagatgtgtttcccaccccgcccaatcacatctttcagactgagcataacctccctgcccccatcatggtgcattcacaactggattcaggtcctgtatctgccattgattagccatgtggctttagcacagtttttcaagttcttcatctttcaaagtaggataccagtacctgcttcacagggaggatataacagctgcagagggcttggccatgcctagagtctcatgaccccttaggaaatttttcatgatgagactcaaagatagtgttcaatgttagactggtttcgctacagaaaacaggaatacttccactgaacaaccgcatacgaaagctaaatcctgctagtgtaaaaatcatcagatttcactggatagaatgaaagaagaataaggaaagaggaatatgataaaaataaaaagagaagtaaaatttgtagcagaaattcaaattggtgatttgctgaatagcagaaaatctaaaatgaggaaaaacagtattgcaagctatgaggagaagatagaaaacaaatagcatcaacataaataggcctgcctgattctctaacacctgagagcattgccttgccacgctaaagggagagtaactaaggaaggcttcttgcagtctgggctggggttgtggggtagggggattcagtagcagtacaaatgacaatgttgttattactgtaataatggtgataatgacacctaaatacttagggccaggcatttttctaagtgttttaatcttcataacaatgttacaaatagatattattcccattttatgggagggaaatctgtggcacagggtagttaagtaatttgcccacagtcacccagctggtatggaagagcctgaatctacagccatgcatccggaccccatactcgtcctaatccctgagctgcactgcaaagccaagtcctgcccattcactttctttagagtattatacacaggagatactctgctggaagccaggtcaagttacattgggatgcaatacccagtcttaaccatgttgcagtggaatcatgcaacatgtccaacctctacacaaaagaagcagagcagttcaatatatcatagaagttaatcacagaagagaaagtgggcatctttgcataacttgaagcctaataggaacatttgaatgcatagtatgattcaggtaaacctgtgacctagcatataatttatttttatttatttttaatttaatttaatttatttatttatttattttgagacagagtctcactgtgtcacccaggctggagtgcagtggcaccatcttggctaactgcaacttctgccccccaggttcaagcgattctcctgcctcagcctcccaagtagctgggactacaggcacgtgccaccatgcatgactaatttttgtatttttagtagagatggggttttaccatgttggccaggctggtcttgaactcctgacctcaagtgatctgcctgcctcagcctcccaaagtgctgggattataggcgtgagctgccatgcctggccctagcatataatttagataggtggctagtcactctttgctatagaatatttgaatagtcatttaaagttgttacctggaattctatgtcaattcccaggaaaaggccatagagtagccttttctttgacctgaggataattgaagaggcaaatatattagtaataattatgaattcatttattcattcatcaaatatttattgagtgcttcctttagctagacatggccctaggtgactgggaatatataatggataaaatatataagcttcctgtcctgatgtgtaacatcctaatgagaggaaacctgtcccccaccacatatacttaggcagattagcacttggccagaggaagaaaatagctgtggagtggacaatggtgtcttcagcggccgaaaggaggggcaggggaagccccagcagcaggagcaggtgtgtggcagcccttcacaaggggctttcatgtctcagttgtatgttgccagtgtcactttgttcattgtcatagttgagggagaagacttgcaacaagaagatggacccacaggagaaccacaacaagaggatgatgagtttcttatggcgactgatgtagatgatagatttgagaccctggaacctgaagtatctcatgaaggtagaacacttttttttcaagttttaggataaaatataatcaatgacttctaattactgaagtttttcttaaacccctttaaaactgatatttaacttttgcttagatttttaaaagttgaagcttaaagcttcaattaaagcaaattttttcttaaaatagataccttgattttggttcaaagcacttttcagggaaactcagaatatacaaatttcttataaatagtgagtcaaatacttgaggaaactagttttactatattcttctgcttagggtgctatttgttaaataaaattcaaacaactgatgaaatattggacttgataatctatcacaggctcatgttcacacatgaactctgtaattacagtgagcaaaacacaattcttagcttctgtaccaggcattggcaaacttttttttgtaaatagccagagagtaaatatttcaggttttctggatcgtacagactctgttcagctactcaactctgccatcacagcgtaaaagcagcctttgatagttcctaagtgggtcagtgtagctgtgtttttatacaacttatttgtaaaatcctacccaacatggctggtaagtgcagcggcttgaacacagctcactccagccttgacctcccatgctcaagcagtcctctcacctcagcctctcaagtagctggaaccacaggcatatgctaccatgccctgccaatttttaaattttttatagtggcaaggtctccttatgttgcccaagctggtctcaaactcctggcctcaagcaattctcctgcctcagctttccaaagtgttgggattgcaggcatgagccattgtgtgtccagttagcaaacactttttaaaagcataaaaatgaaaagtagtttatctactttgcacaatactaaatattttggaaaattactttagcagcaggtagctcctactttatgagtacatgtatttccaaaaacttatatccatgcctattgtttagaacaggaaatgcactttcccataaaaatatgggatggtttggttttcaaaagaattgtatataatgcataattttctgtgaaaaatacaagcacacaatccttttgaacatctatatgatttatttttgctgcattacacattgaaaataagcacttatagactaccttcagaactttatgcctttagtaatcatttatgtcatgatttctttgggacaaggtttccagtttctgagtagggatactgataaaatgatttccacatttcctgttgcttcttctctccagtctttggcctaaatggctcagtaagattgacagttgctcagaatttttctatctacatgctgcttatacaacaaatttcagttaagatgctgaaataaacagaagcatgaggaatttgatattcttaaagttaggagtcacagattgggagtaggaagaaacacttttaagaagttcacaaattgcagaaaccttactttctgatctcatctttaattaggacatagatgcagtttgaacttaaaagttggttgttaaaagtcttcagaaaataaaaatatttattctttatatatgcattaaataaaattagcaaggtcataagtgtggtgacggacagatagctcttctgctatctggggtgtatgggttaagtgttcaacacatttacccttcagctccctaagggtataaagcctcttcagctgtttttctctgttcccatccatagttgctgtactttcgctctagaaaatggtaggacaggtcgaggagatagcacattctagtgggttgtgaagtggattagaaatgaacggctttcctggtctggcctgtgtcactctaagttgtcctctctctttagtccagggggtggtggttgtcagccttgtggggatgagtggactgagaaggagaatgtgtgagacatcccacagtgtacttctagtgaaatataaaagtgttaagcagacttttaattgatagtcccattttttaattttttaaataaaattaatgataagcatagattcagagtacatatacgggatatatacataccattttgtaaaagcagtaaatatcaatctaatttttttttttccagaaaccgagcatagttaccacgtggaagagacaggtgagattttaatttaattctgttcttaattagagtgagtcttcctttaaaagggcatcataaaatacataatatctattattaatgatatatttaaattaatatatgcaagatatgcaattaataattttattacgtcttatatttatggtatttctttgtgaatatacttttttgtgttttgatgcctagttcctgaggataaattttcagtaggattactagttcaaaagatacaattgaattgcatgttttgtacctttcaattacagagtcaacgaaaggtctaaatcatgttttgtcacatgccagcgcccttaaagggcatggccacaggaggtgggcgcatcatctgtcagcactttactgttttgcggtttgagtgtaaaccagttgatgacaggccccccttactcatctttgcatttggcatttaacacacttaatacctatttgtttcaggagtgaacatgtttgaatatcattatgacttgattttgcatttcaatcataactagaaattgtgtctttctggtttcgaatattacatgtattccttatttgagacgtaatttcctaattattccataatttatagtttcacaagactgtaatcaggatatggaagagatgatgtctgagcaggaaaatccaggtttgtaaatgttaaaattattgatatgtgttttctgattgaggcagtggccaaggccgttttattccagggttaacaattgtgattcaacacagagatccctgtatggtatttataatcacttttgattggtcagatgtttatagaaatgtctgaatatagtttaatactacatagagggatgagagaaaaaggagacgtatttttcaaaccactgttgagactttggtctttgtaggtaaggtgctggaaagaatatttgaaaattgaaggggcagtatgatgtactataaagtcattctgggtacaaatcccatttctactctttcctatctttttgacttaggcatcaaattgtggaacgttattcagcttaaattttattaaatgataatgaaaacatctatctggcaaagttgtgaagataattaatttatgaatctcctagaatgctgtctggcaatgtgtttggttttttcctgtttggcaaaggtgtgtttttgttttttagattccagtgaaccagtagtagaagatgaaagattgcaccatgatacaggtattagatgagcattttcattagatttaaaatattaccttagatttttcaatcacatgctgtgtttacatggtgatttttcttttaaaggcatcaaagaagtaatttcgacatctaatgcatgagattttgttttataacaaagttagactgttataagaatatcaggctttcatatttcacctcatcaactaaccattccataacaaaacaggatgtcaaattttaatgctgtttttgtgtatcaaattcctctgtgccaatttgagaaattttaatgaaaataatttacctgccttttaattgcttttgggcagaggcatttattattgactgagcagacattaatatttgaaggagtagagttctgtgtttacgattaagtagtattttgttttaactgaacaattgtatagaatgactcagttaatacttattttgcttttattctcttttttttttcagatgatgtaacataccaagtctatgaggaacaaggtttgcaaatgctttcttttttttttttttctttttttttttgagatggagtttcgctcttgttgcccaggctgcagtgcagtggcacaatcttggcccactacaacctccgcctcctgggtacaagcgattctcttgcctcagcctcctgagtagctgggattacaggcatgtgccaccacgcttagctaattttgtatttttagtattttagggtttatctcaaactcccgatctcaggtgatcctcccgccttggcctcccaaagtgctaggactacaggcatgagccactgcgcccggcctgcaaatgctttctaaccttaagccaccttcttgttttaaaatatacctatagtttgactacaagatgtggaacattatgctttaaactataaactttgcaacttaaaacatccagatgaacggtagcgttcaaagaattcacttggggagactgtttacccattccacggcttctgccattgcctaaataatttcttaaactctttacaagttgccttaggaggcagttacagtcattcaagaaaaccaatctcagtactttatagttgtgtctcttttgactaaaatatgcatgaacaactactttagccggagttaaattgctctagctgcttctacaggttaatcccactctcaaagatgactgatttgtcaccttggggaaggttaagaagcactgtgttccaggcttaaaggcagtatggagaaaacagttctggcaaatttgtggcatcagcagcatctgattcagtttaggcctgtacctccctcctcttgtgtccaagcattgcatagactattgtgttgaactccatgaagtagattttattttccctgcttcccagaggacagaaataaggttctgacattataaataagctgcccaagaatgtatggctaagaagtaatagaaccaataatatatcctttttattccattatcctcaaagatgattatgtagaaagagagaagtcagttgggtataactttatgtgtaaagcaagaacgatgaagaaatacatcgtaattgagttggtggatatggaggactttctatgttctagatggttttagggcctggaattcaattatgagtaacatagggtccctcctttcaaggagtttacagtgtcatgatagatagtgaatcacaattgaagaaaattaggagtgtttataaatatgaatcatatttatatgatgatttaagatttgagaccctaccaagttcatcatctatagtggctatttctaatgggatatgaatgacaccatgggaaaaatcctaggttgtgtctttaaggtactgataatttttatgaaaagttaaagaatttggacctgatgtgttcacaggaagatttggggccgagggaaggttggggaataatttggtcttgagattgcacttagattttctttccaatcttgaatttgaaggagaaaataggaatttataaatacaagttgcatgtaatgatgggatttgagatattttcctcatttctactgatcattataatgtttttaaaaatataaagaacatgtttggaatgcaatttgaagactaaatctagaggaatttaaattcaaactcataagaagtataaaattagataccatgcgaaaagaatgttatatgttttcatagggcagagtatcataataaatgtaatttaaaatgttagcaaaaggcagtaaatataacctaagagattgacatgatttggtaagctactttggatttctttgttatatagaacataaactgtttcaaacaaatagatctaattgaacagtgtattattcactatatgctaaaacaatacctttgtgaaaattcaggaatcagagcagagaaaccaagtaactgacatgtaagtgaagctgtaagtagggtgaaaacaaaaccacatttcaatgggagaatagaatatattctgtatgaaacttgcaaaccccagaacatacacttcgatagaactatagtaggaaccagcttctacatcaaagataacctagaaatcatcatgcctacattggacaaacctgggaagtgacagtatggccttaccatgtaattgacttatttattcatacactgtttagtgtcttcggtctgaaacacaggacactggagcagttctagtgaagaacacccatggttcctgttctcatggatcttatattttagtagggtagtagaaattaaacaagcaatttcactgtagttttcatttccagttgtgataagtgctaggaagaacaagtacagtggtaacaagaatatgtaatcaagagaccttacctagtttgtggatgaggcagggccttcctgaagtttgagctgaaggtgagaacaattgacaaggcaaggagaaaggtgactggagagtcgtatgaggtctctgacgtgaacttgcaagagtaaggctgaggtggtgaaatgggctgggttcagaggatgcctgtgagcaagatcaaggacgttcatcttcacctttgagcactgccaagtcagatctgcattttgaaaagattgatcggtctggcatgcaacaaacagactggagagacaagagtcaatacagggagaacagttaagttagctgtaatcatccaaattgggtctttccgtgcatcacatctctctctgtctgaaggaaccaaaggagatgagtttcaagaaagggatgttcagtggtgccctgcgctactgagaaccatgtgagatgagtgctgaaaacctgccctgatctggcgctgcagtggcctcaacgggtgactttagctggaactgtttcagtggacggataggacagatatgatagtttaaaccaagggtggtggcaatgatggaggagggaagtgggcaaagttgagaaatgcttagaaggtaaaattggcaggtcttcatgcatgggtgtagctggggggagacaacaaggtgccaagagccacatacactcttctgcttctgcagcctggtgacagggggtgctcttttcctaacgtgggagagactggagtcaagcacggggcaggggctcatgagtccagttctttacatgatgatagtgagatttctttgaggcatctgagaggagagatcaaatgagccatttggtggtgtttgactctcagaagagaagtctacttcgtgattgtgagtgtgggaaccatcagagtagttacgtggtcatcaggaccaagctctgagatcccttaaggagagcagattgagggagacatgaggtggttctatggctggactttgaagaaagccagcatttaaggacggctaagaaaaagatgaagtgaaaaagaagattgagtgggagaaacgaaaaaccaaaggggagagtatggtcaccctgaagtccaggggcaacagtgtttggagaagaatggtgttgctaaaaatatagcgagggctggcgagtgtccatcatatcaaatgaggcactggagggggtctcagcaggagccttttcagggatggggtcagggtctgaagacaggcgggagtgagttgaggggagaggaagagatgagccatgagatgtaaatgactgaagaaattagattgttcaatggaagaaagagagggtgacgagaagcaagcttaagaaagagtggtattgcatttttaagttcttagaagcttgagcatgtttaaatgctgacactgctcagggcaacagagtgagcacacattcactgctccttcatctttcaaatgccccaaaaggacaaaacgacctattaaacattgttccctgctgtaccccaatactgagagtgtctgaaagatagtaggtgctcaataatttttctttattaaatgaataagaaagaataaacttacaaccatgctgggaaaaagaaggatgttttcttgtagtgtgccagaaaattggaggtattttggaagatcaggttgactgaggaagctttgagccactgggccctggagaggcctgtgtggagatgagacttccttgcagcagagcagagaagaagcactgagcctcatgccagcaaatgagggaggcaagggcagcacgccctaattagggtggggaacgcttcattctcaggggctggcggcagaggtgtttggccccaggttagaggtctgagaattgtttcctaaacaaagcagggaatctgcccatgaacaccaggatccagttgattcccagggtacagcttcggctaattcaaaacctccaccacagacatgaagaaaattttaaaaaggtagtaaaattttaaaaaggtagtaaaaagtggctgccctggaattagaatccaggcctgttttaccctagaccaaactcttctccaccctactctctagtcggctgtttcccagtgactgaaccttgcaggttcaaagatgcataaggcattgtctctgcccttaaagcatgttgtcagtttttgtgttacaatgaaagttacgggattttgtttctgtttttttttttttagcagtatatgaacctctagaaaatgaagggatagaaatcacaggtaagttttttctgtaagcacatattttctgcaagtcagctttccctgtattttgttaaaactcctacctgtggaacaaagagtcagtgtagaaaaaatgcaagacattttcaagtcagtaagaaaataattgagtatcaaaattaaagttaatattctaatataaatactctgcagaagacccagtttaaaaagagtcaaatttagcaatctgagtggacacgagttaatttaggaatctgaatgaaggcgagtgaatgtaagatgtgtcactggtcagcaacatgtaatggattctgattttattctttattttagaagtaactgctccccctgaggataatcctgtagaagattcacaggtaattgtagaaggtaagataaatttatggaagtggttttaccttccatatgagaattgtgtttgtttattcagttatttatcgaacatttcctacttgctgtctatacagtgcataggagctaggagtacaagagggaagaaaacacagagtcctcttttcattggggctggcattccagtggccaaacagataataaataacggaattaaggattatgagaagtacaatgatagtgataaaaacaggctactgtaacagcaaacaattgatgagggtgtggagggctaccctgagtagcagcaggttaccacccctgaggggtgatctggtgagaagggcatagctatgggcagagacgggttgaaagatgggtctttatgtcatgactcacctgggaaaacaaaacaaatttttttttttttggtggtggagaactgaagggatggtttctgaaaaacaaaaataattgcatgtattaaacagtggcgcttcaatagaacttagatttaaatacagttcttagttagcattttacagttatttcacatatattatttcagttgctcctcgtagtaggcactgagaaacagggagcgtggagatctttgtacttattttgcaaatgaagacctgaagctggagtgaggtcaggtgactggctagccctaggtttcatagctgtaagtgaccaaggggatattcgacccaagactgggacctgtgggtgactctgcgtgggggtgtgaaggtgtgagggaatggggtctctgctttaacaaccataagttgccagggggagcatgtaagagggagaattttgctcttacaattactcttaaaatttaggagcagctaattgtcacctttcagattaaatgttactgcttttgagcttggttaggcagaaaggaaaatggaatggtgcagttgactgaaatggggggagataggtataagggaatcggggaggctaaaattgctgtctgtgtccgcttagctgctgcgagagacccctgtacaggcactctgggcccttgtgtaaaggcaggatccatctctgtgtggcaaggctgaattgagttgagattttttcccaccttgtgttactcagttctctatgagggatattaatgttctgaagaatattactgagtctatatgtttatttggtgagaatcagaagatggaaacccataatctctgggcagaactttctccaacctaccctacatacggtttatagaaaagaactatgcaatttgaccctacctttcttggtttagaaatagttttttcctaagacttttcagtattttgatatgttgacagaggacatagcagaggctgctaagggagtttcctgtcctgggcagtgaggcacctggctatgcacctgccacccatcctgcagcttctgtgctgggctcctgtagtgcctgagtggacagtgaggggagcttatctctcacagcaaccaaccttgttttccctgtctcctcttctcttggccggttgtatcaatatatacttggattcccagaccagaaacatggaactcgtttttgagtcctctctccctctgtctctatagctaatcccaagacctgttaatagactccctaaacatttcttaaatccatttttttctccatagctcttgtatagccccttgtctggctcagccctttctcatcttcctagataatagcagtagtctgctagctagacatcttgattctgttcttgtcccctccaaacccatctttcacatactgttaggatgatctgtccaaaagtatagctctcattgtatcagccctgtgtttaaacccttctgttattctccatctgtgtcagtaaagttactttcagttgcagataatagaaaacgaaactcaaactggcttaagcaataaagagataggtacagatcagtcagggccttgcaaggcctactaaggctttttggattatattctaggcacagtgtgaattatgaaaattcttaagatatagcataatctgatttttgttttagatgtgaaagtgaattactttcactagattgaatggagcaagaacggaagcagagcgaaacaccctgttaggaaaatattgtgtactaatccaaggaagtgattgtggtagcctgaaataagatcatggcagtgggaatggaggggaaagtgttgaactcgagatatattttagaattaaaattaattgaccttcctgatggttgtgaagcaaagatgaggaataaagggggtcttttatttggtttcagtaactattagatgatggggccatttatagagaagaaaactattattagaatgtattaggttggtgcaaaagtaatagcaaaacccacaattacttttgcaccaaccttatagaagaaactggtttaggagagaaaataaaacgccccagatcagacattttaactctgggagttatgtgatatatccaagtgaaagtatcaagtggggggttgaatatgccaacctgagctagttgggtgagttttaagatgaatataaacatttgggagccattgtcgtagagatggtattaaatccatggaaactgatgtgatcattttggaagcaagtggagagacgataaagaggcatgcccaggactgagctctaagaatctaatattgtgaggttgggtggaaggtgaacagccattgtgtgaggaggaaagccagtggagaagtagagaagggaaaatgtgaatatgtttcatgttgttgttgagtggcccaggaatttcaggactgagaagttatcagttgcatttggccacgtagagattgtgagtgatcttaccaaaagccatttgagtaaattaggggaagagaaagccatacagaatgaagtgggttcaaaaagacctggagtaaggaaaagtaggctataaaataggtaacccagattgtgctgatagaattaattcacggtttactttttagaaatcatgttattacatcatataccagaagaaatttcatatgagtttgttgaatgtatattttttgtaataaatttagatgaaaatttaacttgcaataataataaggctttcttagtataacatcagtgttggaaataacaaaagcagcaactaatactttatgatgtacaatattttgagcgtagaataacaaaagtaaaagaaattctgagaaaaatattggcaaagttgataaagtgttaatatgtctccaaataattaagaacaaaataaacaggcaaacctattaaaagccagtcacaacatagctattcaatagtcactgtactgctgttataagaagaaaatattgccagatactaacagtggttagtgggaatgggtgtgatttttgttgctgttttcaattacttttatgtgaaatatttccaaatattctgttttgagcatgtgtcattttttataattagaagcaaattaatgcaagaagaaaaattattaaaatagctccataagtgttttctgttttagaaaatactgttaaaaaaatctttcttttggccaaagattgttaacaattcttaaggaccaaaaggaatgttgatataatcttatctctaggttaaggtaatgttaaatgggttgctaggtttgaagatattaatatgtgatgtaatttcatggagcaaatcagatcactatgtctttaaatcactgggtggggacatctaccatctctttaattgtaactgggttgaagcaaccaaggaaaaagacaggatattaaacattcacatccatatctttgactagtctcagaatatattatctggaatattagttttctaaaacaacttcatgaaggatagtgtttgatgttaaagaagaaataagatactttaagtgtctttccacagctctcttatcaaatctgatgcaaaattgtggtgaaagcataagttttagtccatagctcctttgctgggcagtggagtttgaggttagtcgggcaggtactataaaacctgctgtgctgaaccgttgagaaatacacaacattttgctaagttgtagctgatcattctttgttgtgagggtatagaagcctaatgtttttattaaaatttcaattgaattgtttaaaaaatctatgaaaagtatcatcattacttaaatctggcaacgcatattttaaacactgatcagcaatatgtaacagattataactttattatttattttagaagtaagcatttttcctgtggaagaacagcaggaagtaccaccaggtatgacattttgtatgttgtattttcctcttttgttatccttaaaaatcctgttaatattaccaatagctttataatgaatctacgaaggataaaaattttgagagagattaactgtaccttaatttagaatttttctgttttgatcagttcaaccaaagtaatggaaaatgcacatcagattcagtgcagtacatatctgctgagctagaatttgaggagcattaatgatcatatgattttgccattatagatggtggtagtagtggaagttagagtttttttgttttcctctttgattgacaggctatttgatggagaatatggaatcagaattgccttgggatgaaagttgaatagtgtataaattgtgacattactcctcttcctctccattccccatctctcctgagagcatctttagtgctttgtgacagtccaggctgcccagtgcttgtcagtgtcccagggtgtttccttttagttcactgcattacatacttttccctgttttttcctactttcctctacctgagccctcttgtcaccagttaatataaagaatggtaacagcatttccaccaaagcctatgctttcaaatgcattttagagatggcataaactatacctgcaaccagaagtgagtttataaacctcgtactctcatagtgggaaagaatgttctatcaaacaggatttggaaaatcctacctctttcccaagtgtatttcttctcatttctgcattttatttttgtgtcatatttatttgttcaacctttacttatattttctacattttaacatgaattttgtagcagtgatgtgcattcctattactgattttggtagaactaattgtgcctgccaaaatttattaaatactaaatttcaattttctttctttaatgataaaaaaggataaaataatcaaagaatatatttagttatatgtgggatgccttaggttttgatagttgtcctgccatgtacattaataataattatctgcagaaacaaatatttgattaagagaatggaattgttggtattataatatgaatgagaaaagcagtccatggagaaattgaccttttacatgatgactactaggcagtgtgtatttgtgtttaaaatacttggacagggcaagggcagctgatatttatgtccttctgctggtttccttttcatttttgaatactgcttcacagagtaccctgtttgtatcaaagaggcaggaccagttacagaattagcattttgatgactattccatgacttaacagaaaattattttatattcctaaaaataatgtttgtacaaattaatatatttctagttatagttcatattttaaaatactgatctaatttttgtgaagatatgaaagataatatttttcagaccaaaaatttctatacttttaacattttataactgaacccaatagtttatttggaatgtaaatatgaaacaccaagtttctgaggtgatggaataaggtgcttttttagatttttaagaaccaaagcacatacaaatgaagatctgattaatatgcatagttcccgacctataataagctcccagtaagttttggctatgactattgtttagtaattaattagcctgatcttagaggtagatcaagatctacctctgtgatggatgtgagggccatctggctgtgacatctgtcaccccattgatcatcagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatcaagagaagctacattctgaaagacctcatggagaagttgtaacctgtaacttggtaccataaaaatttgaatgatccactgcattgttgtagtttgaccctgccagaagaggatgtaaggctgagagtcagcaatacagtcatgtgtcacttaatgacaaggctacagactgagagtgtgtcgttaggtgactttgtccacgtatgaacatcatagagtagcctactacacatctaggctatatggtacagcatattgcttatagactacaaacctgtacagcatgttactgtactgaataccataggcagttataatgcaatggtatatatttgtgtatgaaaacatacctaaacgtagacaaagtatggtaaaaatatggtatagaaaattaaataaaaagatatacctgtatagggcacttcatgagtagagcttacagcactggaatttgctctgagtgaatcagcaagtgagtggtgagtgaatgtgaaagcctaggacattactgtaccctactgtagattttataaacactgtacacttgggctacagtaaatttattaaaatttttctttaataattaaccttggtttactgtaatttttttaaatttgtaaacctaatttttaaaaactttttgatgattttgtaataaaaattagtttaaaacacaaacatatcatatagccatacaaaaatgttcttatatccttattttataagcatttttattttcaatttttttaactttttaaacttttttgtaaaaaactaagacacagacagacatattagcttaggcctgcaggatcatcaatatcactgtcttccaccgccacatcttgtcccattgaaaggtcttcatgtgtaataacaggcatagagttgtcatctcctatgataacaatgacttctggatacctcctgaaggacctgcctgaggctgttttacagtaaacttttttttaacaagtaagaatatagtctaaaagaaccgtaaaagtataggagagtaaaaccattaacagtcctttattatcattgtcatatattatgtattgtgcataattgtatgtggtttgctttaatacagctggcagtgcagtagatttgtttacaccagcatcaccacacacatgagtaatgtgttgtgctgggacgttatgaaagctaagatgcatctagacaataggaattttcattatcaaatgggaccaccatcatatatttgatctatccaaaacattgctacatgacacatggccgtatttttaaccattgcacttggttttcttattttctataagtcttaagtcttactcttagtcctaccacatgttacaatttttttattattcacttgtgcaatcttcataaatctgtatttgtggtatttttgcacagtctaattttgcatctgattgtaggaacactaattatagggcctacctccttgccatttttcaatctttaaaattcttttattcagtggaagactcaaattgaggacttctgcaaagtgctgaatattagttcactttttcttttcccttggaacctaattgacgattgatttgccttctctgattatcctaatactaagttatacagtcttaatatagcttattaaagttcataataatgtaactatcaatgtgctaatcccaagtggcattatcaccattgcctccatctaaagtagggaacagtgaatttcatgtttattaagcattatgtaggcgctctgctaagcacgttctgtggattgacctttaatagttctaagaccccaagaggtagatatgccattacctccattttacagatgagaacactgaggcacagcaaggccaagtaaccttccccaggtcacagagctgacaagtggtagaaatcggattgatccttgcattctggctccagagtccacactgtcagctgccgtttttcaaaggattttaaataaatgaagacgtgacagctgagagatttgagagcagttttggtgtggtaaaatcagatgtgttatatattcttcagcatctttctcttaatctgcattagttcatcacataggcctcaggaatgtcaaaggttgagttatgatgtatagtagaaaagtaagttgtccagtagtttgcattctgccttctttcttgcatatttataaatttgtaagtgctgtgcacgtggattcttggcaagcatgtggaagcttaagcttaagatttgatttttctgatattataggccaatcactttggatattagatttttaagattgattttggaatttctcatccattagcaggttttcacctttctccttaaactcatagttttccttgaaatcatacagcatatttgtagcaatctgacagcataaatatacacaacacaaatggaacgacttatgaaggaattacttgtgaaagctcattggagtaaaatttcctctcaaacaatactttaggtcatatgactgagtctattaactatttttctgttataccctgccagaaaagaattttaaaagttagtttatgttttgtgtaaccatgttcttcagaatgcaggtatgtgagcatcatggtttctgggtaattctgctgctcctgtctttgaaaatggagataccacttgcagcttatcccactgctgagtattccagcattggtagtggtttcactccattgcatccatccagaactttcacacaggcctccccattacccagcattttttaacattgatcaataaggcctataaccagatttaggctagcaacaccagaggtctgggggcaagggtggaaattgactttacattcttagtagctaatattccataagtgctttatatatatattgttgttattgatcatctattcaaaaaatatatattgagcagctgctgtggtataggctctgtgctggccagtgaagatacatgattgacaatgttgtgcttgcttggttcacagtcctgtgggtacatggtggagtaaaataagtacaattaatttctcagagctgtgcacagcaacacacagaaggagagataactcacccagcttcagaggggtgggacagagaatgaggttagcctcccagatgtccttgtgctagttttagctgttttcaggtgttgataaaagctccaggagctggcaggaggagagcagaggaagctagagcttacaaagcacaaaggccatgacagcatgccagacgggtgaaagaggacaggggaaatgtaggcaagtgtctcttctcagaggatgttatatactatgtttaaaagtgttgatctgctgggcacagtggttcacgcatgtagtgtcagcactttggggtgccaaggtgggaggattgcttgagctcaggagtttgagaccagcctgggcaacatagtgagaccccatctcttaaaaaaaaaaaaaaaaaaaaaaaaaaagccgggcttggtgtcacgtgcctgtagtcctagctactcagaaggctgaggtggaagaattccttgagtccaggaggtcaaagctgcagtaggctatgatcgcaccactgcactctagcctgtgtgacagattgagaccctgtctcaaaaaataaaagtttggatctttgcctaaaaatgacaagaagtcactgaaaaaatccaagcagaggagtcatatgatctaatctcaatttgagaagttagtccagcaaggaggtagagactagtaagaagcagctaccgtaggctaagccaaaaatggtgggagcttggctgcagtagaatgaatggaaaggtgcctgatttcatggaaactggagctggaaataatttgatgggggagggagaggagtccacgttcctacatttctggcttgagtccttgtgaatgaatggcagaatgttaatggagatagagaaggcaggaagaaatggagagtagcagaagagatgacggtcctggttttggagatgtgggatttgcaccataaccacttctgaatggggtcttcagacatttattggaattgttcaaaattgtagtagaacttttagtttatttgcctttttataaatactcattgttatactttgaacaactttccattttcccagggtacttctgaaatgtatcttcctctcaaatcaaagtccagaaaattgttgaatgccaagagaatctaaaactcatttaaataaactttttctattggggtataatttatacatgtggaaatgctcaaatgttgaatttttccatgcatatatactcgtacccgttactcagatcaagataaaacgacgtaaagcttttaacaccccagaaatgtctccctcttcctacctctgagtcataccccaaccagaggtaaccactcttgtgaactggatcatcgtagattagttttgtctgctcttgaatttaagatccataaacacacacatttgtttttgcaacttgtttctgttctacatcttgtctgtggtttcatccaccttgttaagtgtagtcatttgctcttattcataactatttcctacagtttttaatcactgttaatggacacaatgagtttttttccctcaattgttgactatgaagaaagctgctatgaatatttttgtaatgtctttttggggaaatagaagcattcatttatgttgggtatgtaaaggtatatatagaatgtctagttgttcccaaacaattccacttacataaaaagttttggttgcacatgtgtagatagatagatagaaattcttaggaaagtaggaaggaagaaaggaaatattgggatccagctttaaaaattatatcaagattttgcagggcctttctgtgcaccacctccttttctagtttaattgtaacacaaatccaattctgtgatagtaaaacaaatcagatactaaagttaagaatgaaaaaaaaaattgtaaaaagttggataggaatgaattttacttcttttaaaatacttatatacttttattgtcaaccatttatgttattttaattttcaaagcaatatattttaatttttaattttttaaaatttattttaatttaaaatttattttaatttttaaagcaatatattttaaatgcagcttatagtgtccagttgatccttgaaactgcttcttgtatttatttttcaaataccatactagatttctgtttctttttaatagagtgaaaatattgaagaaagaaatttaatgctgtgtttcttaaaagattgagattattcagttcagttttaattctcaagtgctcgaaagaacctgagattttcatcagcagctttgcaagccatccccaggggcttctttcggtagttgattattctgttaccaagttgtccttaaaaacaaacaccaaaaaaaaaaaattactttgttggtgggttttttaaaaagtagaatgaaaatgaagcagtttcacagtctgtgtctggttggtcctttaatttagatttccccttatttttgcagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctctatattgtcattatttttgaagtataaggtatttttaatttgttacataataaaatcagttcattttatccttactagtattttagaagattatagcatttttgataactaaaatcacaaaggaataccttcagccagttaacgtatttctaacagataatgcttattttgcatttactatcatgctacattgccaggaagcaagattaaaattaaatagcccctgcagccatcctttgtagattttgtcctgcacctagaagttttgattattccctggacagcctgctccaccttttttccccaaatttttaatttttgtgagtatataatagatgtataaatttgactatatgagatatttcgatacagatatagaaaatgtacaataaattattgttggctatagtaactctgttttgctatcaaatactagatcttattcattgtatataactatatttttgtacccattaaccatcttcacctcctgctcccctctcccctcactacccttcccaacctctggtaaccatccttctaccctctacctctgtgagttcaattgttttaatttttagcacccacaaattagtgagaacatgtgatgtttatctttctgtgcctggcttatttcacctaacataatgacctccagttccatccatgttgtttcaaatggcaggatcttattcttttttatggctgagtagtactccattatatatgtaccacattttcttcattcgtctgttgacagacccttaagttgattccaaagcttagctattgtaaatagtgcaataaacatgagagtgcgtaaatttcttcaatatactaatttcttttcttttggatatatacctagcagtgggattgctaagagaaaacaatggggaaattgtccaggactttggtctaggcaatgatttcttgagtaataccccaaaagcacaggcaaccaaagcaaaaatggaaaaatgggatcacattaagttacaaagcttctgtacagcaaaggaaacaacaaagtaaagtgataacccacagaatacatcaaaatatttgcaaactacccatctgtcaagggattaataatgagaatatataaggagctcagacaacttcatagggaaaaatctaataacctgatttttaaaatgggcaagagatctgaattctcaaaagaagacataaaaatggcaaaacaggtatacgaaaaggtgctcaacatccttgatcatcagaaatgcaaatcaaaactaccttgagatatctcacctgagttaaaatgacttttatcaaaagacagcagtaatgaatgctggtgagcatgtggagaaagaggaaccctcatgcactgttagtgggagtgtaaattagtacaaccactaggaggttcctcaaaagactgaaaatagaactactgccccaccttatatatcactttttaatgggaggatattaatttcatcgtgagtggatggaagggcagaaatggatatggaaagttctcttttccatttccagtcttcattctctggacagaaaaggagaactaaataaggaagaagcccctggggttctagaacaggttgtttttagccccagcatgtccagaagaaacaaaaataaacactaatggtaagcagacccacttttattgaatgcacccactctgcggagtactgtgtgcacatgtcagggagctgagttttctcagcagataagtattacttctgcctgcaagtgagcaaagccaaggtcagagaggtggggtgcctgctggcccgaggtgacacaccagtatccagagcaactctccggcagctggtgcaaggtggaagccattggagggaggccaaagagcaggcaggaagatggttaggcaactaactagtaataggtgatggtgatacagcatgagctaaggaagtgctagtagagaaggagactggaaagctgtgacgtgaggactggtcagtctgggtgcttagggagagagcagtctcatgtcctggtgcagggaaagaacagatgccagtgtggtaatgcactcagagggatgaacaggcctgggtggaaattcactttgaatgtaccttgagtccagcaagaactgctcagctggcagattagcgcagtggctggaacacgagtacagtatatctgttttttgtttgtttatttttgagacggagtctcagagtctcgccctgtcaccagactggagtgcagtggtgcaatctcggctcactataagctctgcctcccggattcaagcgattctcctgcctcagcctaccgagtagctgggactacaggcacgtgccaccacgcccagctaatttttgtatttttagtagagacagggtttcaccatgttggccaggatggtctcgatctcttgaccttgtgatctgcccgcctcggcctcccaaactgctgggattacaggcatgagccactgtgcctggctgagtacagtatatctgaatccaccaaagcgatttgctttagtggttgcatgacaatatttaaagatcaatatcccattctttttagtaaggtgtttattgttctgacaaaatatttaaaggagaaaaaacgttaagacaggtaaagagtagtgtaacatcttttttttctgaatacgaatatttaaagactaaatatgagttacatgtgagcttgtacttttgtaattttcagggatgggctgagcatatagctccctttagttaatgaattccccattactgggatatagagtgtgattaaagtagtattttatggaatatagtctctgaaattggttttgtttgttttgtaatcctacacaagattctttagcctctctatgcctcagttgccttatttgtaaaattataactacctcctatgaatgatgagaagtttaaatgggatagtctgtgttaagtgcttagaacaatgcctgtatataatacgtgctcaagtcattttcctctttggcacagtgaggttcatatgaggtctcccagagaagcataggtacagagaataaagcaaagtatcacttcattattatctttgcagagtgctagtggggtaagctgaatctcacagaaagctcctttacctaagctaaatttaagcaataaaacttgtagagcctaaaacgtattctctgtgtattttcttttcttttcttttcttttctttttttttttttgctcaagttgcagtaatttatgtataacaatataaaactaatgcaaagtattactattatctctgtgtattttctccatatccgaaatgagtctcagaactcagcttcttgatgtgaggtgaaggacagaagaggacaagaatgagaataagagagcttttggcctggggcctggaatgatctggtccaggctttaggtcagactgccaacccccttttagatacagcatgggaagttgaagaaagatggtggcccttgtttctgggcatatgtccaaccacactcaccctccacgttcctgggaggacgtgagtctaaaggacatgaggagacccggccagggccctcccacatcgggatcagcaccttccacttctatatggaatgtgaccagttcaaaccactcctccttccttatttccctcccaagagtgggaagatctgtggagagccctaaactccccttcatgaccagcacccacctgttctatctagtccagttagaaacttgcattttacgcttgatttttctaatcacattagccttatgcaatgactgggggatgtggagggttgcagtgttcctgcaggtactgctgatcccactaggaagagctccttcaggactggaattttttatgcttttcttcattgctgtatctccgatgactacaaatgtgccagacattagtaggtgctcagttaatatttgctgaatgaatggtattgaatagtctagttcagctacctaactttataataaggaggctatagttaaagagatcggaaattctagaacattctaccaagacctacatgtccttaaaaaaaaaaaaaagtcctgcattattcttgcagcactgcgcaggaggtatgtgctgtaaaccctataaaatcaatcaactctttgcaaaagtcaagactggcacttctctttgaagaaaggtacacagtggttcagtggaaaaaaagtatgctttggaattatgtaaactgctggccttgatagctttggggactctaatttctcagccatctattttctcctatgcacaaagagggaggtaagaccttctccacagggtgtgagaagacaagagaattcataaatgatgtgcttagcacttagcctggcacgctagatttcaaagttagttttcctttcttcctcttatgtagagtctcaaaggagcaagaacacttgacttataaaaatcccttccctgcattaaaaccagcctcagatttacttttcatctccccaaattgaaatgttttatatgaatgaatgtgggaaactccagaccaacaaattgagtgatctgtgtcaatgttcacttgaccgcatccctgatctcaccgacatcctcttgcagcttctgtgggagaggacagagtctggttttttatcaatctcccagactctgccttgttccctctccaacctatgtgcatacgaccgtattcctagaaatacacaaagaacagataagttcctactagggctgtaatcaagtgattgccgtgaaaattaactagatcctaatttaccttacacagtagtcctgatgtggagttacaggtgcagaaatgaggttaaaaacacatggtcagctcatatgctgttgttttccatgtgaggggtggatgttctctggctagtctaggctgttggtgggtgtcactgtcctaggtaattctatttgtgggagagacactgactgtgatttacttagtgcatctgacacaggtggggtcttgggttcatctctggcttctcatctgggcttcagcacaagctcccccaatggatcatctgtgtatatgtgaagtccttagagtagcagactaatattccaagcagtgtgacatgctgcattcctttaaagcacatgatgtcaattgttcaagtagttttctggttttaagagacaataacaatattgaacaagctttaatgatggcttctccccatccacatgtctttgtaccttagagacacttggagttgatgtacatcacccactccaactctcttatcttatagacaaggagtacttagcctggtgcctagtcagtgcttggtgacttttagtataagtaattgaaatatgcccaaatcttgatcttttctaatgaacttcatgtgtaatgaattcaggatttaggaaaattgaattgtatgctcagatatatttttctttgattatacttattgaattcatttaaatattgtcctatattttgagatactgaatggtgacttgcatagtacttactatgttttgtctttaattttcagaaacaaatagaaaaacagatgatccagaacaaaaagcaaaaggtgagattgtcaaataaacagcctttaaaatatacatggggaaaagaataacatgattttatgttccatccaagaataacatgattttatgtcactaattaaaagaatttgctcctgggtttgttatttcaatgatttatcaaagaacacttattaatattttacataaacattaagagccaaagcacagaaagaggttgcccagcttctaattctagttttgacatttgcactcttgcgtccttgggaaaaatacttaacttttgtgcctcagttttctcttctgtaacgtaggaataataagagtaccaacttctgaaggctgtgtttccatgatagtaataaaatgaaaatatacgtaaagtgcttaaagcaatagctaacatagaaagcacttaggatatattaaatatcatttattgttgatatgtcaacaactgtactaggtataggaatccaaagattcctagaacatgatatctttttcaaggaactctgaattgttggaaagatatacaaacaaagttacagctatgcagaaagaattatttctgcctgccaaaagtttattacaaagtttattacaaagagttaaaaaattatatggatgatcatagaatagtggctatttttagtatcagttgaatgatatgatctttaataattgaatattattacaatttcaggaatgcttttaatttaatttgtagtgatgaaagcagtatctacatatgtatcttgtacataacgtgcataagatcttacttagtgtgcaaatgatacttggtgagcatgtggaattgctggcctctggctgtaatttcacagcccacaagttgagaagtaggcctttaattcatgaaaacttttctaactagttgtttttaatttttgtcaaagtagtacaaggatatagtttaaaaagttgaggtttataatgaatagcagcagtcctcttccctactacttcatatccccaagtctcactcctaactttcttttagctgtttctttctttctttctttcttttttttttttttttttgagatggcgtctcactatgtcacccaggctggagtgcagtggcatgatctcggctcactgcaacctcctcctccctggttcaagcaattctcctgcctcagcctcccgagtagctgggattacagacacatgccaccacgccaactaatttttgtattttttaagtagagacagggtttcaccatgttggccaggctggtctcaaactcctggccttgttgtaatcctcccacctcggcctcccaaagtgctgaggttacaggcatgaaccaccgtgcctggccttagctgtttctttctagtacttagttatgcatttctaaataatttgtataatgctgcagttttctccttaatatcagaaaccgttggctgactctgttttatagatcggtgagattagctcgatcatcatactctcacaagctctccgctgccttacttcctggatcttccgatatatttaggacataactataaataagatagcgatacctgctaatgagaaaacacaaggcaagaaggggcaaatcagcagcttttgatagagttgatcacttcctgtccttcaaacactcccttcacatggcttgctggatacattctcttggtctttctcctgctctctactgtttgcttttctcaggctctttggatggatgtttctcatctccttgaccattaatcaccggagtgccccagacttagtcctcggagcatttccccatatacacgcactctcttaatgatctcatctaatctcatggctttaaatgcctctgtatgccacagattgccaaatttactcacagcctgggtcttttgcctgcactctagactggtgtgtccagctgtctacatgttgtctgcctgataacttcaatgtgttggatgtgtaataatcacttcaaacttaacaagtctaaaaccgactcctgatctttccccctcaaaacacacttcatccccttaaaattagtgtgccaactacatgccaggaattgttctagacaagtggttgcaggtgagagcaagacagaccaggttcctgtttcagggaactcacatcccagtagggagaccagcagtacacacacagactgaaattgtggtaagagttctgaggaaacaaagcaggagagcatgccgtaggcagaaggggtggtgaattagggaagaaggtgtcccaggaggttagggaaacctaagcactctgagcagaggaacagtttgtacaaaagtcctgagacaagagagaagggcccaagaagctggagcacctgaacaagcctagagtgtgtaagatacagttagagaaagtcaaagactagaccacagtgggagtctggacttttcttcatgctgtggacaccgtacccagcccatgcacatctgtgtaccaaacagagccctttctcatttacacattgactggtttgcttctgggaggttcactataatgcattcttacaaagagagggacagggagtccgaatggtgggcatggcttgttgcagataaacagaaacacttgcaaacctgccccaaatctgctgctcacagggcagttgcaattgtgagctcctcatatctctgcctctcatgctccagacctcccattctagtcttagcagcccgtaccttcccctgcactgtcgggtatcctcggtgcacaggtctgacctccagggatgctgatcctaaagggggtttgccagggaagtgtagaggctggaacctctggaacctgcaaagaaaatcattgcaacggcttctgttgactggtttgtcactctccccccatttaaaattagcactttagatcagtaccaaccaaaatatgtttgtaactaaagtattttattaagggggaaatgcaggaatagacagaattaaaagaaataatgaatcaatgtcatcacagatttattaaaaatctattggagcaaattgtgagctgtggaaattccatgtattttttattcaaatcgattcatatgatactgttatctggtaaggaaaagggaaagggaaacattatgtaaacattacatatccagaatatgtagtaaaaaaatggaatggccttcactcatcagactttagtttcataataacagaaactgaaatttttttaaggcaaaataggccctcatttgcagacatctgttacttgagtcaaatcagattatttttatgttttagataaaattgcgatatcagtttctccccactggatgtcatcttttcccacatattccatagcccatggtcacaaaatgtgtgaactacaaaataatccaatacaaaaatggcttgttaaatgtcaaattcaaacagtcattcgtgttcatccatttattgagtacatagtgagtacttatgatgtccaggctctgttttaggcactgggcccaaaacagtcaataaaacagttgcagctctcattgtacttgctttttagtgtgtataggggagagagtggggctggatatgtagttttaaaaaattaaaatataagaggcagtgtgaagtgtgaaaaggaatataagacaggaaaggaaaacagaatgagcaggaggtgttgctgtgtaataggcctcttggatggtgacatttaagcagagatttgaagaggcaagggcaggagttgcaccggcgtctgggagaagagttccgagacttggggagcattctcatggtcctcagggcatgtgtgcttagcatgtttgaggcctaacaaggaggcgattgctggtaaagaaggtatgaggggagagtgcaggagtgcatgagaccagagtggtcaagggttcaaatcacataggctttcgaagacaaaagtaagaacttgtgtattacctccagtgagatggccattgggagattctgggcagaagatggatatgattgcattatattttcaaaggctcattctggccataggggtgcaagactggaagcagggaaaccaattaggagactattgcagtggtccaggcaagacatgatgatgaccaggattacgatgtagagtagaagtggtgagtgctggttagattctacatatatttggatataaagttagtagggtttgataatgggtggaataatggagtgagagaggtcaaatatggatctatggccaggcacagtggctaatgcctataatctcagcactttggaaggccaaggggaggatcacttgaggccaagagtttgaggccagcctgggccacatagtgagatgctgtctcaacaaacaacaacaacaacaacaacaacaaaaacccaacacgtagccaggcatggtagcatgcgcctgtagtcccagctactcgggagtctgaggtaggaggatcgatgctgcagtgaactatgatcatgccactgcactccagtctgggcaacagagcaagatcctgactcaagggaaaagaattcactctaacctttaaaagctgtactttgacaaattcactgaacacaaaaatgtgcaatatgttcttgatttagtatattatcaaaggtcagttatcagttgggatttgtgagcctttaaagaaatttgaagagcaaaggaaatgtgttttttcttgtgtgtatctatgtgtgcacgtgggtgggtgggtgttagataaaactgtatttgtattgtggacttttcctaaaattttttatttagacttatacttaatatcttattaaattattcattacaattaagaatatgtttaaacagtatttacatgtctttaaaacacttaaagatttcctgggtactatttgtatttttttttaaagtcataatcagggccctaacaaaacaccagatggcgctagaaaacaaatcacatttacactaacagaaatcacatctgcaaagcaacttaaagaaaggtggagatggctgtattacagccagtaaatcagcttggtgcaactagtacttcatatggatagttcttagttttctgtgatcataaagaaaatagaacagacgtagctaataatcaagtgtcattcagttttcttatttaaaaaatcttcagtgaagttttccttgtgattcttataactgtatataacatatttgaacaaagttctctattgctttgatgataaaaaaataaacttcttagtgcagcacatgacgcatctcaggatatagcccctgcttatggcctccctgtgttcaaaatgctcttcctaatcgctccacttcccttttatcactcccatttcttaaaactgagcttagatgttctgtctttcaggaagccttctctgactgcactcccatctcctaccccagaccagaaagtgtgtttctctttttgttcccaagatgccttgtgcttacagattttttattagcacatattttgaattttccttttaatttctagacaaaaagcttattaagagtaggaaccatgaccaacccttatccccttatattaatcagagtttacagagttctccagagaaacaaaaccaacaggatggtgtatgtgtatagatatagaaatagatagagatttattttaaggaattggcttacgtgattgtagaggctggccagtccaaaatccgcagagcagagttaatgttgcagcttgagtctggaggcagaattacttttccttggaaggagataagactttttcttaaggccttcatctgattggatcaggactactcatattatggagagtaatctgctttactcaaagtctactgatttaaatgttaatctcaccaaaaataccttctcagcaacatccagacatgttcaaccaaatatctgggtaccatggcttagccaagtagacaaatataattaaccatcacactattctagtggtgcttaaccatagatagtgggtgctgaataaatagttgtagtatgaaaaaaatgtgactaacccccttccctttcattcttgccccttcatctgatagtgatattataagatgcatatagcctgaatggtgggcaggaagaattataaacagaaaagtcaaactatgaattaactttaagtgtctacaaatatacttgctacatttcaagttattttcagatgggttcttgtttaagccttacccatcaatcttatgagttaagcatttttcagctaccatttcttcattttttaaatcttctttctcactcccctacttctgtgcctataattaaatgtatattggattgcttgaaaatgtcccacaggtctatgaaactttgtttatttttagtctgggcatgatggctcatgcctgttattccagcaatttgggaggccgaggtgggtggattacctgaggtcacgagttcaagaccagcctggccaacatggtgaaaccccttctctactaaaaatacaaaaattagccaggtggtggtgtgtgcctgtaatcccagctacttgggaggctgaggtgggaggatcacttgagctccaaaggcagaggttgccatgagctgaaatcacaccactgccctcaagcctgggtgacagagcaagactttggctcaaaaaaaaaaaaaaaaactttgttcatttcttaatcattttttcccattggattgcatgctttatattattatatcttcaagtccagtgattctttcttctgccatttcaaatctgtgttgagctcatctagtaaagttttcattttagctactgttctttccaactctagatctcgaactgcttcttttttgtagtttccatttcactattaagattccatgtctgtttactcattaatactatgtttttctttaattctttgtacttatttatgatcaacaatttgaagtatttttctaataaacccaatatttgggcacaatggcaggcagctgcagttggctcctttttttttttttcctgagactgggtcaggtgattcctattttttttgcatatctagtagtttttggttgaaaactggattgtgtatgtaatttgttatatcaactttggaatttgttttggtctttctgaggactgttggtgtgtggtagacagttaacttggctggactcaaattgaaaaatctgactctccaacagtgtaaagcagctaatatctctgctcaggatttttggcttttaattgctgtgtttaaagtctggtcagaaagggtggcggtgtcttgtgccttcagagtttacttgtttgccaaagatttgagtagaattcatactcagattttgagacttgcttctggaatttccccttgcttctgggattcactatctaaatttcagttgcctggccaaccccaagttctgccctcttacacctcaagccagtagaacttttatctcctctattgggaaatgcactcaagcaaaacataacgacttgtactttcatcagaagctgctctttccggaggtagatttttatagtagtcagcctcgaaggcagcctccagtgattcttgcctcctggcattcatgcctctgtgtagttctctgtctattgaataaagctgacctgtgtggccgaaagaatattgcagaaatgacagagtgtgacttccaaggctaactcataaaaaatgttgcagtttttaccataatcccttttaatcgctcactctggaggaaacgagctcctgcattatgagagtatacaagaagctgtgtccatatagcaaaaaacttgggaaatacaataaatgtttatggctgttgcaaggtgctgaagttggggatgatttgtttttgaagtcattatagctaatccatcgccctcaaatttctgctagctttttcaccaggctccctggggctacccatgaaggtggcaactaagtcagccagggatgctttggcttgtgagcttgggaagtatgaagtgtggtcctttcctttaaaaatttattcattcatcttattgagatgagaactgtagtgcctggctgcaaagacaccatgaagttgcaatcattcagtctctgagggtccattccattgatgcacatgggcttgatcaagccatcaccgccttgaacttaattactgcatggttagcctagttagatctgtctttgtctttttgctgcccactggagatgctttagccttgtctttagcagtcctgaaacactaggtattcctcattgacaacagcctgcctagatgttgcagcacaggctggtggttcagttccagctaaccactatgcctagtaatttttccatgttgttgaagagcaatgtagcaatagcataataaaccaactcaaggaaaagctttgaaaaaacagtctcccgtccacccttgcagctgtgaaaagagattatgagataactgctcttaaagatttattgtagtcattacattcaacagctacagtagttttagtggttcctaaaatacaccagcagttattgtctgattacttccacagataagttaattatacaagatttctgactctcatacaagtctgatttagagagaagtttaattatggcaattttagtgattgaaataagctcagcatatatcatcagtcttagcaagtatagtagaggtttttagctgtgttaaaatacacattctctttgtttttatttttcatttcatgatttctaaccatagtgtagtacatgtgataatttaggacacctgttttcaccagagtgcatcttcagtcaaacacaccacaggacaacaatagcaaattcttcattatcattaaaatcccattctaatgctgcccatggagcactccacattttacaaagctaatttgtataatgattgtgacaatgtgagcaggaaagtaaaatacttttcttaaggaaaaaaaaatcaggtattggtatgttttaaaatgactgttaagattgtaatttttttaatgatggaagatgtgacactccttcaaatcaggcaatgcacttcattgtttatgaacacattgtctatttctatactgaggcaaattaaagattaactttaaccacatatgcttaaattaacttaaaattaagctttcaaaaaatgtgccataaaaagacagtgctgtgagtagttgaatatattcatttatttaaacaagacttcaaattggtgagtacattagtttgaaaaatgctttactgaaaattaccttagtctgagccctgcagacctcttccccatagcacttttcattcttctaatataatggtaggtccagtggcatttggagcagtagttcctgcgatatttttatatttttcacttaaaaatcaaatatatattgacaataggaaaatattaataatggtgaaaataaatcaaattctgttttaatttgagtgattttattacatcctgcctgggaagccagtctaccgcctttccttaacactatgaatgtcagtcatgcctttcctctttgctgcaatgttctttcttcttcctcttcatccattgggatccaccccacagtcctttgctgctaccatgcccggtcagcagtgacagagatgtgggtgagcatggaatgaagattaggcatctcacaggcagtgtctggagaccacgcgggaggcagcaggcaaatctgtctcagaaatacggagaaacctagcctcatagggattctggaacagaccacaagtaaagctgccagcagaggatgtttgctaacagaaagcaggatttccacgtggaggggtagcattggatcctcaaagtactggaatagcacagaaagccccgtcgctagccctgccacgtcgttaggagctggtccaggatgaaggtagcagggcatgagctcagtgccaggagagcagccgcactcgtggtgtatcacctgccataatgcttttatctaacttcccctttcctcctcgccctccatctagagcacctgaagctaatgtacggataattaactgctattgaaaccagtgatgcacccaaacaaaactaggttctccttaggcaccactgtatactgtagcatttcccacccctacctgcctgctcgtctaacccagctctgtgtcactgctggccaggcacagtgagagcaaaggactgcaggatggatcccagtggatgaagaggaagaagaaagtgcggtagaatcacatgggggagagttcagacagtgccctgggtcccaccctcaactattctgatttcatcactctaggtgcaataattctcatgtgtagtcatggttgagaagtgttagttaagatacgctgctgacctagtcagtctggtctgtgtatcaggcccatcttaactaaaaatttttattggtatcacctgattcagaaatcattttttgacaatatttgaatccgatttgaaggggttttttaataaaatataaagccaacaaaaggatcgtttgagaaaagctgaacctgtagtatgaaaaaaaattttaagtttattaaacagctattttaaagataaccatatgagccacaaatggtaagcaaacctagctgtactgaggagctgaggaaaccttgcagtgcttccttctcatggcgtggacagaatactgagcttggtagttgaggcagctgttactgcctgaatcttggcggagacccttttcatctcatgacccatgttctatctcatcggcagactctcacctcactcagctccattcctttagcaaaccgtgcaaattttaatcaggactaaaagactacttttaacaaattctcagttgccctctatacatgctcaaacttcagatatgaaagaacaagatttttatcaatgatattttcaaaggtctagctttttctgatgccgtcagttactactgcattgatgccagcaagtgctagaagaaaggtgagcctttcccagtgctgcaaatatgttgcctgggaaagacagcaactgcctctggcctaggactggagagacccacttgaccactgtctcaagtcccccatcctccttcctgctcctgctgtcctcattctccaccctgatttcagcagctgagagtagacactatcctctttgagatttttgctgcttaactatttgaggcaactaattaaatcctcatcatgtatgtggggacatgtcatttactgaacaaatattgctgtataggatgacgatgtttgagggaaaacataaccctaataataaatggcagatgcattccacttcgtttgttcactttctgcaaagggacttagctgtgctttgtactcagaaggtactcagcatttcctgggtcattgccatagaccgattcatgggtctctcatgccagaaagaatgttgtttttttttttcctttaactcttattattaaagtaataagaaaacattactgagggcataacagtacttctttcatggttcccctcctaaattatttactactagatatgttaaccacttaaggtgaatatatagcactttatgttgcgaattctaaactcatttcaaattataaatacatttgttgagttggtcatggtagaataagagaacactgatttttgcctttgagttcatttttaaaagtcagcgtgtatggatgaacggagtaggagaaagaattatatatattccgacacactttcatttacagaggactcatttgcgtctggtgaaagccaggcggcttgcaccatgtcctgggacttcagccatcctttcatgtgttgacccttcttaaagaatggaagggggaactgaataaagaagataacagcttctagctaagaaggatgatgcattagtttgccaaatatataggctccttttgtgtgctatgctctgtggagcgctctgaaagcaaagcaagtaactacaatgtaaagaggtagagactatgaacaaaatgctgtgggaacaccaaggaggaaatgacacactgctggcaggagatggaaagcaactggagtcttcatggagcgatgacatttgagctggtcctcaagtagtgggtgaggattacatccatgcaagagccctgtgaacccagatactgaagtatgtctaatgacaaggatgataagttgatatggaaaaaaaatcacaggtgtttctgctcacagcaagcccagcagtactccaagagcagtacttaacttgggtgtcatgggctatgctctctatacagaagattacattagagtcttgtcttaaaaaccctttttgggaaaattatcataattcatttttttctaatatccaatgacttttacgcttttgctactttgattcatcagtacgttgatgataccttctcctctttgtcccattcctgcttcatgataatttaatgaaattaaagtaatggatttaattagcacctacatctatgattatatgtatatattatttatctgaaacctttggggtgggccagctaccacaattaaaatatcaacttgattcaagttgtgtgaagcacactttaaacttgaaataaaagtgaataaaatctatttatacagtgtgatgcctttaattgataccctttatataaaagccaaggtttgataaagttgtgtttcaggtaataaccttgatttttatgcttcattgaaatttggctcctctcccccaaggatcactgacttccttgtgcatttatatcatcatagtagtgatgttattactaatgtcattcagctagtcatagggtggaagtagcattaattgcaaattatagcttcaacataaaaccaatgaacttgggtgagcatttaatttctgggccttgtcactttgattcatactgcgtctttgccttttaactgctgctgtgagcatacatgtgcattctctgcagtatattttttcatggcacttccagacagtcctaagagtcaagcagtataggacccagcagggtatgtgttgttgcgccattaattgcatacctctgcgccttctgaggaaggaggccagaggcagattgtctttcaccccctgagaagtatgataatagcttgacagtgctcttactggagtatttctctgtgattattaaatacaagtgaagagacttgttagaaagagagaaaaatgaggaatattttaaaattgccttttagattaatagtatcaaacacacttagtgcattggtactagcgtcatggaaatacacaagaggtttccattcttggtcagtctgagtttggggtttgatctggtgtgtttttagattaaagtgtgtggctaaatgtgatgctggaggtcaaggctcttatgagccctgttcttttgtctgcttcagcttttgagtagctattattatcattttatcagtgagcattttccttataggcatatgaattcctcttactagtgtgaaatcacttatttaattctagaaaattcttgcagtacagtagaaagggttcttgactaggagtgttaatcagctttaccaattcttatttgctatttcatcttgaacaagtctcctggcctctctgagctttttctcccatgtataaaacatggagataattctacctgcactcctgcatttttcgtgcaggtcagatggccatttggctttgtcgctggtgtcatgctatacagatatgagcaactattatcattactttccctccagtgattactttgtataaaatgcatgttatccctaagtccaaatgcaatagaagagtaatctgatattgcttgtgtatgttccttttctaagaggctcttaatgactgtgataaactttatccacatgacattccaatgtctttaagtgcaagagaaaggtggttattcttcagggatatttttctaggaagtgtttatatgtgaaaacaaacatctacaagttgaataagttatgagaatattggaaagctatttgaggaatgcttgtagtggcaactcattaaagcgttaagttatgctttccttctaccttgggtgttacagctttattaacactgagtttgaaaacagctaacaaaaaaagctaaatgcttaagggatttattataaaattcaatagtgccattaatttccatgtatgctttaaattgctgggaaaaagtaatgtattcagcaaagaagcaagttcctgcttcctcccctgagtctgcctgattgtgcaattggtctctcattctttaattaaacttgtccaaagataggatccgctaaaatgtttactgtataaatagttttcattcccagtgtgcaagtttaaaaccatggtaaaaagtttgtcatctgttaacaaccaaaacatgtggtgtgctgttgcataaaaataaactgcacattattcataaaagggatcacaacatgtatcacatctttggggctgacaataatctgtgatgttttggaatgtcacctccttctaagtgacagtatgctcagtagtgcattatgttaaaaaacatgatcgtctataattgtaataaaaataattcatgtattgttattcaagtgaaattgatttatctgaatgtcagtgttactgataagaaattataatttttaattttttctttgatattttcaaatctaaattttcctgagttttattttcaagtctttttttcctccctaaaatttaaccatttaatttagccaggaatttaaccatttctctctctttctgtactaccattgcctcggccctgtgacatctcaggcttgtatatcacatccagggagtcttcttgcctctagtttttgcctttctgcatatatgtacctaccacaagagaaagttcttgaaagacaggattcatatgctcactcattgaagccatcagaaataccacattgtctgtggagcaaagtcaaaattcctcagaattttgttcaaggcaccccataatctggctgtaagccacctgtttagccttggccctaactatccatgtccctgtactttatagaattccacaagatttttcacaaatccctgaacatacctttttcacatttatatgtacatactttcccatttctttgaaatatttttcgctgtctacctcattccaaattagatctgtgcctcaagagtcagttctaatgttctgtcattccttaattctttccttgtttttccaattagtggtaatcctttgcttctttctgttcccagagcattttgtaattcttactttgcatgatcattttcagtcttttattctagtcattaatttacttcccccctaccactttctaatgtgtgaagtacttggggatagggattgtcttgtttatctttgtgtccccacactagttagcataatacctgtgaggcactcaataaatacgtgtcaaaatggtttgaaaatggtcacacattgtgttctggagaatccaataagcaaactaatgcaatggaaaaatttagacaaacaggtcagagcagattgtcatattccacataggatttttttttctatgtagcagtagttatggatgtcctaaaatgattttggccctttcctattcagtatttcttaatggacaagagtggacattaatagacattaatatctcacaagattctgcaggaagttctgatttgtttcacacaaaacgaattgctgtctttggaccttgtttaggtcccatttcaaattaacaaactctataaatttttaagacaatcagggaaatgtaaacactgattattcagtgaaagtatccaactatgatattcagaaattattgtgaatttcttttctctttttttttttttttttttttttttttgagacaagtctcactctgtcacccaggctggagtgcagtggtgcgatctcggctcactgcaatctccacctcccaggctcaagcgattctcctgcctcagcctcccaagcagctgggattataggcactgaccaccatacctggctaatttttgcatttttagtagaaatggggtttcaccatgttggccagactggtctcgaactcctgaccccaagtgatctgcccgcctttgcctcccaaagtgctgggattacaggcatgagccaccacgcccagctgtgaatttctttttagatatggtaacagtattgtggttatatttttatatgtttattataacaacttcactgaggtatagttaatatacaatagacttcacctaaagcatacagtttgataagttttgccatgtatgaaactgtaaaaccctcaccaaaatcaagataatgaccatatccagtgatcccaagtttcctggtgctgctctgtgacttctcctggatgttcttcctctgtgcccctccccaaccccaggcagccactgatccacttaaggtccctacgcattagtttacatttcccagattcagtggctggaacctccagtaaaatgccaagaagttatgcatggacatctttgtctttttcttgatcttgggggcaggagagggtagaattcagtctgttaccgtttagtattgttagctttagatttttcatagatgctcattctcagattgagaaagtttcctatgtctacactgcttaaagttttttttcaggaattggttttagatttagtcaaaggctgttctattgtctaatgaaatgatcatatttttttcatttttgtgtataatataaattgcactgattaattctagatgttaaaacaactatacattaatacatttctgagataaaactcatgatgcattattccttatatatcttgttggatttgatttgctaacattttgataagaagttttttacatctgtgttcatgagggataccagttagtagttttcttttcatgtagtatctttttctgattttggtttcataataatgcagaccccacagaaggagttgggaaacaaccccttctctttaagaatttatgtatgatttctttattacatatttgatagaattcactagtgaaggtgactgggcctagtattttgtgtttggaaagtttttaaccataagctttatttatttgactgatacaagatattcaggttatttgtttattcttaagtaaccttgggtagtttgtgtctttcaagaattgtgttcatttcatctaatttgttgagttaattgacataacattgtttataatatttattgtttaataattatagaatctgtaatgatatcacctgactcattcatgatgttggctatttatgtttatttgtgtcttctctctttttcttgatcggtctggtggagtatcaattttagttaacttctctcaaaatcagctttatttttattatcttcctctggtattttcttgctttctaaattatcaatatgtaccttgatctttattatttcctttcttccacttattttaggtttaatttgctgttcctttttgaggttttttttttttctctctctctctttttttgagatggagtctcactctgtcacccaggctggagtgcactggcgcaatcttggctcactgcaacctccgcctcctgggttcaagcaattctctgcttcagcctcctgagtagctgggattacaggcacccgccaccacgcctggctaatttttgtatttttagtagagacgaggtttcacgatgttggccaggctggtcttgagctcctgacctcgtgatccacctgcctcagcctcccacttacaaaggtgtgtattttactattgttgcagggagtctagaaaagtcatttaggtcaagttgcttcataccactgttcaaatcttctatatccttgctgatgttctctctgcttgtcctattaattactgatggagggctaccaaagcctctgatggaattgtggatttttctattctctttaaagttctgtcaggttttgtttcatggattttaaagttctgtaactaggggaatgaacatttagattattatgttctcttaatgaattgatttatttatcgttatgaaataatcccctttatcattgagaatattctttggtctgaaatctgctttgatattcacacaggcaggcacttcagctcttttttattgtcctttttattagaatgatatgccattttctactcatttgcttttaacgtatttgtctttatatttgaagtgtatttattgagttaccacatagctggctcttacttttttatccaagctgaaattgtttggcatttaattgggagtatttatatttaatgtgattattgctatgattagatttagatctattatcttgctgtatgttttctatttttcatatttcttctttgttccaattttcctcttttaccttcttggctaaatttattcttaggttttttttgtagctattataaacaggattactttcttgatttcttttcagcttgtttgctatggtgtatagaaatgctactgatttttgcatattgattttgtatcctgtaactttactgaatttgtttatcaagtctaaaagttttctggtagagtctttagatttttttctatataagatcatgttttctgcaaacaggacaatttgacttcctcttttccaatttgggtgacttttatttctttttcttgcccttttgctctggcttggacctccaatactatgttaaacaagagcagtgaaagtaaacacctttttcttatttcagttcttagaggaaaggctttctgcttttctccactcactgtgatgttagctgtgggtttgtcatacatggcctttattatgttgaggtatattccttctatgcctaatttgttcagaagtgtgttgtattttatcaaatgcgttttctgcaactattgagatgatcatatggtttttgtcctatcgatgtatttttttttattttcatatgttgaaccatccttgcattcatgggataaatcacacttgatcatggtctgttattttttagatgggttgttggattcactttgctaatattttattagggattttcgtatcaggaatatcagtgtgtatttttttgttgttcttgttgtcgttgttgtgtcctgtttggctttagtatcagggcaatgctgtcctggtagaatgagctaggaagaattcccttctcttcaattttttggaatagtttgagaattggtgttagttctttaaaagtttggtgaaattcaacagtaatgctatgtggtcctaggcttttctttgttgggagatttctgattcagtctcattacttgttattgatctgttcagggtttctgtttcttcctagttcaatcttggtggttgtatgtgtttaggaatttatccatttcctctagggttttcaatttgttagtgtatgattgttcataatagtctctgatgatccttcgtagttctgtggcatcagttaaaatgtctcatttttatttctgattttatttatttgggtcttctctccttttttttcttagtcattctagctagtattttatcaattttgtttttcttttctttttttttttttgacttttttaatatactttaagttctagggtacatgtgcacaacgtgcaggtttgttacatatgtatacatgtgccgtgttgctgtgctgcacccattaactcgtcatttacactaggtatatctcctaatgctatccctcctcactcccccgaccccacaacaggccccggtgtgtgatgttccccttcctgtgtccaagtgttctcattgttcaattcccatctatgaatgagaacatgtgttgtttggttttttgtccttgaaaaaccaacttttcatttcattgaacttttgtaatttttttttagtccctattttgtttagtttttctctgatctttattgtttgtttctttctactagttttaggtttggctttttcttgatcttctagttctttgaggcatgtcattaggttgtttatttgaaatctttctacatttttgttgtaggtgtttagtgcttataaacttccttcttagcactactgtatctcatgggttttggtatgttgtgtttctattttgattgcttcaagtagttttttaaaaatttccttcttaattttttcattgactcagtggccattcaggagcatgttgtttaattttcatgtatttgtaaaatttccgaagtttctctccttactgcatttttagttttatttcattgtgttctggaagatacctgatatgatttcaattttttaaaatttgtcaagacatgttctgtggcctaacatatggtctacctggagaatgttccaagtgctgacaagaagaagagtgtgtactccgtagctgttggatatgatgctctgtaaatgtctgttaagtccatttggtctaaaagtgcagtttaaatccagtgtttattttgttggttttctgtctagctgatctgtccaatactcagagtggggtgttgaacttgccaactattattgtattagagtctgtctcttcctttagagataataatatttgctttatatatctggatgcatatatatgtggaattatgtcctcttgaagaattgatccctttatcattatataatgaccttctttgtttcttttttatagtttttcatgtgaagtttgttttatctgataataaaatagctactcctgctcacttttggtttgtatttgcctgcatatctttttctgtctttctatttgcctgcatatctttttctgtctttttgcttttagtttatatgtgtttcaggtgaaatgagtttcttgtaggcagaatatagttgtggtatgtgtttttatcagtttatccagattatatcttttaagtaagaatttaatttgtttatattcaaggttactattgataggtgaggacttattcctgtcattttgttaattgttttcttgttttccttttgttgttgttgtatattttttgctcctttatcgtctgttgtttatcatgcagtttggtagttttctgtactggtaacatttgactcttgttttctcatttgtctgtctgctctactagtgagttttatactttgtttatactttggtgtgttttcatggtggcagatattgtccttttccttccagatataggaccctcttaggcatttcttgtagggctggcttagtggtgataaattctgtcagtttttgcttaagaaagactttattcctccttcatttttgaaggatagctttgctggatctggtatcttagctggcaattttttttctttcagctctttgaaaatgtcattttattctcttctggcctgaaagatttctgctgagaaatatgctgttattctaatgggaattccattttaaataacttgattcttttgctgtttttataattttctctttgtctttcacttttgacagttttactgtaatgtaacttggagaagaccattttgtttcaatttatttggggatctttgagcttctcatatttggatgtctatatttcttgcaagctttgagaagtttgaaagctattatttcattaaataagttttctttgcctctgttcatatccataaattaggacatttggttatttggttgatttatggtgtcacatatattatgtaataatcttttcttttctttcctttcttttcttgagacagggtcttgccatgttgcccacactgatcttgaactcctgagctcaagcgatgcatatgcctcagcctcccaaagtgctgggattacagacatgagccaccatgcctgaccatgccaggccccttcattgtttttttttttttttttttcctgactggattatttcaagtgatctatcttctggttctgaaatttttccttctattcaatctagtctattgttgatggtgatggtcttgattttatttttgatttcactcattgaattctttagttcccggttgagttcttttaaatggtatctatctctctattgaatttttctttcagatcataaattattttcttaatttttttgtgtcatttatctctgttctcatatatctcactgagtttctttagtattattattctgattctttttctgatatttcataatttccttttcatcagaagctgttgctggaaaattattgcgttcccttggaagtgtcatgtcttcttcctttttttgtcttcatttgtccttacctttgatatctgcacatttggtataacagtcacttcttccaattttgtgaattggctttcataggaaagacttttttgctgtagaagtatctataatgctggttgtgtagagcactttgtctttgattctgggctggcgcagtagtgtagtctcagtatgatttccttggctgtgttcagcatcagtggtgtctgtgatttcctcagtggtttagctgtgaattttagtggaggctgtggtgaggctctgctggggactgggatgccaggtgggctggtccttgggcatgcccgtctgtgggcccctaggcagtgtacatgggcactgatggtagtgggtccaggagagcagacctttgggccttcagaaggcttacttggttaccagcagtggctgcagtgggcaggcaggtcctcaggcacctaggcagcatgtgtggtattggccatggcagtagcagtagcaggccaaccctcaggctctcaagtgtcatgtgcaggtacctaggtccccaggtagggtgtacaagtggttgcttgcagtagaggtggcaggctggctgggcccatcctcaggcccctggaaggcatgcacaggtgccagtggtggcagatggggtgggtcaatccctaggcccctggaacatgtgtgtaagcattggtggtggcgggccaggtgaaccaatctccaggttcccagacaacatgcacagggagtagcaggagtggtaccaggtaggacacacttgttctcacactgcctgacagtgcacatgagtgcaggctgcattgaggggtggggcacggggcaatccttacacatccagatggcacactggggcatcagtgacagtgggggtgggtggggtggatctatcttcagatccccagacagcatgcatgggtgcctgcagtgacaggctgagtgggccgattcccaggcttccagatgatatgcttaggtgccaacagctatggcagtaaaccaggtggccctgtttttaggcccctgaatggcaggtgccagtggcagcaggtggggcaggcttattattgggcttcctgatggtgcatccaggccattcttatttttatttccctgtgtgtgacatgtctattctctctgtctgcttttatgatccttattttatcactggtttgaggaatgtgatccctatctctcagagatcactgacctttattacctgatatacagtttctcacaagccattgtttcatagataatatggaaatatttagaaattttaccaagtttactctcaaccttagtatttgaagataatgtcctcctctttattgttatttttcactacctctgtttcagaaaggcaatggctttgtttttcaatatatcaaataatagatttacatccctgttactgatctataatctcatttgtctgtaatgagaaacctcccattgaaacatgtattttctctattgggtaatacatcagaaatagtttgtcacttcatcatcctgctattgctcaagtaaacttaactatttcttactccccagagaccaggatcttcacagttgggtatttgttgaaagtttgtggtcatcctgtcatgcctaccacctctactataaagcaagattaatcaattttgtaatgtcaggttttcattcttatagcatatggagaaactctaaagacactcttggggtttctctcattgtgattttcaagttgtgtttaaagatatccactctgttttggtgaaatctcagatgatatctaaaaaatatgaattccatgtaatttatttcttaaaagttataatagtgaaaaccagtcaatatcagttctgaacaaacatcggtcaaacatagatcctgctgacatctaaacaatcaaatgaaaaataagatagttcagacataggattaaaaatactgaaattattcattcatataatatatacaatagtccttccttgtccatatgggatactttccaagaacccttggtggatacctaaaactatgaatagtaccaaacctatatatactatattttttcctatacatacacactatgacaaaacttaatctataaattagtcacagtaagagattaacaacaatcactgataataaaatagaaacattataacaatatactgtaataaaagttatatgaatgtggtctccctctcaaaataccttattgtattgtattcagctattttgggactattgtagaccatctgtaactgacactgtgaaaagcaaaaccgtggataaaaggggattcctgtactaatctttacatgtagctgagatgttgcagagcaaaatcacctgtagcaatttttttggtattggggtttgggaacatctgttttgtttcaggtccttcaggagacactgatgcaagctgggcttagaaattattatttcatttgacatcactgggaaatcagtatttcatagaaacaattatttaaagatgatgttagataactttaagcatcatttaagcaaaattaataaattcgggtgatattttctaaagcattttaaaatcatttccccatttaaaaaatgtgttgtgcaaataatttaacattccctggtgactggagactataattctgattttaatgaacatcagttactgtatcatgcagtgatgcttttggggactgttaaagtgtttggcaccatttatgtctacacagtttaacccatgttgcagtgctattggagctgggtttatttcaggtttatttctggtttctgactttcttactttcagtctgtcagcttgtatccgctgctgagtatatacctgcttcaaacaaccctcactccatcttgttagtttgttacctataataacttaagggctagagaaacagaacaccaagattattagaattttatctaaaataacatttgaggaaggtggctattctctcatggaacgtgtgcgtggggataaaattcagtgtctggcactgctgttggtgaggctgcggactgctttggcactgaagggttttctgttatgtctagaaaacacatcacttagcatctctaaaatttctaatttaacatatggggtcacatctgttaaaggattattactctagaaggggagtgatgtataatttataaaaataaccctatgggaaggcagccaactacatgtaataaactggaatacttgctgtctccattgaatgctcccagcagaatctcacattagtttagtagagggagcagatgaaaacaattgccctttatatactatttactgggttgtataagttagcatctctcagtgaaaaatatttgttaactgtttggtttaagctttgaatattgacctcctgctggtatatagttgataattaattctgaaaaaacagaagtccattattcttagctgtaggaggcaagaaagagtgtgccatccttggtaagagagtctttcaagagttgcccaaatttacttcttcttctggtaatacctatagagtagatcgtgttagagaaaaaaagcctcagaaggggctatttttggatcaaacacattagcttttctttctcacatggtgataatacaaacaaaggctcctgccagaagcacctccatggctgtctgcatattgggtttctcaacagcaaatagcatgtctctcaatatgagagcagatttatttcagaccccagtgtgaggcatcacagtagggaataccttgcacaattcccacttttaaatgaaagagaaaataactgagggcgcctacccacatcccccgcctgtaggaacactcgtagattcaggtttgcttttcctgtgattagcagataacgtttcatcaaaaatcctaacatgggattcttgaattcttgaatgttttcttcttttttaccctttgccttaatttatagatttacctcactgtcaagacaaatgtagagtgatgtttcttttattgaaatctatcagtgattttaaaaagaaaagcagaattagcttccaatcctaataaaggaagattaaaataagcaggggtcctatcttgggttaactgttaattgctatgaataatattgcagtaaggttgctttatgtgatgactttgaaacttcacaccacatctcagtcagatacagagcacctttttctttaatatcttattttggtcttacttttccttcccttaaattgttttgctttttagattatttttcatcaaattccacctttgaataaccatagccaaaagcagtatttaatattttatgtgattctgcttaaaaacacatactagagtttgggaagcaggggaagtttagcatggcctcaaagctctttaatcctttgttgacttgaaatccaaactgaatgcaggtatagtgtgataaagttattagttgcccaaaatctctgccagggaaatgtctgatcatagagaaaatctgatctttttaaaaaattaactgcttaaacatttattaataagagtcaggcacatttcccacttaattaagcatagaattttaaagtaactaaaaataagatactgtagatgaaagtcataattaacatttatatgaggttttatgctccatgactttcctttactgtagtaggaaggaggtcagatattatccccatttcgtggatgaaaaaacaaaggctcaacaaaattaagcaagctgcctcagaagtagcggaactgaagctcacagactggccttcaggcttgtactctgtggtccttctaccaagccaggatgtgtctgtgtaatgtctaaatgctacgtcttgagacacaaaatgaaggaaaattactatggttatttaactgcctttatccttacagacaagtaatacaaagttcagctacttcctttacacaaataatacttatactaatacttaattccactgtgtcatcacccttaaaactcttaggaacaccctaatttcttgacttctgagccagatgccaaagatatagcaaaatggttaagagtacagacattggagtctactggagagaacccgaagcttcagtctcggtgcctactgtttacagtttgtgcagcttgggtgagtcacacatgtctagaaggcttaagtgctccataaatgtcagctgttattatcagcacagaattggctaaggcattaagcagtgactcagaacataatagcaagctgctttgggaagtttttgttattctaaaattagcgagaccttgcaatccaagaatttactgttagttgtgccttgtattctgccatgtgtgtccccatttgctcaatatactgaaaaacctacatggaataagatgtagaataaatgttagtgttccctacaagatcttcagtggggattatggtacaagtatcttgcttttttttttttttaatcttcctcttcgggcccctccattattgaccattgaaactttttggatttgaactctataaagcaagcaactctcaggtaattttctatattggttgtttataattttctcattttttaaaagacagctgatatgcccaattacaaattcacattgccatatccccttctacagtgtcttgcttcattcatgcctgcatgcattcatgcctttagaaacatgaaaaattgttgaggatttcctataggacaggccatatgccaaatgctgttttgtaaattataagtaacacagttcagaaattaacaatccagcaagggaggaaggtgggagtgaggggggagagtttgagcgagcactgtgtatataccgccagcatgaacacagcctgaagagtttactatttctagaaatagtaatgagtatagtagtaatagtaatagaatgttatatgaccataggagagattattttctgcctaaagatgccttaaacttgatagaagaaatgacatttaaacgaggtctcaaaagttaaaatatagaatattctttggtagaaataaaggaaagggttttccaggaagataaaacaccatgagaaaaaccacagaagtgtcaatgttcatgccatattcgagagtctatataaaggaaattaatagaagaggaaaatggagattaggggccaatttgtgaaaggcaaaagctggttcaaggaaatgcaactgtgcaagagctcaagatgcacattattttccttgaataagtatagcatttcagatgggctagtgggagaaattcatacacacacacacacacacacacacacacacacacacagagttaaattaaggtccgtatttaatcagccatacaaaattgtatcagaagcaaaatggcagcccagggcaggggcagatgctatgtccctttgcatggcttccctggccatctagagtccttcactggtgcagatgggagccacagttttccactctctgtcttgcatgttttcaaaaacccagttcttgctatgccactgcccttttgtagtcagtgtgtataccctctctcgaaaaaccttatactcccagagcaagcactctggactctactggcttttgaagcaggctcagcatcaataaagttccttcttcagacacggggagaaagcaagtcagtgtctgggatccctgagcaatatctacaccttcagcttcccaaaattctagaaagctgaaattcttattgtaagaaaatttatgtgttatggcaccaaaccctagtatccaagcaggagaggaattttagcctttcacattaaaaacaaaacaaaaaaaccaaaaaacaaacaaaaaaacctaacaataaaggttcaaattcctgattgtgattgagttacaaaataaatactctctcctctggccagaatgctacctctccctgggtatacagaagtttttagtttccccaagaaggctcccctcccaaatagattagtaccactcctcattcatcctataattgcacatattcctctaactattagttattcatgtatgtcttccccaaaagactataacctccttaagaaagatcccgttgaattctgagaacctcacacaatttttggaaaacgggcactttaacaaattcttgagtgaataaacaagccggtgaacaagatgggccctaatccacagtcctaggtctccctccactgtgggcagagtgacatgctgaggaacggccagtgttttgatgtagttcaagagtagggtgcttggaaggctggtggctggtaaggaagagggcagtctggagtagaagaggtagctgggatgttaaatacaaaaatattccaatgtcattgagggcctagctaggtctagattcgcatgttgggttttttcctttttgtgtgcaggtaagtgtgtcttaaacatgggtgagtgaattacctcccaaaagatttttggagagtttcaaactaaatttaatttcatttttgaaaaggatgctgtttttattcccaagtgtttctcatactattacacctacacagtaagagtcttcactgagaatcatggagcttatctctgccttgtaactttttttgttaaaagtcaggttcattaagaaggaatttacatacagtaaaatttaccttttatagtgtgtattctatgatgcatatacatctagatacagcttttatccaccacaactaacttacagaactttgcaaccccctaaattattttgtgcccttgtagtcatccccttttcccaccacagcctctgaagccacttacctgttttctgtagctgcagttttcagttttccagaatgctatctaaatggaattagtcagtagccttttggactaggccactttcacttaacataatgcatttaaaattcatccatattgttgcaggtactggtgttattgctgagtagtatttcattttttggatataccacagattgttttcattcaccagttgatggacatcgggttttctctacgttggggctgttgtgaacaaccctgtggtgaatatttgcatgcaagtctttgtgtacgtcttcatgatttatgttttcatttttcttgggtccgtaattaggagcaggattgctaggagggcatcccagtgaatttaatttctattttttatgttctggggatctatgggtgtattttcagcaatgtaatgacatgaataaatagtgtttcaaaaataacctgagaacaaggtagaacatgggaacagactcgagtcagggagactagttaggaaattgttgcttttcaaaatataccttgtaggagaaattgctgttttcttcactgtcttcagtggaatgggtataggacatagagtaatgtgaagattctgtgtctgtttttattgatgatcaacttctccccatggactgtagtataaaaacatcttccatgaactaagtggaaatgaaaaggagtcaacgtaatttttataatctacaaatgcatcactagtgttttcctcctgccttcagctatccttttattttccttcttttccattttgtttgctcttaatatttcaaccacagcctggcaagggaagtaaggatttgaaatgtaagtgttcctttttcttttcttctttgtgcttttgaaaaagggccaaacacttgtaatggcagtgatttaaaaacaaaacaaaactttaatttatatatagcatagatagctttctcctaaaccattttgaaagatccaaattcaacaaaattaataattctttctagtaccttataggtgtactttaaaagattatgaacataatttaaatactgaaaattagaagcacaggacttttgagttcaaagagaccttaagagaagcagcccacatcacccatttcttacccatgggtaagaaagctgaggcccagagtgctggagagagttcgccagggtcccatcaccagcctgaatgaggactcattttttctacaggtagaacatgtgcctccccagaatgagaagaaagagtgagtctgtggtttttagcagttgggaaaattgcctcaggctttctgtgtacttaaaaataaaaataggataaaatttgaatttcaaagacaggtacaatagttagaagctatcaaatatgaagatatatgaaaagatagaacatggtggcatgctgtgagatttttaatattttgtctattttagtgctgttattgaaatatcgtgacactaagatacagcattgctcattaacaagcatataattttgctgttacactgttttggatgtcctaaactgctagtttttagtttcttttaaataaatattattttaacttgaattttataacacaagagacatgttggggaaaaccagtgatgcccacagtgaaactgtctactcagctgcacaccaggcttttctggaggtctcactgtcattctgttgatagacacttctacaaaagcaaaatgaacaattgggagacataagtctgtgctgagatgacaaggcatgagctcctactaccatcaatctgtgtcacagagaaatgtctattcattttccatatcagcatatatggtaacatataatggcatgcagtttaaagctcattattcactgttttttcagtctctgccttagacacatatagctttcaacattacagggattagggtttctgggaggagagagaaggaaagtcaaataaatataatagaagatcatagcaaacaaatgtgtaagtaattaaaagatgatcagagtgtcagctttattacttgatgaaagttgaattaaaagagggggtttggataatcaggaataacagatttcttaacactgagccccagaattggacatacccactgctccagacagcatggaacagccttagttcttccatgtgagagcctctcttgcagttccgctcagcacgaatgttctcagaaggtcagctcagctcagctcagtgtgcatgctcttgagaggtagggaaggagtgaaactgaacttcaagttccttctaccaactcagcaagtggattaagtcatatcacctcccctgtagggagaggtaggagactaagtattttggagaatcttccctcttcttgggaaacacgaaataagtatccacttctttccatgtgggtgagagagtggaggggtcaaggtaactaacccttttggaacctcagtggtcttctccgtgtagttaaattccctgtgttcaggaagttgagaaaataaaaggtatctatgtatagtgtgtggccgggcgactggcgcagagtgagtgctaaaaagacagtagtgattccattccatcttccttaggatgattccatgtgctcttctttgcccttattttggttgtgttttataaccaagtttctgatttggacaattgggtgtcattctctgcaataaagtcaatatgaaaaagaatagatgtgtgaggaatagcaaattctattttttatttactgagtttgaggtatgtgtcaataggtgcttggatttataattttcgtgatgcaggagaaaatgaactagttggtttgtagctcagctggaaattaagtagttaaagccgctaaagagactgaagactgaccctgaagaatataacatcccaaggagcagcagggagaaggagttacagaggcaataaagagaaattcaagaggctagagaataaggaagaacactgggagagtgggcaacataaaagtcaaggaaagggatcatctaggaaggaggagggcatcaactgtgtcaaatgttgcaaaagggccaggtaaaataggaagaaacagaacaaatagatttgcagaaagccgtagccattattataatagctctcaggtactgagcacttactgtatgccaagcactgtgttaaatgcttcatatactatcctgatttaaccctcaaaaacacccctaattttatagaggaggtaagtgagacccagaaaagtttagtgccagcttggcttaggtcacagagcttggaggtgacagagctgggactcagacccctgccatcgatgcttaaccacacagccttccctcctctggcagacttgcttctgcccacgtggtgggtgaggaagccaaagtgctgacaggaaaggtgacaaagaggtgccccccaggggaggggagggagcgtggcaagtagaggagggtaggctggtttgtttgtttgctgtaagatggcagaaactttggcattatttaacgcattattaaattcccaccagggggcacacgagagatgctgagagtgaatagacattcagaaggcacaagacaggtgtgtgtgttggcggagaggggaccttagaaagaacagcccgtcttcctttgtgacaagatagggaagaagctattaacgtctgtaggtttattgtcagaaaattgaggaagttctcttctgattgttttaattcgtctctatccctcccgctttgcccccttccctgccaccactccccttctccagaacattctgcttacccttcaagcttccactcttgtcacttggggcttctgagaagtgctctgcatccatccactctgcaggcactgccagttgtgcaccagcaggactggccctctcacctgctgggtgtgccttgccttcgggaggagggctcctgtttgctgggtgctgaggttgtgcacagagccaaaaactgtttgctaagtaagcaatggattgatgcttacataaacagattcagcctgcttttaagacacggtaccaccctgcaagagttaggactaagataagcgcgtgaaggattataacaaaacccctagtggggaaggaccacaaaacagagatacgcagggtgcagtggacttaaagacgcacacagtggagcagggaactgagtactgtgtgggtgatttcaggagaaactttataaggagcgtggttttgaacttattgttgaaggataggcacgtttttcacagaagaagataaagaacaggctttttatttaaatgaggtagcataagaaatggcacaggttgggcacagtggctcatgcctataaccccagcaccttgggaggccaaggcaggaggatcgcttgaggccaggagttcaagaccagcctgggtgacatagtgagactctgtttctacagaaaaaaaaaaagaaaaaaagaagaaagaaagaaaaagaaagaaagaaagaaagaaggaaagaaagaaagaagaaaaagaaagaaagagaagaaatggcacaaaaagcttatttggggatcatggggcagtctattttggctgaagtatggaacatagctggggtggtcagtccaggatgcactggaaggaccttgaatgctaaacgaagaaattctgttttatttgacttccttgagaggagccttccattttcatctttatctgtatcagaaaaagttgtggacatattcaaaaaaactattttaaacaatcttttggacatagccaagaagtagattatgagagtttaggagtcatacccaccatttacatcccagaaaccaagccagtatcctggagagtttcagtatactatccacccactctcccaagaacacattgtagcagataggtaagggctgcattgccttccttggcagtcactgacttcatcacaccatctaggggaggaaatggaaggcgagcctgcagtgtgccttctcctgcaggtctttggtggagaccagcatcaggtttcccactacttgtaaattgttatgcttaataactatttctagtcaaaaaacgttaaaaataaaaatctcttttttctttcagttaagaaaaagaagcctaaacttttaaataaatttgataagactattaaagctgaacttgatgctgcagaaaaactccgtaaaagggtaggttgatattttttgtgcaatggttttgttgttaaataaactcaggcattactcttgatttgttaaaaaaaaaaaaaatagtaagtgtaaaagaaacaacagttgaatagagtggatttttccccaggcacatgaacattccacatgaaatgaatcagatggaagagaattgctaccacatggccaaagagaaatagaactttccttcaggccagccgatgcgggtgtcagcctacctccatcacattctagttatgcagctttggggaaaccacttggctcttctgggcgttagttttcttacagacatgataatgataaatattctttctacctcctaattgagttttttaaagatcaatttaaagatcaaatgagaatttttttttttttttttttggacagagcctccacccaggctgaagtgcagtggcacagtctcggctaactggaacctctgcttcctgagtttaagcagttctcctcctgagtagctgggattacagatgctcaccaccatgcctggctaatttttgtatttttagtagagacagggtttcaccatgttgcccaggctggtcttgaactcctgacctcaagtgatccacccgtctcagcctccgaaagtgctgggattacaggcgtgagccataagtgagattaaaataataataataataataataataacactgtcaagtatcatagaagtgcaagtttttaattttatagctccttgatgcaaaaagaaaaactaggtcagtccattactcaggatagtaattggtagatgaaatgacattcttcttacttagggttaacctcatgcacctccagttttcagggtaccttatttatattttaatttgtcgatatatttgaaatattacttgcatttctttatagatattacaattttgagaacaataaattgaaactggatttaagttattcgttcccttaccttggtcatatcatctaatcatcgggtgcaaaaatatttattataatgtatttaatcatatcttcaattaatcatctccttgtttttggcggaaatttgtttctctactctgcacttgaatgtagactctgtaatgttcattagttttcctgtaataggctttttaatcagtagacattggctgcaataataaaggaacaagtgggctttaagtaaacaaacaacaataaaaacactggttaggaactaaaatgggacaagaatgtacgtccgcatgtttattgaaagtgtaccaatgagcataaaggcttttggaactggcattaggtgaggctccaaagccaaggtttgccaataaaaatagagtaactccacagaatattgcagcaaagtcattgttcacttcccttaaatctaaccacgtggaatgattcctactttctgatagtaaacaagaaagttaactgtcttgtttaactttatgaagtgaagccatctactgtttgtggtcagtttgtatttcttaatagaattgaagcaataatctttttctgccacctcctttggcaacctccactttctctatactaaatgtcatatataaaaatgggagtgcctattgcacaggtgacttttggtgtaaaaaacatatgagcagctttagagaaggattttaatgtaattatatgaatgataaaggagggctcagttatggggtattctgcagtgttgctcctttggagaagttatatttttctcaaggagcatcttgaatttataccagggaaataaaagaggaagaagtagccccatatacaattcttgcttctgaaacaacaggaagctatgttattgactgactcatcaacataattcagtcttttagggttgtttttatggctagtattttcagaggatgcaccttagtgcactggaccagccgaggccaactaacacacactccacacagagccagtgcagcctcagttcatgccttaggctcaaggactatgttacatgaaagtatgtgttcgctttttatccccccagaaaagtatagatcagattatattccaatcctctattttaaaaaataataatatttattatttaaaatgctttcctacctctggaaaaagggtttgaaatgatatactgaaatatatttgcttatttgttggaatcacttattattacagcattgtaagtgatttttgaaaaggtggggagggagtaaagaaaatgtaatcaaatacctgaaagttcacaccactggctctaaaccatgctaggaatgaagtcaacaattcctcgagggacaacatggaaaacagaatcagaagataagattaatattgttcatcagaagagctgttctgctccaagtccagagagaaacatttggctgtagatcttcataaaaggtatactgatggatgcaaaacttcctacttccccactgacatcataccagtggattattctaccatgcagctgcaggaatgtatcttattatccttccgcacagcccattggcctcatgtcaacacagtgtggcctacgtccatgtctctcccatgaactgtcttggtcctaggagaacattataagctatgttgaggaacagatcattttcaggcaattcttcaaacattttgtgtcttgcagctgagtttttaaattagaattgagcaatagtgtttggagctatacaaaaacttagggaagggaaattctttcagactaaaagcaaacacatttactttgccagccaactgaagtgaaagcaaggctgatggcccctcaggaaagtcacagagcctctgtcttgcagggattcaaaggatgctgcagacagagccaaaatatcccattattttaacagccttgacagtgtcaagcaggaatatctcaccttatcaaatttgttatgaacattgttattcttatgttttaagtctgatattagtacatttagcacaattatcattgaaatagctttgacagttgcaatttaagttgcatggggtgcatactaggctgaaaatagacccccaaaagatatgtgtctggaacctgtaaatgttatgttatttgggaaaaggatctttgcagatgtgattaaggacattgagatagagagattatcctggattatccagttgggccttaaatgcaatcatgtttcctcataagagagggacagagggaaatttgatgccgacaaaataaaaagtagcacatacagaggagaaagaaagcagtatgaagacagaattggatattggagtgatccatccacaaatcaagaaatactgggaatagacaaggacaaatattcccgtaaaacctctggatagagcacagccctgccaccatcttgatttcatcccagagaaactaattctggaaatctgttctgcaaaactgcgagagaacaaagttctcttattttaagccatcaagtttgtggtagtttgttacagaggccatcgaagagtaacacagatttcaatactgggcctgcaggtacacagaagtcaggaattgaggtttgggaacctctgcctagatttcagaggacgtgtattgaattgcctggatgtccaagcaaaagtttgctgtacgggtggagccctcatggagaacctctgctagggcagcgtagaagggaaatgtggggttggatcccccacatagagtccccactggggcactgcctagtggagttgtgagaagacggccaccatcctgcaggccccagaatggtagatccaccaacagcttgtactgtgtgcctggaaaagccgcagatacctaagaccagcccatgaaagcagctgggagggggactgtaccctgcaaagccacaggggtggagctgcccaagaccatgagagcccaccacttgtatcagcatgacctggatgtgagacatggagtcaaaggagatgatttcagagctttaaaatttaatgactgccacactggattttagacttgcatggaacttgaagcccctttgttttggcgaatttctcccatttttttttttttttttttttttgacattggcagagctagctgaggttttattttggaccaaaaaaaagcaattgaattgttttgtagctggaggcatgggcaaggggggtccccaggtagtaaactccccaggtgggctgagggctagggctgagcctcaggtgggtctcctgttcccagtgctaccctgaatagtggcctccttctcaggctctggggcagcgcaggaggggtaggctgggaggggctgccacagctgttcacttgggcaggatgtcagaggactcggacaccagcttcccatcacatgtctcgatcttcttcacaaccacggccctggaggaactggtgcggctgagggagctggagcctgcgccagagccaaagctggagcccaggccgtagctgaggccggggcttgtgaggcccccataggccgagctcagaccacctgcatagccgctggtggtcttcgtatgaatactcatgttctgcatcccagacttcagccggctctctttgccctccagcagcttcctgtaggtggcgatctcgatgtccagggccagcttgacgttcatcagctcctggtactcacgcagctgccgtgccatgtcctgcttggcccgctgcagggcagcctccagctcggacaacttggcgttggcatccttaatggccagctctccacgctgctcggcatctgcaatggcggcctccagggaagccctctggcctttgaggccctcaatctcagcctggagctggctgatgttccagttcatctcagagatctcagtctttgtgcgccacaggtcatccccgtgcttcccagccagactctgcagctcctcatacttgatctggtacatgctctcagcctcagcccgtctttggttggcaatatcctcgtactgtgccttgacctcagcaatgatgctgtccatgtccagggagcggctgttgtccatggacagcaccacagatgtgtccgagatctgggactgcagctcccggatctccttttcgtacagctgcctgaggaagttgatctcgtcagtcagcccttccaggcgagactccagctctaccttgttcatgtaagcttcatccacatccttcttgatgaggacaaattcattctccatctctgtatgcttattgatctcatcctcatacttgttcttgaagtcctccaccagcctctgcatgttgccaagctccgcctccagcttcagcttctcctggcccagagtctccagctgccgcctaaggttgttgatgtagctctcgaacatgttgtccatgttgctccgagccatcttctgctgctgcaggaggctccacttggtctccagcatcttgttctgctgctccaggaaccgtaccttgtctgtgaaggaggcaaacttgttgttgagggtcttgatctgctccttctcctgggtgcacacagcctggatgttggggtccacctccaggacaagggggctcagtaggctctggttgaccatgactgcggtgatgcctcccatgccgctggccccactatagccgcctcccaggccaccccgaaagctgctgctgcccactcaggagaagctcgaggagctgatgtgggcaccgggcccactcgtgtaggagcggctgctgaaggcccgggggccagaggtggacaccttgtaggacttctggatcaccctgatggacatggtggaggcaggagtggaggcaggcgggccgaaccaggcggagatcctagaaggagcggagaagctgcttcttggtccaatttctcccattttgaatgggagcatttatccaatacctgtacccccattgtatcttagaagtaactgatttgcttttgattttacaggcttctaagtggatgggacttgccttgtctcagatgagactttggactttgactttgggtttatgctggaatgagttaaacttttgtgggactgttgtaaaggcatgattgtgttttgaaatgtgaggacatgagaattgggagggatcaggggtggaatgatatggtttcactgtgtccccacccaagtcccatctcaaattgtaatccccataatccccatgtgcctagagagacacctggtggaaggtgattggatcaagggggcagtttcccccatgccgttctcatgatagtaagttctcatgagatctgatggttttataaggggatcttcccccttcgctcctcactcttctctctcttgccaccatgtcaggagggtccttgattcctctttgccttctgccacaatcgcaagtttccttaggcctccccagccacgtggaactgtgattcagttaaacctctttcctttataaattatccagtctcaggtattttttatagcagtgtgaaaacagactaatacaatattcgagaacatggtagaacctgtacttatattgagggaaaattcaatttctttagcaaaaccacatattacatcatttatcaggtgtcttgtcttttttttttttttttttttttttgcgagattgggcatccttgccattttcttttttttttgtcattttattatttatttatgtttttattattatactttaagttctatggtacatgtgcaccatgtgcaggtttgttacatatgtatacagtatacatgtgccatgttgatgtggtgcacccgttcacccgtcatgtacattaggtatatctcctaatgctagccctcctccatccccccaccccacgacaggccctggtgtgtgatgttccccaccctgtgtccaagtgttctcattgttcaattcccatctatgagtgagaacatgcgatgtttggttttctgtccttctgtctttttaaaaatgaagtaaatatgtgttcattactagttttctgtttgccttaatatagctttttttaaaatcttagataaaactatctttacactcaggatggaatctaggaaactctgacaaaaccacttgctgaatattaaataacaatattgattgattattcattttaatttattttatttatgtaattttgtctttctaacagggaaaaattgaggaagcagtgaatgcatttaaagaactagtacgcaaataccctcagagtccacgagcaagatatgggaaggcgcaggtattctgagacccttctccttaggacacttttttgatgttcatgtgttttgtgtgattgaattttttactcctcactattttccctttctaatttctctacagaatcagtttctcatgtatatgcataagcaagaaatacaattatcactattgcatgctgctgaatttagtaacatttttttctgctccccctccatatgacttctctctggctttgaaaagaaaataaacagtaacacttttgtcattgatttaccatcccctcatgtcccattccatctaatcccaccatacagtgttcacttgaggctcctcagagctttcagactctcagttttataactggaggttgcaagtatgcttaggaaagacctttctaaaatataaagtggaacatactttgatgtctctatagttttttccaacggactcatttcttagcagctacctttatcctcatctcccaccgtctcctttcttatctggctttttctagtttccaactcctttcatgaagcatgtcccctttcacctgtaactgcataaacccactgtatgtcagtgttttaggccctgggaatgtctgttttgcattcttttatgagatggttagtcaggtgcagctacaagaggtctcacaggacaggattaggaaaaagcaagtttattatgctcacagagacaggaggcccagcatgccaaacagggctacatgggaaagactcaaggtgatcaggggatggtaggcaagaacgaggggaaggtttggccatagcctttattgaggtttccatggaagaggcaaagtagggcagggtgaacagtttaggactggctggtttgaataatttcagcctacagcggtggtaccttttgcctacagaggtggtaccttttgcctataggggtggtacctggccctgagatgattaaagtcgaggaggcgtggctctggattggttaatttgcatatcaaaagctttctcctggctgagcactggccagctcagaattgtctagctcagggcagtctctccctagccagagaggtttttttaagatgtcaaaacatcataatatacagaaaatttaaaaataattacaatacaatacagtgaacattcttgtggattccagtggaagatttttttaattattaacaaatatttggtgaaagcccactgtgtgctaggccctgttctaagcattagagatacagccatcagtagaacatattttaaaagccctagcacttacagagtttccattgtaaaggggaagacaatgcataagacaagtaagtccaatgtatatgctttctagggctaagtgctaagcagaggaaaaagaaaacagagaacagccaacagacatgtgagggggtcgacgtggtatgaaaggtggcagggaaaggtctcatcaaggaggtgacatttgagcaaagccctgaaagtctttataaataaatatgtacttaaagaacattataaagtattaagaataaatatgttagatcatcttacctaataagacatgctgtaaagaaaataagaaaatgtaatggaatgaagagcatacctattaagatttttttggctgcaggtaacatgactgaaagaatggggcagacagcgctttggacaagttgggcaggaaaggtctctctggggagacaacatgtggctgagatgtgaggaggttatattactagcaggagctatccaggcaagagaaagcagcaagtcaaaggctttgaggcaggaaaacaatcttgggataagcctgaggaaagaaagaagggcatgctggggcagggaagcaaggatcaaggaggctgtgaccttgcagattttattctacacgtgctgagaagccatgggagggtttgtttgtttttttgggttttgtttatttgtttgtttgtttttatactttaagttctgggatacatgtgcagaacatggaggtttgttacataggtatacacgtgccatggtggtttgctgcacccatcaacccatcacctatgttaggtatttctcctaatgctatccctcccctagccccccacccgacaggccgcggtgtgtgatgttgccctccctgtgtccatgtgttctcattgttcaactcccacttatgagtgagaacatgtggtatttggttttctgttcctgtgttagtttgctgagaatgatggtttccagcttcatccacgtccctgtaaaagacgtgaactcatccgtttttatggctgcatagtattccatggtgtatatgtgccacattttctttatccagtctatcattgatgggcatttgggttggttccaagtctttgctattgtgaatggtgccacaataaacagatgtgtgcatgtgtctttatagtagaatgatttataatcctttgggtatatacccagtaatgggattgctgggtcaaatggtatttcttgttctagatccttgaggaattaccacactgtcttccacaatggtcgaactaatttatgctcccaccaacaatgtaaaagcattcctatttttccacatcttctctataatctgttgtttcctgactttttaatgatcgccattctaactggcgtgagatggtatctcattctggttttgatttgcatttctctaatgaccagtgatgatgagctttatttcacgtttgttggccacataaatgtcttcttttgagaagtgtctgttcatatcctttgtccactttttgatggggttgtttgtttttttcttgtaaatttgtttaagttcattgtagattctggatattagctctttgtcagacaggtagattgcaaaaattttctcccattctgtaggttgcctgttcactttgatgatagtttcttttgctgtgcagaagctctttagtttaattcgatcctatttgtcaattttggcttttgttaccattgcttttggtgtcttagtcatgaagtctttgcccatgcctgtatcctgaatggtattgcctagattttcttctcgggtttttatggttttaggccttacattgaagtctttaatttttgtataaggtataaggaaagggtccagtttcagttttctgcatatggctagccagttttcccaataccatttattaaatagggaatcctttccccattgcttgtttttgtcaggtttgttaaagatcagatggttgtagatgtgtgatgttatttctgaggcctctgttctgttccattggtctatatatctgttttggtaccagtacaatgctgttttggttactatagccttgtagtgtagtttgaagtcaggtagtgtgatgcctccaagctttgttctttttgcttaggattgtcttggctatatggctcttttttggttccatatgaaatttaaagtaggttttttctaatgctgtgaagaaagtcaattgtagcttgatggggatagcatttaatctataaattactttgggcactatggccattttcacgatattgattcttcctatccatgagcatggaatgtttttccatttgtttgtgtcctctctgatttccttgagcagtggtttgtagttctccttgaagaggtccttcacatcctttgtaagttgtattcctaggtgttgaattctctttgaagcaatcgtgaacgggagttcactcatgatttggctctctgcttgtctattattggtatataggaatgcttgtgatttttgcacattgattttgtatcctgagactttgctgaagttgcttatcagcttaaggagttttaggggtgagacgatggggttttctaaatatacaatcatgtcatctgcaaacagagacaatttgacttcctctctttctatttgaatacgctttatttctttctcttgcctgattaccctggccagaacttccaatactacgtcgaataggagtggtgagagagggcctccttgtgccaacagtctggttgttttttgtaaagtttgctttggttactgagtggaaaatggattatggaggcaaaagtagatgcaaaaagaatagaaggctattgcaagtgtacacaagagatgctggtggcttggactgcgttcacggccatggagatgagggaagtgggcagttggtggagctgaaaggacttgaggatggattagatgtaaaaacatcagaggaagaggactcaaggctgacccctgagtttttggttcggccagctgagtggaggataatgccagttactgaccaggaagagcaagtctggagtgatgcagaagtcaagagttcaagagtttgctgttggtcttattaagtgtgtgatgcctatgagacattcaggtggacatgtcaagtagaccattggattcacagagcctggaacttggaggaaaagccagggcaggatatcaaaatatgccaggaagtaaagctccaacagctctgcctagaggtcaagattgtcaaccctgctgggaaatggtagattcagagtgcagaaattttccagacagaggagatgctgacagcacccctatggagaaggtccatgcagacatttgtacaggacacacacaggaactaactcagctgtagataaaacaagtgaattttgttctgaactgaagatggtgaccacttgagatccagatgctcagtatcttcttatatctccattaaaaagtaattaatatattttttattaattcgattttaattagatttgtgaaaaattgattcaaataaattcctcttgtccatggtacagaccagctttagcagacagcaactgtatgatttttataaattagtttggtcagtaattctctgaaattgctaaatcattttgctattaagtaagagagagtgtgtttgttaccaaaaagatcatgcctattcaaataagtagtgttttttatcactagtattaagtcatttcattaagagaagcatattaactagagagagaaatggtttatgcaaatgctaatttaattatggcaaaaatgttttataccttagaagttttccttatatgtaatattaattgtgagtaccaaagtctaagtaaatgaaatgctcttgaaacagtgtgattgttatatttacagtcagccctctgaatcctcatgttccatatccatggattcaaccaaccacagattgaaaatattcagaaaaaaaataaaaaataacacttcaacaattaaaataatacgaataaaaatgatacaatataacaactatttacatagaagttacattgtattgggtataataagtaatctagtgatgatttaaattatacaggaggatatggataggcaatatgcaaatactataccattttatatcaggaacctgagcatctgcagactgaggtattgcagtgcggcagtgatggtggtggtcttggaactaatctccagtatataactaaggatgactgtatatccttatgtcacagtagaaaattgagatttaggcttcaagcaatatcttttatctctatgctattatgcttcaatgtgttattgctattaatattaatgtggcatacagcaaaatttagccatggtaaattaaattttaatagagtaatttaaaggaaacttcaagttcatagtagttttaaaaataaaaattcaacagaagatgggttttataggaagaaattatgactttcattctttgttagcagattaaacaattactttggaatattccaacaaatttttaaaattttgcaacattaagtcatatataaactatagtatctctcatttctaaagtagcactgatattgtctttttcttcatatcaccaaaattaattttgatcaagttccctgaacattggacacaaaatattaaaatataaactcaattcactttattatctttcacaaaccattaatgcctttgaggcagaaaatgacacatctcataggaagattggttgggtgaattagttagagtcaacaaaaggctttgcgatgttaacatcctgtaacaaatattcagtttcagtttagcttgttttatctacagatgctacactgataaaaatcaatctgcagacttttcagtgcaagtgcctatcagttttattcaagagcttataaagaattatgtgccattttagtagtgatatttttccaattctgcaagttgtaaatgttaatacttcattaaaacaaagggccctggggcaccagagaggggacaaggcatacagattatactatctctctcccttttcagattgagtttaaagatgtttattccaatctcaataaagaaggattatcttggtaggcatttgtcctcccactaatgctacagagacctccagttccaggatctttttgggcactctgtaggttcaaaatgaagagagtgaaccacagatggtttacaatttacaatgtcttttcttaacaatttttcaactttataatggtgtgaaagtgatacatattcagtagaaactgtacttcagtatcatatccaataaattacatgagatattcaacattttattataaaataggctatatgctaggtaattttgcacaaatgtaggctgattaagttttctgagcacatttaatataggctctgctaagctatgatgttcagtaggttatctgtattaaatacattttgacttacgacgttttcagcttaccatgaggtgtaaacccgtcgaaagtcagtgaacatctgtagatggttttgaaaggactctcaggtctagaactctgtgttttgcaaagttatctatcaacattcatattctggggagttaactcactataacaaaactcacaaggagctgatacctatacagaagagccagtatatgaatatatgatagaaggccatgccagcatcatgatcagtgtgggtcattgacactggactttctctcctggtagataagactattctggagaacatttacagacttccaaagatagtgaatggtctggagcatatctccatttagcaagggtgaatttccttttctaatctagagatttttatcctaccaagttttctttctcataaatctgtccacttccatcactttaattctagttctcatcatcttgggtaatttatcctaatcagttcatattatcaagttatttcattgatgtcttattttgtgaaaaaaaatcccatagttgtcttattttgtcaatttgtgctgattcttaggtttgtttgtttgtttgttctttactttgggatatgggagggatgggtcattttcttactgtgccctcaaattatggagcgatactttattttgattctgcatacatctatatattaactacagcacacattttaacaacataaacatgtttaaatattctgagaaaaaaaaatatatgctacttttagcatctagccagaatcatttttcctcgaataataggcttcagattgtagcctcctaaatctgatgagatattgatgacattttacacattctcctctctcttcctgactccagtattttactctccattctcagtttccagctaagaatgttgattcttttttcgttaagaaaatagaaatatccagacaatttccacctgatgctgctactttgctaacagccatcctctacctgtgcctgtatgttctgccttccctcctgttagcacagatggactattctggtccctgttcctctctcacctgctgaaggacatccctctaatttttgtgtctccttctgtatcatcagattttccctctctactgagtctcttgcatctccttggaagcatgctgtactatgtcccatccttaaagaactccccttgtctgcacattaccctctgccagctggctcatttttctgctcccctttacagtgaaactcttcaaaagagttatctccacctccttccatctcatgttctcttgaacctgcagtactgtggtgctccctcctttttgctgctcctcccttgttatcctgatctctaatgacctttaaacattggagttctttaggattcagttcttggaccgcttcttttctctgtctacactctcgactgcttctagcttcctagctttacataccatcttcatccttgatgattcccacacttaacttctcttactctgacctccctcctgaacttcagactcatatatgccccttcctggtcagtaactccatttggatatcttatagacattttaggtttaatatgtccaaaacaaatctcctgattctatactgcccccaaacttgcttttgccctttcttcccattctcaaggaatgacggttcatccagtaatcactgaagcccaaaccttgttcattcatggtttttctctctccccctttctcacaccctacatttagacaatcagcaaatctgttggctctgaccttcaaaatgtatctataatctgaccacttgttaccacttccattactgctaccttagtccaagccataaccatcccacacctggattcctgctggagtgttctgcctctcccagcttctcagtctgttctccatacggctgccaccatgatcccttcaatacatacatcagatcatttcaaaagcccccattgtcttcccgtctcactttgtgtactagaattgtcaatatcttgccaggccctactttacctcatggcctccattggtcttccctttcctcccctccactgcactggcctgtcctcgattcctcactcctacctccaagcctttgctcttgctcttttccctgcctagaatgctactccccaaggtatcttcataatttgctccctctcttctttcaggccctccccaattatcctgattaaattagcaactccttaccattcctacccagcactcctaagcctgctttgtttttatccacagcacttatggctgttagacacatagtacctttatttgtttattatatttgccacctttccaaaatggatgcaaagtagaagcaaaaagggctttgtcagttttgttcaatatgcctgccacatttgtagaagagtgcctctttcccagaaaacagttgttaaatgaacgaatgcatacacgaataaattaatgaaagaacgggaacttgggctggagacctgcctatataatgttagtgtgtaataggacgtacatctccatcagccccagcgtgtattagtcctgcatttatgacattctttcttgtctttagtaacaaactttaccttgtattattaaaatagtgtgttgattttctatcttttgttagttttttttatctcttgataaggagaaaaggctaacgtgtcttacatttcttttaaagcatgtccaaaagttaactttttatgaatattttgggtaattacaaacacagctagtcatgggacatttatccagtctggggacttcttctagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtaagatgcaatcaaaggtaattcagtaggaaatggcatatgttttatcttgaagaagctgaagagtgtattcttctcttagaagaattacgtgggagaaaacctgagttttacaactgatttcaagtaatgtgtctgtcctaggctcaccatctctaaaactgaaattgtaatcctaatcttaatagaggcatgcctcacagatactgtgggtttggttccagaccatcagaataaagagagttacacaaattttttgatttcccagggtatctaaaagttgtatttatactatgtcatagtgtcttaagtgtgaaataacattatggtttaaaagacaatgtccaagccttaatttaaaaatatgttattgctaaaaaatgctaacgataatctgagccttcagtgagttgtaatccttttgctgatggagggtcttgcctcaatgttaatagccagtgactgatcagggtggtggttgctgaaggttggggtgactgaggcaatttcttaaaataaggcaacaatgaagtttgctgcattgattgactcttcctttcaggaaagatttatctgtagtttgaagtgctgtttgacagtattttgcctacagaacttttttcaaaattggagtcaatcctctcaaaccctgccactgccttatcaacaaagtttatggaatattctaaatcctttgttgccatttcaacgatgttcactgcatcttcaccaggagtacattcagtctcaagaaaccactttctttgctcatctgtaagaagcaactactcatctattaaagtttgatcatgagattgcagcaaatcagtcacatctttaggatccacttctaattctagttatcttgctatttccacatctgtagttacttcctccactgaagtcttgaacccctcaaagtcattaatgagggttggaagcaacttcctccccaaactcctgttagtttttatattgtgacatttaaataaaatgtatttattaaataatagaacttaaaagtctaaattactccttgatccatgaactgcagaatggatgttgtgttagcaggcatgagaacaccattcacctccttatacatctccatcagagttcttggtgactaggtgcttatcagtgagcagtaatattttgaagggaatcttttttaaggactcaacagtgggcttaaaatattcaacaaaccatgctagatgtcctatcatccagactttgttttcccatttatagagcacaagtagagtagatttagcataatttttaagggccccaggtttttcaaaatcgtaagtgagcactggcttcaacttaaagtctccagctgcattagctcctaacaacacagtaggtgtatcctcaaaactttgaaagcaggcattgacttctcctctctcactatgaaagtcctgatggcatcttcttccaatagacagtgattttgtctacatagaaaatttgctgtttagtgtagatcacttcatcagtgatcttagctgtttagtgtagatcacttcatcaatgatcttagctagatcttctggaaacttgctacagcttctacattagcacttgctacttcatcttacacttttatcttatggagatgttttcttcccttaaatttcatgaacaaatctctgctagctctcttctccctctttcttcccattttatgatagcttgtataatttgcctaaggaatcatagctaatagattaataggtctggaataaaaaactcttcctgtgataccaaattcttttcttccttaactatagcaaaatgattcatggaggttgaaattatctgtggaaattttgtataaatgaataatagctgtttctggtactctaaaaaaaatttactggtaagatttgaccctatatcaaggaaaatgctagaaaaaaaaacatgaagtaaatttgcaaatactttgaaaagaacatcatatcatatatcatcagatttaggaggctacaatctaaagactatcatttgaggaaaaatgataccagctagatgctaaaagtagcatacataatatagaacatcatataccatcctctggactgacccaggttcccagtaccaaaggcaagtaagactagctgttagctaacttcacgataaccaggcttacaattctcttcccataacagatcatcagtcaacatggagggaaggagctaagctatgagtcactgccaaggcaggtgctcggctggcaagatagttacatggacagattattaatgtcacttaggggaggctcctatagattagagtcaaggcccaatggaccctcctatcagttttccgaggattagaatgaagaggagttgtatcacttttgtagataaataaaataggactaaagtccatgtgatgattaaaaatgataagaaatggtcagttagactaatattcatagggaccagtgcagcagaacaaaaacatgcagcacaaattcagcacagaaaaggcagggccgggactccagagaggcaatgcgggcactcgccatggacgcagaatcagcattactgcccggacgcagtggctcacgcctgtaatcccagcactttgggaagccaagatgggcagatcacctgaggtcaggagttccagacctgcctggccaacatggtgaaacctggtctctactgaaaatacaaaaattagccgggcatagtggcgggcacctgtaatcccagctactcaagaggctgaggcaggagaatcacttgaacccggaaggcagagattgcagtgagccgagatcatgccactgcactccagcctgggcgacagagcaagactccatctcaaaaaaaaaaaaaaaaaaagaatcagcattactgagttttcctcttgcctcagtctccactatggctctgcttagcactgtttagtgattctgtcactaaagtgttaacattttcttcatcatgaatgttttacattaatattgattttttaaaaggatgcattaaactagccttcacatcaaaattatgaacttttttggcatcctctgaaatctaactctgagtgcctctctggcctcaccctgtcctcggccctgggaaggtgactgcctcttccacagcaatccatcagcatttgaatgtagtcctctcagaatgtccttgagaataaagcaagttcactcgaggaggctctgaggcaaatggagacagaagattttagtgaaaatgacatggtggtgaagttggtcacaacacaacagggttcccagatgcagagtggaagggatggggagcagatggctgcaaggaggagtttgtgtccatgcttttgttgtggataataggagatttctagaagaaagtgtgagcctaggtgggcagatagggggaaggaaaggtatagaaaaggaagcccagatttgttagtgaggaaatgactagggttctggttggaatatgattggctggtaatggggcataggccgtcggatgagttggtgatgctttatggcagatggtttggcagtggaatatacagctgctttagcgtactgacactcccatcactctcctagattgtgggcaactaagccctttagataattcatggcttttttcgttgatgctagtcctctttttgcacatgttcttttatacagataattgaagctgggttttttcatgattcatgcgtgcaaagtatgcctttgtccacgagagggccccataatactggatgatgtatcatttgctccatgactaggtcattacctagagatgagtacacttgtcattcataggggatgtgtcagcagttaggtactgtcctatgtactttggtgccttttcgaattgcatacagggtgctagaccctgaagttagttaagactttttattgcttatcccctattcataaagttaataaaccaaaaagatttcagcagaacttttttttttaacgaggaattgttaactaagtttttcttgagaaggaatttaacataaaatggtaaacattgctgaatgtaaaaaatgagaatgtctttagatgtttataatcaataccatattcagtatctacttatggcagttattaataccattgcaactacattatgaaatcctactaggtacttagtaaaccactaataaagccagatttgagctggttctcaggctctggtgaatagtctctcatgacttacattctcaatacaaaagtgtacataatctgtttttatttctattttttttaaattcccacctactcaggtcatatgagaggttccctgcttaccctgcagagattagttcaactatttcccaatgatacttccttaaaaaatgaccttggcgtgggatacctcttgataggagataatgacaatgcaaagaaagtttatgaagaggtaagcatcaatcttgtattaactacgtcaaattaagttctaaggctatttgcaaattacatttattatacccagtctctctttattttaaattaagttaaaaagcatgtaagtattattatagttaacatattctaaactatgttttaacattgcttttcttcctagatcagaagatttttaaatcttagttaacacttagtacattaaagccttcaacttataattgtgattcttttaaaacttcatatttatctttccatacatagtctttctaaaattgttcttcatgacaggaagaagaatttaagttcctgtgaatgttacacacacacacacacacacacacacacagacacactttcctttttttttttttttttttggcagaagtatggtctagagagaggctatatagaacaggggcctttcaagcatgtgacataaattacttttcagcagggcactgactcttcaaatcctctggcaaggatacctttcaaaggatttctactttataacagatgttgatagataacctctaagtcacaagtaactagaaaatctagagaaatgtgacttctttaggcagtggaggaattcatttggtacagaatgaacaggatgcccaatgaattttgaagatggagaaagttagcgcctctgtaaaagaaagatgaacatgtttacttgttattctttaatttaggccctttgatcaatggttttcaagctggtgaagtctacatcaatatgctaccactcagtgatagtatgatttctgctacagttttgttttgcttttgtttttgtttttgacacgtggtctcactctgttgcccagactggagtgtaatgacatgatatagctcacctcaacatccatgtcccggactcaagcaatcctcctgcttcagcctcttaagtagctgggactacaggcacatgccaccatgcccagctaaattttaaaaaattctttagtgatggtgaggtcttcctatgatatccaggctggattcaaattcctggccacaagtgaccctcctgcctcaggcctcccaaatagctgggattacaggcacaagtcatctcaccctactccttttacagtattttttaaatgccatcaagaacagcagtttcatactctggtagggactgggtctatcctcaaagcggtactttcctctgtgtattgctattattgtgtaatgaaaatcattgaattgtgaagcagttgtctttttacctttctcataatttttatattttctgagagaacagaaataagacctttgcttttataacatcactaatagctacacagggtggattgaacctttaatgttgacaatgtgtgccatttactaaagacctattccaggtcataaattaattccatgtggaacattgcatttgttaatggccaacacataacactcaatgccctgtcttacagagtatggttaagagaagcatcatatacctcagtgaatcagggtctgtgaatgtaagaattgtgaagctataacaaacatatccattagtttgtcactgtcagaggccacaaaaatggaacttgtagaattcctaacttccttcctccctccctccctccctccctccctccctccctccctctctccctccctccctccctccctctctcccttccttcgttccttccttcttcccttccttcccttactcctcattcccttccttccttgtagaattcttccctattttctttcttctgtccctctacccctccctctctcgcttcctaccttcctgcaccctttcctccttctttctttccatctaaaaaacattctgaagtgttgactgggtgcaagcacgtttgaggttagggcaggatctgacagcatactggtttctctaatacactgtggatttgtccttcctcacctttttaaaacctcccttcaggatattcatccctttacctgacgctaaatctcagatatgtgaaacattttacttcatcccgaaaaataaaatttacctgttgtttatacattttatatcataatctcatctgaatatgcataataggatgcagaaagtctaaaatataaggatattattcaattgaatgagttttttttttaaagcatgaatagactgaaaatatgtgtgggggtcgccttttttccggtcctctcacttttaagttaataagctattatctaatggagtctctttcattaaccaaggtttttcttgatatgtttatgttaaagatcatttttagaaaacagacattgtaattttatatttttcttcatgttaatttttacttttgagtacatttataaaaatcattgatatttttatttttccagctttttgctgcttttagttgcaacaaagaaactggctttaaaatggtgtgacatcatttgctccagtctgtggctttttgcggcccctcctgggattctcttgcaagttggcaacattagcagctgcccaggtgttacagtggggagtttcatgccactcctgactcacccgccactgctcacgtatacccattcactcagccaacacacatctattaaaacccatacacactagctagagaaacagtagttcatgaaacacacgcagaatgtgcccacatgaagtttataatctggtaccaaatcacgaatttgtgttcattttaacttctgattaactttcaaatcccttccctttgtaaccaaagcacccgtcatctcttgcctgagcagggacaggtttatcctgtcctagcttgctcccccccccaaccctcaccaacactaaaacacaaccctgatcatctccctcggctttaaatcttctgtggttctcatttcctgcagcagtggtcttcaaacatgcttgatggcggcccttccagactaaaatgttcaagcaaatgcctgagatatgtttatgtacttatatgttatgtgtacatgtatgtacccacataatattatgtatatatatatgcactaatatacatgtgcattacaaaaggtacataccccaaaacaatttttaagatgatgtcaaatataaaattctatttaactgccagaaaatcttttaactcttgctgaaaaattaatatttatgattttatgattatataactttttaaaatcccaggaatgtatcacgcaaagagtttgtactggggatagaaatgtcggctgtatgaggttgtggttgtttttgtctgtgctttgtgtttgtgtatggatgtgtgtgttttatagagagagagaaagagagagacaatctgtctaatattacatttggcccttgaacaacacaggggttagggatgctaacctcctgggcagttgaaaatccatgtgcacattttgactccccaaaaacttaactactgatagtctgctgttgaccagaagccaccgggtagcataaacagtcgattaacgcatattttgtatatgtactatatgttatattcttataatgaagtaagctagagaaaagaacatgttattttaaaaagcatataattggattatttgtaacacaaaggataaatgtctgaggggctggataccccatcttccatgatgtaattagtatgcatagtatgcctgtatcaaaatatctcatgtaccccataaatacatacacctactatgtacctacaaaaattaaaaaattagaaaaagaaactgtaaaagccataaggaagagaaaatatatttgctattcattaagaggaagtggatgattaaagtttgcatcctcactgttttcaccttaactaggccgaggaagaggaggaggatgagggggagttggtcttgtctcaggggcagcagaggcggaagataatccatgcatttcaaaccaatgttgttcaaagggcaactgtagcctcaatctgggttttttagaaatctcataaaaccacttgtcattttctgagggtttgttgattacaactagataatacaacctgcatgtccattacacattcgcatataaactgcagtgagcatggtacccacgcacaaagaagcaagcagggagggcagcactgtcagctgccctggggcctgagccctgaacctcgcctcctgacagtgtttttcctgaatgggacacatggctgtccaccgtgcagatcacagtagagccacagagcttgtttcacactatttgagagacagatacaagtagaagtgtatgtaatttttttctactccccaggagattaccttgtacttgatactaaacaggaccctttgtgatttaatttgacttctgccttttctccagtctcttctgctatcaccttttgttcataatttaacaacattctcttttgcttttcctggcccactatccctttctactcactttctaatataccttgaatgccttttcctccatcatcccacacttccttttcctggtgaactcctatttatccctaaatacctttcagagcttggccccacccacactcatcctagagtgagccaggtgcccctcttatataacccctgcatgcttcgtgcctatctatagctacatttaccatcttgcattgtctacttctaaatttgtctacttctaaatctgtctccctcacttgagtgagagccccctgagaaaagagagtatatctcatttatctttctatgcccagggcctggaagagttctgtgtgttctaagatgtctagtaaatcaataaatttgttaattacttgagataatggctgtgtgcctgcagtaggcagaaatgtcatctgtgtagctgtaataattatgataatccctccatggttatgctggcagaatcatcatctgtgtcaatttagttcaatgccagaggtatttattgagctcctgctcaatgtctagcttgggaacagtactgtggaaactgcagagaagcaggatctgggctttcagaggtctagttagggaggaaagcccagcatgtactcatctgagcatttagtacaggtttctcgggcacctgaatgctatgctatgcataacaggcagtggggatgagcaatgagcaaaacagacaaaatccctgtagagcttgcatcttagtgggagaaataaaagtatactaggtcagacggtgataagtgctatgaagaaaagtgagacaaggtaaagaagttggagagtgactagggatggagggggttcagttttagtaatgcgggtaatggtcaggggtaggcttcacggaggtaagggagcttgctgtggggatgtctggcggaagagtctgagccagagggatactgtgaatgcaaagaccctgaggcaggggtatctttggcttgctgtggagcagcaagaagtccaacatgcctcagaggcttggctgggaggggcaggggcaggagaggaggccagagcaatggagaggcccagccaagggaggccttgggggtggttccaggaaccctatcttgcactcactctgagtgcaatgcagcagaggagggttgagatctgacctaggatttagcaagcggagagtggactacacagggtcagggccatgtgtgcagaggatctgcagtgaggaggctcctgtaagaagatatagagagatgatgagacacctctcttgggtcagggtagcagtggtgaaggaagtgacacatggtatgtttctgaatatattttgaaggtagtgttggccagatttgctaatcgatgaggttcaggacaagatgcaagctgaaaatgctacagcatctgcagtgtgtgttgtgtgggccccccgagggcctggtgtcccctgcgtgtacacttgatccttctgtgtaaccccattgtagtcctactgtggctgtgacttccctttttctactcagtctcaaggatggagagaagagatgggagatgcatctttccctacatgcacatgcaccgactcaaaccttctccatccttctcttttgttccataaattagtttgtctaagtagcttttcaagttgaatgttgttgttctggtttctcactattaatatttaatttagaggcactttgcataatttatctttaaatcataatgaatgcatataataataaacagtgatgtgatttatatgaaatatttacctgggttttatcacagaatattggatttgctcaccactttatcttcagggcttaaaatggtctgggcactcaagaagttttctgttgaatgaatggattgtgatgtattacaaatgcaaatctaaattttctcttaattaaggcaatgtataaagcttgtatatgaagtgatgtctaataaccattcagaattgtcttcaagtatagcaaatttaaagccattttcccttgatcactaaaaaatattgaagtcatatcaattgagagatattttgctgatttgcattgttaaagtgatgctttaacggttattgccttttcattcatttcttcattcttgaagaaccattgtgtaaatgtgcaaagcatattgagttgagaggaaatggagccatttaagcttaatgatattgccatgagacaaagtactatggtgttttcagctgtaacatcataatccaatccaagtacaacaaagctaattaaaactggttttgacagtcatctgtagaattttctaagcaatcacctatgttttctttgagttatgttctgtgttttctttgagtttaggtgctgagtgtgacacctaatgatggctttgctaaagtccattatggcttcatcctgaaggcacagaacaaaattgctgagagcatcccatatttaaaggtaatgctcactgcttctcctctcctttcatctttcaagtccttcgagttattgggacacacttgcttattccttgtagattgattgcatgcactgctgagtattttcatcctcaggatgtccaccctcagaccatgacattcataagcagcgtgggcctccactgtaaccaaaagtgtcagatgtcaggataccaaccacttgagcagagatgatttggaaaatattttattttaaaatttataaaactgaagttgttattagtttttaaataaatggcaaaggcagacaaaattagtgatactttaaatatttttaaataaagacaataggccgggtgtggtggctcatgcctgtaatcccagcactttgggtggccaaggtgggtggtcacctgaggtcaggagttcgagaccagcctggccaacatggtgaatccctgtctctactaaaaatacaaaaatgagcctggtgtggtggtgtgcacctgtaatcccagctacttgggaggctgaagcatgagaatcacttgaacccaggagacgttggagaagtctggagaacccaggagaaccctggagaagttgcacaccagcctgggcaacagagtgaaactgtgtctcaaaaaattaataaataaataaataaaatatatatatacacatatgtattaaatatagacaatgcattatatgttccttttacaagttaattatatatttactgtactcagaatagtactcttaactacccacacaaagttaggtaacaaatactggctgaaaaggtcattgctcaaaatattcaaattaaaatatgccttttttctcatatctaattaaatcctcatcaattcagcagaatcacaggtggtgtagaccagggcttcccagtagaattttctgctgtgggccaggtgcagtggctcccacctgtaagcccaacacttttggagaccaaggtgggagaatcacttgaggataagagtttgagaccagcctaggcaacctagtgagattcccatctctacagaaaattctaaaaatcaaccagatgtggtggcacatgcctgtggtcccagctactcaggcccaggaggtcgaggctgcattgagctgtgaatgcattactgccctccagcgtgagcgacagactgagaccctgtctctaaaaaatgtgtataatattaaaaaaacaaacaaacaaaaaaaacagagcaagacccagtctctaaaaaaaaagaattttctactgtgatggaaatgttttttatctgtgttctccaatatgatggccactggccacatgtggccattgagcacctgaaatgtggccactgggactgaggaagtgaatttttcattttattttaatttagcagtaatgtgtggctagcagctaccatattggacatagctaattagatagctgtaggctttttttttaagtatcaatatattccacttttatgatctctttctttcacatgacttaaatcagagatcccaaatagtaacccactgattgcaaatagcttgcatgttttatttggctggcatggttctattaaaaaccattttaattgcttgccttatttgagaatctgagcatttttatataattatgcagacttctagtttctcttgaaacgtcatatctggctcacttccctgcacacagacaagcagtgatccccccttgggatggggctgtccctggacccctgtcaagcacttcatatttcctgccagggccctgtgggcatgtgggtttctgtgatttaaagtgtctccttacatttcctttgacataggatggcttactggtactctgcctgcttcagagatagggaaagcaagagctggcctggtcagttatcaagcaaggacacttgagtgttggtcaattagaagccctcgccacagctcccttcctctcctgagtgatgatgcctttcccattctatcgtgcagcttgctcatttccaacattatgtaaatacaatttcttcctagtgaaagataataggcttcttgtgaagaggcctcaaggatgcagatttttagaaagaagtccttgacatttacatatttttaacttttgtccttctgcttttctaaacgcattctgttgctttaatattttctcttttctctttgtggggacgggaatggggttcatcaatctcaatttcagtccttgtgtgagaaatcagagaattaggtaaatgttttagaatagggatttgtttaataaaaattacatttttaaagattcaaattggctttaattctcctgtatgttttgtaaaaaaaaaaaaaatcattaaaaggtaaggacacatttgttttgaatggaaagaaataatgctcgcagttggactgccatcacttcaaacatgagcagttaaacattttggtttaggaataaaaagcctctagatgacatatggtcagatttggagagcaaaataaatgtaagagctatccagccagagaaattcttcaaaatattgaaatatgattgttcccacacagaaggtacacaaagtatcatactaattttgtgggccattccacagtgaattaatgatgaatgcattgttaaatttagctttatgacctccttttgttttggcattgcaaatgttgaccagtaacctcattcccaaagtttaatatggagatatatttttctggtttttaggttttcatacgatgtgccataagaaaagctatgtaaatcaattaatggaatctggtatttaattattttacccatactaacactgtcctttctacaggaaggaatagaatccggagatcctggcactgatgatgggagattttatttccacctgggggatgccatgcagagggttgggaacaaagaggtaatgggtatatgaatttctgattctctctaacagaggatggagttgggagaataattatttctaggaaagttagaattcaaaaaatattttgagtgtgaactttcgaaagcagtgatataaactatttagttacttaaactatctttggaacaacccaacaactccagcttaaccctttaaagaatttttgggatttggcttttatagtttctttcaagaaatcagctaagtaatcacaaaagcaatctctaagttggtacatgtctgtgtatgtttttgtctgtgtgtatctgtgtgtgtgtgtctgtgtgtgtacagagagatagaaattgccttggaaaagtattttttaaattttgaaatgaagagatgtcactgaaataatttaaatttttagaaatattttaacagtttgactagattcatttttgttttattttggacttttaaaagtagttctttttagaatgaagtctttatcagctgattcctaatcacacagatcctaatggttagttgtgtaacttatcctctgaaatatttaataccaagtttaagacgaacattgtggtgatagtaatgatagggattgacacaaaaaatgtagtagctaaaaaagttccatgtttcctttgtaatggttacctttttctgagtacagtgtctgcttctataaccataacattgtctcattaatcatgacatcgcatgctataaatttcaaaactctgtcacagtctaccatgatttacgatttatgcagccctgctggatggcaaagccctcctttcctgtcctgctttattgcaggggtgagagctgggctctccttagagtcagtggataaaagggtaaagtgagacactgaatctttgtaaccattgcatcccatgtatgtaataaagtgacatctaaggataatacagcttcaggtttctaaaattagtaagaacatggaatcatctggggaattgagggttcagagaagtgaaggggtttgtgataacgtaattgtctgctaggaacatgaaccaatctggaggtactagaggttcagataattgacaatttttgatttatacatgtctatttatctgtacctttccccctctaacctaccagtcaactgaaatggaatgagatattagaattaaagagaaagatgggagaagaaattgctgattagtagtcctttttgcatcgcatttttcttttagatgtaatcactcagaactcctttgaatgagagggataagaaagattttgctacaacatctaacactggataaatgttcatgtctgactactgtaaatgtaatcatcactaattaatttatctttgaacatttcagagtccagggcaaagacagatgaaagaagcctatgatttatctcacatcttagatgaaaacagccgttacttcaagggcaaaaagttcattactatacacttgttaagggcttgggatttgaacgtatgggactgttctaccaacttaattatcatgaatatgcaaagaacagcacagttcttgaatttaaaaagttcagaaggattcgttcttacaggagaacagaaacaaacctgtagaaactccatgttagtatattcccagcattaggtgttgagtctgacttggctgtcgtgctctgagtttgcatgtcaggaagtaaacacctttcacgtttttatgcctagagcactgctccaactctgaaagaggatggatctgcaaaaagcaaagccacagcctctgtgctgcagagactgacaagaaaatgggttgtgaggaaaatttttctaagtggtccgtttagtatgggcaggaagacgggggacaaaccatgagggtctgcagcaattcagatagcagttctcggtattcccataacttccaaatccacgttctagctagatttagtctccttctccaagtccccattctcatgtctactgccagctcagtgtcccacacgatggcacagagacaacttacttgtctttctctaaaccgtttttcctcctaggttccttctctcattcaatgatattcccgtcttcccaggatcaagatttgagtgagcttgagctcctccctctcctccttactccagtctagtcagggccagctatggagatctggttttctcatgtttttggcatccccctcaccctccctcttgctcagtcagtgctaactcctgtctttgtcaactgcgtcctcaatgatagctgtgagaacctggatgttgtttcttgcttggtctcagtttatttcaagccaccctatgctcaaaaagcctaccatgcaaaataacataacattctgtttgcacgcgatagcatttacaatccttaggcaagttgcagccagctcttctcaccagaagtgtgtctctcaggcctcactggacagtgggctccaggcagaacataccccagctggggccacttatgacagcccattccacagatgtggcctgggcttttctgggatccagtcatctgacatactttctgtctctgtctctctctctctctctctctctttctcttatgtgtgtgtgtgtgtgtgtgtgtgtgtatgtacatgtgcataaaaaccatacatagcaacgattggaagaaagtagagacaacattgatataaaatatatttaacttcttaaatgtggcccaggggctcttactgcccctgtgtcccagggcctcctactgtctattttaatattcctaattgctgattagacaggaaaattgctgatcagacaggaaatagtagagaaattttcaggggattctaacttgatctttgattttatagcaattttttattgtaaagtagtttaggttttttttaaaaagcactctagctgaattcattgggtcccctgtgtcacatattattaaaggtgatttttaaaaatttctgatatatcactttcacaattttgtttctcctaaaatttatatgacaggagagtgaaaaattgagtcctacttgatgcaggattacttactttgagtgtcagaaaagaccttatagatagtttaaacatgctgttgtaacttgcccagacatctagcatgtcgagggctaattaaaggccggaactaaaatctaaggcttccaactcttgaactacagctataatgtttgctgtttttatttttctacaataacttcttttctcactattctagcaatacactttatccttaaaatgaattgtgatgactcaaaaatggactgtcagatttttgaaaaaacaatctgttgtccttagtattattgttcacttttgccctgaaaagcataggaagtaaaatcctaaattttagttggacaaaaataaccacaatagtcaaattaatttcagagatatatgctattttttaaaaaaattagataacaattagccattttaactttctagtttttaaaggaattctggctacaacttacatgtattgtaaggaaaatatttaagaatgatttgtatatgcattcttagtttcagatattaataaaaaagataactaaataagaaaatcatttttcatagtgtttgctaaatgatataaataggaggagagtagaataagttgccaggagccccaaatgctagttcagaagatttagcctttataaaccttagtttcaacatttgtaaaatggagatatttggggttattggaaaaatcaaatgagataacacattcaaagaaagtagtcaatgtaaagtgttactgaaaatatgaggtgatattgctatcccccttcagtctcctaatgagggaaaatttgaaaagttaacattttttacatctaaagtgtatctggtgatttacaaagaagatattcaagttactatgaaatgcttatttttatttatcaaaaatacatttgaattatctctgtaaaagtaatcattagatcaggtttgcagtagtggaggggataatattaagtgtaccattagaaagccttccattcaaaagacaatggaacatgcatggtgcaggaagtgggcagggctccttggagagcatatggtgagggcatcatttaaaggagccataaagagcgtcatgctccgtagccagctgtccctgaaaaggctagtcttggaggcaagtagtatcatgttgcagctagcctaaagccacacatgttatcccttatggcagaaaaaaatatatattatgaacaaaaattccttctttaaaaatctaaaatgggctatcactgtatttattgcccactcagaataatttttcccttctgtctacttaatttaatggagggtttgcactctgacgccttggtgtgaccttcttaaatgtggacatggaaagtacatgtgaaaagaagctgcttttattttagcattctgattcagtaaatgcaaatatctttgaagaaattattaaaatcataatctttttctaatggaaatagaaaatagaaaaggccctttggtgtcttatttattcattcaaaaaataagtgctcgactccctgctggacactcgagggagaccaaaatgtgtagggcatgaatccactatccagagagactgcagcctaagggggaaaagaaaatgtacatgttcattatacaaataggtcataatcagaaacccagtgaaataacaatattttcaccagatttcaacagatttgagtacctagcagtaagctctttatttaaatgtgtcaaagtaataccttatttttaatgttttcaattttaaaattaataaaaatgctctgttgaaggaacagtttggagcacattctttctgttccttcaggcatataagtggtatgagcttgggcacaagagaggacactttgcatctgtctggcaacgctcactctacaatgtgaatggactgaaagcacagccttggtggaccccaaaagaaacgggctacacagagttagtaaaggtaagtataacttagacatcatcctcaccagatctttgtctatttcctcctcaaaatcagaaaatgtttatcataaaaaggaatgtcagggaagagatagattttatttctagtgacatttgcaaaatataatggaaaaagaattgtcatctcattaaccaaaagtttcatttagatgatgaagggaatttgtgcggaacttaggagttctcaacctttttggccttaggaccctcttatactcttaaaaattattgactaccccaaggaatgtggcttacatctaccaatataatcattagacattaaaagtgaaagaaaattatatatatatttatgaattatttaaaaataataacctcataacatgtcagtataaataactttttaaaaaaattatattttcaaaacagaaaatgtagtgagaagattggaattgttttgtatttttacaaatctttttagagtctggattaatagacaacaggagaatcctcacatgtgcttcacacatgtacctgttagagctgtgatgtcctacctcatgtagcttctggaaaactctactgtgtgcccagaaaagaatgaaaagagcacataatatctttgtattattaagaaagtagttttgatcttgcagagcccctaaaagggtctagagaactctcagatgtccttgaaacacactttgagaaccactggccctgcaactatggagagaaaacgcagttataaatattgttagaaaatgctgtggcagaaaatgttgtagcatttggagaaactaagtgattctaaatagctataaaaataattggaaggttttatattagtaggttaaacctgaactttaacggtctctacttggtgactttggtagggactggtcagaagtttacttttgctttggtaagccccctcttcttagacagtcataaaatgagactcacagttaattaactcatagttccaatcatgttgttttctactcaaaatgtaaaaacttcatgtatcttacaggttagatggcttcagggttttgacctcagactctaattgctatttgtacatggtttatataagaaaatatattctgatgttcaaacaattgattttacatgtgcaagaagcagggatgaagaggaagagtgacaaaatattgataatgttagaatctggctgatggatatgtggaggtttgtcatactgttctttcttcctttaggtatatgttgaaatttttcataatttttcttttaagtaacatctaaaataaactgtatctataagacttacaagacttcactgattaatttggtctacttggggaaaagaggttttcatgtacttagattatgtcttacttgactgtgtttattctgtatgtcattataaaagcatactttataatcttcataatccaattgtaaaataggctgccattggttagcctttgaatattttatagctcagggaaccatggcatggtgacaattaatacagattgattttttaaagttccatatccagattagaaatagcacaagaacaacatcttccttgataggtcggctacatttagcactgtcgggtttttttgttttgttttgtttttgtcaaatttcaccctccctcagattggatcccatcgaactcttctgattctgctttactatcttttattcatgatctctttgtgagttcatttctctactgtaccttttgggatcctttcaaattcaaaacacggaaatgcaattcaaacctggcttaaacaacaagaaatgttactgattgacatagctggaagcctagcagtagggcagacttcggggcagtataatcaagggaagatgttcttggctctgcacttcctccttggtcagctttgtccttgtgctggctgactgcaggatggctgccagcagccactggaagagagggggagagagtgacattgctgagctaccaccccagccgtaaatggccttctggaaacctcctggcagaccctcttctattggtgggaaccatgtctcatgggcactcacagttacaagggagtctgaaacaccagatggctggcaacagtctgaggcagccagcttccaggaggagagagggtgtacctctctatcatctaaggaccagtaatctttcctttcagtcttattgagccaatttaagtcagatttccactctagatgaattactggcagggggatatgagattattcttaaaccaacagatcaaaccctacagccagaaaaggattagtttcctctaaatcaaataaatggtttatctggaggaaggtggacgctcaaagtcagacttttgttaagaagaaagaagcatgattgattgtgtgaaggcagtctactatgggctgacatggacccaaacattgttctttgctttcttttctctttttcttgccattcattttctaagaaatcttctccactgtggtttaactgctgtgaaaattctaccaaagctatgttccccaaatggacttctcactctttctattctatgttcagctctattaaaacattaacattcggtgtgaacattaactcaccacgtaaccccttggttaatatcgttttccagctttccagttttggtcagtgtcttagtagtccatttaagctgctgtaacaaaatgccataaactcggtggcttataaacaatagaaatttactttgaggaagtccaagactaaggtgttagcagattcagtgtctggtgaaggcctgcttcctggtttgtagatggtgctttcttgttgtgtcttcacatgatggaaaagagaaggcagctctctgaggctttttttataaggacaataatcttacttgcctaaatcacctcccaaaggccccacttcctaacaccatcacattagtgattagatttcaacatatgaatttgggggacacaaacgttcagaccacagcagtcagtgattcagctttagtctgcctttatctcttaccactgccctttaccatcctcattccagacaaaattcttccaacagaccttcccatacggtagccctctttcctggaggactctttctttacctctttctgttttccttctctcatatatccttcacagccaattcctttttatccttcagatgttagagaaattgtcacttcttctaggaatatcagtcctttgcataaagccaaaagccctttatactttctttttaaatagcacactatattctaaagtctcttagttctctgagattgtgtcttctaagatgacagggaccatgtctctaatacatgatgggttctcaaaaattaggttcattgtatgaccttctataaactttcttttctctagttttttcataaatatgttagaagctccagggatttaaaaatgttactactgagcatttcttacatataagaagttgcaacagttggtatccttggtttttcctgaatgtgaggaaaattctcccttactgcactgcaccaggagaggaaggcctagagagaaagaaaattatctctacctgctattttaggagcaagggacaaaggtattcattttcttgaaattgttactgcttaagaaagaaggatatttagaatgttctcagttcctgatgaaacctcaagcatttaattgcttataaaacattgtgtaatgaggcagaacatcagaatggcagagggaatgtcttcataaatctacccctccacaaaagcactgagaaaaattgttaaaatcaacttctttagaactctgtacattagcaaagacatacaacaattagaggaatatttattgaaggaaaaagtgctgaacctgaataagaatagcagggtttgtggggtggtaattttaactgctcccaaccattcttccccagttccagggtagccttgaaaactggcaatctcaaaacactagagcagtgaaaaccatagctttccaggcactagtggggccacatcacatttttagtacctcacaaatttccatacccagagcattgtcaccattttaaacctctctctttctacctggaaagctgcattctcaggacattgttgttatttgtcctcacttgcaagaaaagctctattcccaggctattagtcaaaacaattattggcaggtattttttttaacattacaagtgcccagagcaactacaggtaaggctacaggcaatagagatttcacaaaattaatccagaaagtcagtaaacaaacaaatagtgacaacgataacaaaaatgaacaacaacgaattttatgagagggaccgaactgatttccagaattgccacattgtattatctaaaaactgtccagtttcaacaaaaattatatgacacacaaagaaataggaaagtatatacatgcacagaaaagcatgcagtcaatagaaactgcctgtgaggggccctgatgctgaacttactaaacaaaggcttcaagtcagctatcgtcagtatgttttaataactaaagaaaactatgtctaaagacttaaaagaaattattacaatgacgtctccccaaatagagaattccaatgaagagacagaaattataaaaaagaactaaacagataatctggagtcataaagtacaatatcttaagttaaaaaactcactaggggggctcaacaccagatttaagctggtaaaagaaataatcaacaaatttggaaataggttctttaagattatccatgctaaggaacagaagaaaaagagaatgaagaaaacaacctatggagcacgatcaagtgtaccagcatatgcataatggaatcctcaggggaagaaagagaggtggcagaaggactgtttgaaaaaataatggccagaaatcctccagattagataaaaagcattaatctacacatctgagaagctcaatgaattataaggaggataaactcagaaacatacctagacacatcacagtcaaattgccaaatttaaaatttattttcactttcattttattttttcaaattctaatctcaaattgacaatcaaataaaatgagattcttgaaagcacacagagaaagaggacttattgcacaaaaggaaccttccttttaagatgaacagccaacttgtcatcagaaaccatagaggagagaaggcaatgaatgacattcaaatactgaaaggaaaagactgccaaccaagaattctatatctagcaaaattaagacatttccagatatataaaaactgggagaagttaatgctagccaatatttcttgctctacaatagatattaaaggcagttctttagattgacataaaaagataccagatggtaatacaaatccacatgaagaaaaaaaaagagcatcactaaagatagtgggtaaacataaaagggataatatatgtgtttttattagttttttcttctatcttattccaaaaccaatgcataaagcaataaatgtaatatgtattgtttgtggacttatagcatagaaagatgtaatttgtatgataatagtgcaaaggaggaaggggaaaagatttatgttggagcaaaatttctgtatgcccttgaaattatgttagcaataaattgaaattgattgttttaattaaaggtattaattctagtgcccagggcaaccactaagaaaataactcaaaaaagtagggtaaaattaacaacaaggtaattaaatggcacactagtaaatatctatctgttgtaaaggaaggcagtaatggaggaacagaggaacaacaacagcaacaaaaaggacattaaaaatgaataacaagatggcagactttatcagcaattacattaaatgtaaggacatgaaatactgcaatcaaaaagtacagattaacaaaatagatttttaaaaagtgatccaattcaggtccacatgaaacattaaccaggaaagactatacactaggccataaaacaagccccaacaaatttagaagcactgaaatcatacaaagcatgtttactgaccacaaaggaatgaaattaggaaccatcaactaaaagctctccttgtcctcaaaatctgtttgcttgccagtaccccactactgctgtcaaagttactgacttctgcttatatatcttgtgtccttttcctttttgatatcaagtattttattaaaattcttatttccttgggcttttttctttcagccctgcctgtcttaaactctgctttatttaagaagaaaagcaagatcagagtgtgaatcatagaattctcagtgcatggaatctcagtgtgtgtggcatctcatggttacaactccatgctgtgtgattgtactttgagaactatatttgcaggaatgttaatttatgacttaaaaaaaaagtaacgtcaggatgaccacttgacagtagtgactgtgacattaagagagctgctgtgtgcagaaacccagagttcattgaccgtttagttgacagaccctggaacatcaagatattcttctattgtaattttcaaattacagaattgaatattatgagtcatggaacatcacccaagtattgacgtcttaaagtggaaaccctctagatttagtagctgcaacatttggccaaaatacttttagaataattacccagattttggcccttgagtgacttttaactaccatgaatagggcatttccctttttttttagacggagtctcactctgttgcccaggctggagtgcagtggcgcaatctcagctcgctgcaagctccgcctcgcgggttcacgctattctcctgccttagcctcccaagtagctgggactacaggtgcccaccaccatgcccggctaattttttttttaatatgaattatatctttactcttataaaagtcatgttgaataaataaattctatcttttaaaatacaaaaccattatattgccttaactctaattttttgtattttttagtagagacggggtttccccttgttaaccaggatggtctcgatctcctgacctcgtgatccgcccacctcggccttccaaagtgctgggattacaggtgtgagccaccgtgcccggcctctcatttccctttcttaatttttttttcaattcttatttttaaaattataaagatggcgtttcaccatgatgcccaggctggtttagaactcctgagctcaagcgatccacccacctccgcctcctaaagtgctaggattacaggcatgaaccactgcgcctggcctgatagcacattttcattcaacttacttcttgctctacattacagtgagagatagagtgcagttttcctgaaggcaggggacagtgctcagtaaaatgcatcatatgtgttttcccctttggttgaatttctgtatgcccttgaaattatgttagcattaaactgaaatagtccattcttgcatcgctataaagaaatacctgagactggtattagtccattcttgcattgctataaagaaatacctgagactgggtagtttataaagaaaaaaggtttaattggctcacggttctgcaggctgtataggaagcatggtggcatctgcttctagggaggccacaggaagctttcaatcacaggacgcttacatggcagcatgaacaggagcaagagagctggggcaggtgaggtgttacatacatgtaaacgaccagatctccaagaactcattcactatcacgaggacagtaccaagagcgatggtactgaaccgttgatgagaaatcacccccatggtccaatctcctcccaccaggccccacctctaacactgaggattacaattaacatgagattatgagatttggatggggacatacatccaaacaatatcacccctcattgtgtaaatataatttggcagctctagcactaggagtgtggagaggctattcaactcaaggaaaacattagtgaaaaatattccagtagagttttctcttttcagcttattttccttaaaattgagtaggttgttgcccaaatcacaactatcaaagcaccaagtgccttgggcttatttaacatagaaattgaaacaaaaatggattaaaatctttgctagggtaaaaatagaaaagatgtcctatagttagagaaaagccattaaagcttaagagttttgctcttcccttttcgggattaactatttgatccacactaatttagatgtaaacacacattcatagaaaacactatagtaacattgaaaataaacaaccaatagcaactcaaaactgttagagtaggtagctcgtcaggcataagcagcgcaggagagggacagacacacacacacacacacacacacacacacacacacacacaccccagaagtgttaggtgaccatcacatgatggtcaggcggttgttaacttttctctaaagtaataattggtcacagccggcaccagggaaaggcagtctcctaatagatagaaaacacctgaaactgatcagcagcttcccagtaaggtctcaggagtggggagaagtaacgcaagatcctggaagtataaccccaagccgagaggtcaagcagggcatttgatctctcagcctgcttggccctcatccaggtgtgctttccttccttcctttctttactgttctaaagctttttaacaaactttcactcctgctctaaaatttgcctcggtctctcctgctttatgcccctcagtcgaattcatccttctgaggaggaaagaattgaggttgctgcagacccatacagaaaactaccgctgataacaaaaactataattttaaatatatatatattttgagatggagtctcactctgtcgcccagtctggggtgcagtggagtgatcttggttcactgcaacctccgccctccgggttcaagcgattctcatgcctctacctcccaagtggctgggattacaggcgcctgccaccacgcctggctaatttttgtatttttagtagagacgggtttcaccatgttggccaagctggtctcaaactccggacctcaggtgatccgtctaccttggcctcctaaagtgctggaattacaggcatgagccaccacacctggcctaaaatatattttttgtatttgtttctcctgctgtctaactctgcattcatcactgagaaaaaggaaaactgcattcttttcccagtttttcagcgcagctgcttggatataaacacatccaaacagcatcataaataagttttgtgatccaaaatagcatcatatataagtttgcctttcttcatattgtagttttattacagctggaagagtgcccagtaatattttgccagtgatgtgacatagtgcattggaatgattgattagaatagcactctgtcactttccttcacactgtggcttttattaattaagaaatccattgtgtatgaatgacttcgcctagacaaaaataagacttacacagcactaaattagtggttcagcatttctttctttgtaattaaatacttgaatgttttcactggactgcttttgaaatgaaataatttgagaaagcaaaaatgtcagatttatagtggaattaagctgtaaattaagaggattaataatttatataatttacttttatgtaaaagtaaatatagtatcaagaagtactgaaagcaatttcttaagattaacataatagcttagtcttatctttctaaatcaaactttaaactgtttgggtttcgatgacactttcactgaagatgtcaacaaaacaacaattggagtgtggagtttgataattacatgatttaacggtgaactttttaaaagggctccataattagaaacagatttgttttgctgtcagctctgacactttgggcaagtccttttacccatctgagcctgtttttttgttgttttttgtttttttatctctaaattcaaaataattacctcagctcctcttctcccgtgacgttttggtaaggcttaaaacacaaaacaaaatgaagccttccatcatggatgttcctgtgtgctatttagatatgagcccttaataagagtccacacggctgaggctatagggtggcctatgatgccaattatggcagcagagcaaaggaacacagtgttttatattctttgagttatttcatacaaagaggctttttttttctgaaagcaaaatcagtgagtttttattatttgtcaatgtgggagaaaaaaaaagacctacaaattggctttctctctgaccctctttgggaacttacagcacaacgtttgatatttcagaataattgcaaactatacctctaggttggtactccatttggggttctaaaatgtctaattcagtaggtcatgatttgtctcaatatgctacacagatagatgtcttaaatatgcatatgccctttgggaggctgaggcaggaggatcacttgaggccagaagtaagaaccagcctgggcaacatagcaagacctgttgctacaaaataataataataataataaattagccaggcatggtggtgtgcacctgtagtcccaactatttgggatgctgaggcaggaagatttcttgagcccagaggtttgaagctggagtgagttatgattgtgccactgccctccagcctgggtaacagatcaagaccctgtctcttagaaaaaatgtgcatatgcacatacacattataggcaatttgtttatctctttgtcaagaaatttgttgcttatatacacataaagtttcagctgcctgagattagtgactgtggggctgctactctagcatcactcaggatgtcccttagtgcactgtttccagctggtaggtgggacatgaagtcagctccccatcttccctttaccttctctgactgatagggcggactggcttccctgcctgtctgagccaatatatgaggaatatggttctcctctgccatctgagtccttgaagccctcaggctggttgtttgtcctggcaacctggattatcttttctccttcctctcaggtgaagcaatcctttttctctcactcactagaacgagcaaaagtcatttctccaagactctcctgtcaccccagtgctagctaggtgcctcatgttatccttttccttcagcaaggatgatgagaggctgaattcacagtcagtagccagactatatgtaaaaatagaattttgacccacaacctgcagtaacctgcccaggaaaccaatcccttatctatgataaacagcccaggaaaccagcatgctataagtcagacttgcaggaagccagacttctgtatctagtaacaatccagggagctacacaatcaattctgtaacaatcagaatagccccaaatagccaggatttgattaataactgaaggcttccctgaattttgtccacagttccaacgtaagcccaaccagagagagccaaatatgcaccctcctctaatcacataggatgtcctgcttctagttagccacttctagcttccttaggccaacagcccccactcagagcatgcctgaagccttctcttcctattataaagctttcctactcctctgcctgcctttagagtgtctgccaaaacacaagtgacagtggctgactcccttgctgtagcaagcttagaataaataggctttgcatttctcacttcattgacttttatttccacaataagaaatgtcacctgttggttgggtgcggtggctcacgcctgtaatcacagcactttgggaggctgaggtgggcagatcatgaggtcaggagatcgagaccatcctggctaacatggtgaaaccccatctctactaaaaatacaaaaaattagccaggcatggtggcgggcacctgtaatcccagctacttgggaggctgaggcaggagaattgcttgaacctgcgaggcagaggttgcagcaagccaagagcatgccactacactccagcctgggtgacagagtgagactcttgtctcaaaaaaaaaaaaaaaaaaagtcacctgttttcttttatctgtatattcacacttgaaaaacaaggagatctaatcaaagtgtattaggaccagtgagagattacactttaatgctagtaatttccttagcggtgttgttagaagtattgcaaagagaatttgctgcaatagcattacagtcccatggtgtttgatgtaataacctcgtctcagcacccagggggatccccgccatcctgggatgttgtttctaaggcagattacactgctactcgtcttatcatgtttagagtataggcatgttttgactaaaatttaagcaagctgattttatctcttaaaaataagatacataattcctcaaataataactaatgacaagcatattcttaaccaattagataaaatttagtacacagtatactaatgcaccattgttatcaattcattctaactccaatttaatacacagactttgccaagaatagcctttcacagcatccctttcctcaatttagagtcagaaactttcaaggaatgtataaaactctgggacttttctcaatttccagtgtctgttttctcgatgcctctttttcttaacagctagtcacaaacagttactaacctaatcttgcttatgttacactgaaccctaagagttgttttgttcacatgttaaaaacagctcttcctgcatttcttcaaaactgtgttttattttgctcctgcgaatttaccttttcctatgttgatgtgaatatattcttgatccccttccatctgctgtttgcttttgtagctagagctttttcaaacttgaagctatataagtgttatgggctgaactgttgcttcccacaattcctactctgaaattctactccccacgacctcagaatgtgactgtattaagagactgtgtttgggtctttaaagagatagtgaagttaaaaagaggccattagggtggaccgtagtccaatttgattggtgtccttataagaagaggaactttggaaacaaagagagacacccaggatgcatgtccgccaaggaaatgccacatgcagacagtgagaagttggccctctgtaagcccaggagagagccctcgaaagaaaccaaacttgctgaccttggtcttgaacttctagcctccagaactgtgagaacagaaatttctgttgtttaaaccacccagtgatactttgttatggctgcccttgcaaattaccattagtgactttccttcgtaaatcccgttactgaaatgtgtactaactgcctcagcaaaaacttttctcggaatggtcctattttcccacatacaagaaaatatttaaagctcagaccaattatgattgattagaacaaaattaaaatggtttaggtcaaacctcaagtatcacttgtatcatcatctgagtgtgtcatgggattgaggatatactaactaagtgatgcaaggaaagtgtataggccaagaggcaaaaagaaaccaggtcaacaagaaatcaatatatggattagcagagtttgattcaaaatgtaaaatatgctgatacttttttttttactttctactgcatatctctagcatgtggaatatcattactttgagtttgatgatctcttaaaaacgaatttgaaagactaataaggggttttgccggctaataggattttctttctaagcatcactagatggttggattacatattacaagatttgactagtctaggagaaaaggaggtaaaagtaaagaaagaaaattcaattattagagatatatagaaaatatgagtgggctgggcatggtggctcacgcctgtaatcccagcactttgggaggccaaggcgggcggatcacctgaggtagggcattcaagaccagcctgaccaacatggagaaaccccatctctattaaaaatacaaaattagctgggcatggtggtgcatgcctgtaatcccagctacacaggaggctgaggcaggagaattacttgatcccgggaggcagaggttgtggtgagccgagatcgcgccattgtactctagcctgggcaacaagagcaaaactctgtctcaaaaaaataaagagtcaagaaggattaaacaaactgagcacatgcatttaatagcaccccccacctgaaacctcacttaaatgacaatacaagaataaaatggcacaaattgtattttttaaagggagacaatagcagatgaacagtgtcagcgtgtaattttgaaagtggaaaacagaagtagatgatttggcagatctaagacagcagaaactgtagcaattacagagaagcttccaaagaagaaattcaaggcacctggtactacagcaattcaagaaactgcatggcctcagagaatagacttatctacgctgacattttaggatccccaattaaaaaacaaacaaactggcttgacaatgcacccaacatggaggcctgtcagacacaggctctgccctttcacaagatgtccaattgtagtctcaattttataggactgacagccaaggatcacgaaacattaaggagatttttaacacgaaagatgaacaaaacaaaaagaatgatgtagcttgtgggaaatcgagaaaatgtagggaacaaaagaaaaacaaaataatacctctaatatactcagagcaataagagaagatgtgtatctgtaaaacaagtatgggatactgtaaaaaggaagaattgaagacccagaaagggctctcagaaattaaaaagtgtgatttgcagaaataagaatttaaagcagtattagaagctaagttaaggaaatctcccagaaggaaaaacaaaaaggcaaagatggaagatagaaaacataggatgattagaggctcaatttaacatagctgacattcagataaaaagagttccagggagaataggcaaaaaaaaaaaaagaagaagaaatgaagaaatgaataatattagaagatagttcagaatagaaaaaatgtgagttttcaggttgaagggtgccactgagtaccctgcctttacattaaggcatattgccatgaaatttcaagaaacaggaaagaaagagaaggtcttaaaatcctcatcatcatcatagctatacttgcatatagtgcaagcacttttcacacatttaattcttaaagggcctcttgagaaaagctttataaactaaggcacagagataagtaatttgccccaaatcacacagcaaataagtggcagagtcagatctccaaacatgcagtctggctccaaattttatacccctaaacactatactatcctgactcctataaagcttctagagaaggaaggataggaagagggagaatctaaaagtcatcaggtttccaacagcaacactaaaagttataatgtaatggactaatcctttcaaaattataaaaagacattcctcttggcaataattttgtggatatgacatggaaagcacagacaacaaaagcaaaaatgaacaagtgggactacagcaaactaaaaagtttctgcacagcaaaagaaacaataaaatgaaaaagcaatctatggaacaggagaaagtatttgcaaaccatatatctgataaggggttaataaccaaaatatagaaggaactaatgcaactcaatggcaaaaaaactgaataacccaatttaaaaattggcaaagggcctaagtagacattttttcaaagacctgcaaatggccaacaggtatatgaaaatgtgctcaacatcactattcatcagagaaatgcgaatcaaaaggacagtgagatatcacctcatacctgttaggatggctattatgaaaaaaatgaggtaacaagtgttgatgaggatgcaaagaaaagggaacacatgtacactgttggtggaaatgtaaattggtgccataatggaaaaccatgtggaggttcctcaaaaaattaaaaatagaattattatacaattcaacagtcctactctaattatatatctaatggaaatgaagtcagtaactcaaagaggtatctgcacccccgtgtttattacagcattatttactatagtcaagatatggaaacaacctgaatgtctatcaacaggcaaatgaagaaaaactttagtatataaacacaatgggatattattcagcctttaaaaagaaggatatcctgccacatgcaacaacatgaatgaatctggaggacattatgctaagtgaagtaagccagatatagaaagacaaacactgtatgatatcacttatatgtggcatctaaaaaagtcaaactcatagaagcagagaatagagcagtggttgcctgggagtggggagtgggagaaatggggacatgttggttgaagagtacaaactttcagttataagatgtatatcaactcattgatatatattgccctttgccttgttcactttgaatatattcaatctctgtcaactatacatttttaaaataaaaatagtatcacactagataacaagaaaaaaattataaaacaaaattatttactaactaaataaatttacaacctaaatacctaaccatacacactcaaaccttcaatcaggtataagagcttgagacactttcagaattcaattttacctgtggtgtgtccttcctcaggaataactagaatccagtaattagggagcccagtaccaggcagaggccaaggggagttccatggccatcatcatctagcaaattcagacagtaactgatccagatcagagcaaggcaaatggctgcgggagggttatcttcagaaaaagagaaaaagcaagaaagtaatcaatttataatgtttttggcaaaaggtagaataaaagcatcaagggatttaatagcactctttcagagttagtgaagaaatagtatgaagtgcattacaaaataaagccaatgaaaaggggacagaaaaaaaatgctgcatgtgacatgaagtgtaatcattacaactcaagtatgaatgatacctgattgtcatactattataaaacctgaatgtgaatttgcactgatatgaaagatttgtgaaattaactgtattacaaggatggagaaggaagacattaaattgtttaattgttaaccttctataatagatgagtgataatgcctcaaattaataaatcaagaatagcaatataacaggctatttagatataagcaggttaacaacagaagaaatattttaaataattagccgggagttatactgaggattggggaagagttggagaagagactgcaattctcattataagacctgtagtaatatttgactttaaaaaatgtgtattttttaattgaacaaaaacattagtaagaaaaatagttaaataaaaatgagttaggctttagtttgcttctcaaaagaaagactttctgcaggaagtcaattttaagagaagattttaaaaataggacttaatttgatgttacagagaaaagtacagcatccaggtggcatgagcaggctgtctggggagatgaggaaactgctcctaactggatgcaggtctgggattcaggagagctggggcaggatgtgggattcatgaggtcagaactgggaaggccatttatagatgcctagagtgaaaaatatagctaaggtgtaactggtgaggcacatgctgagatggctttatgaagccatgtgctgccgtagaaagaatcaaacctgtgctttctaaagtctcttttgccacaagaagaaatgggaattagaaactggtgtctttcgggcaaccaactgaatactgatgcaattagtttctctttcagttttatgaaatagatgagtttagagtcaagggagtaatatttcagaagaggcttttaaaaatgtaggcattgcctgctgtttgtgagccttcaggttttctgttggaatttcctaaaaactggattatttgccattgaagacaagtgggtggtattagtgtagagaaaattcatattctctctccctctccctctcttctgcacacacatacgctgatatggtctgaatgtttgtgtctcccccacattcatctattgaaatttgactcccaaggtgatagtattaagaggtggggctttgggtgatgattatgccttaagggcaaaacattcatgaatgagattagtgcccttacaaaagagtccccagagagtttggttgtcccatccaccatttgtcgaggcagctagaaggtaccatctatgaaccagaaagtggccctcaccagaattgaatctgcctacatcttgagtttgaacttctcatactccagaactgtgggaaataaatatctgttatttataatctacccagtttatggtattttgtttttgtcctgaatagacatacacatgccgagtgtaattaggattgatctttaatttcctctaaccatgtgaatattatattacgtgattccttggtttgtgcttaaaaacagcattcttaggtcccatcccggatttccccccagtgcccctaaaggcccctggtttgtctttccaaagttggaaaacgccttcaaacacatgtcatcaggtttaactggtgggattttttggttccctcagttttccccatttgccaaagatgttgaactgtcttggtggcatgccctctgcagggcgctcaccagggagcatgttgctctctaagcaccttgcaagtgctcctgaccagtacccacagtcacaggtacccagtaaatctctgagaccaggaggctggggtacctcgcaattgctcttttgctcgaggggagcagggccccttgagtccactgcagcctgaaatccctgtgcctaaatgtgaccttctctaattgaggaggagatagtacagaggggttttggcaccacctgtgctgaccaccagactgtgggatttaggctcattaaccacacaaggagtcatttcatcatccctaaactgaagaaatttcagctagattaacagtatggttccttcccaatgtaaaattctgtaagaaagtattgaactcaaaagagaaaataagcgactgttttataatcaaaatggactagatagtactgagttagtagtactagttaggactgagaatgtctggtggcatattagggcatgtgttcagagagacccttctgcaccagtttgccccttttgagcacgagtctgtcatccagtacatgtgtgccacatataacaaggaaaagccaaaacatttcttaaaaaattattactattcacgaaaagtaccttggcaacacttcccaggggaggctgtgggtgaaggggcaggaagggcaatgtttcatatataaaagatagtctattcttaagtaaaaaatgttaaattatattgagtgatgcaatcactttaacatttttccctagggctttgtgccctatttttagtaacaaaagatcagctgtttccaaccatgcccctaaatcagctttaaagaaataaaagaatcttctaaaatatcaggagggaataaaggaataggttgtccttataaggcaccaataacctcatttgaaaagtaattttatgtgttagaggagcaattcttcccttgtctgtgtgtcaatttaacaagaatgtaacagatttatctagcaacttaaacaagtgacaatatccagagtgagtgttggcaattgaggtgcatttgggaagatgtgaacatacagcgaaatcctagggtgcatttttttcttttccatggtcttggggttttttacaaaatggttgtatgctctcaatctgtggatctgacaaagtaagggcttttgaatgtctctttattgaaatgcgatctttgccctgttcttcatgaactgcccacttgggatgaagtaatatggaacctagttggtggaacagagccctaaacatggataaatgaccaggacaacgccaagctgggcaatggtagtagcaggtgtagatgtggtcaaactatgcccccagttggcaaacaagatgaactccctctggctcaaaagttaaaagcagaactaagaggccatgtcaaggtgaggaggcagtcacgctctctgtgtccttggaaggtgtttcagaatttgtttttctgcaaccaagtcaaagaacagtttttgaaaacaactacaactggaaattcctccatctgaccaccaacaagaccacctagcaccaacaagccaaccaaccacctggaaccagccaattaaccaccagagactggtgatctggggctgaaaggccatccagccaacattcttccttgctcccaacactcctcacctgccctgccctgcagttttggcctttgtcatctccttccccccgccacccttcctgggagtgtactttccaaagctgcatctccctaatctgcagattgcttttgaaaaataaagttctcctttggcctccccacatctcattggtcttccgttaacaatattaacacaaattaatgcatacatatcataaaattataaaatcaaccaaaatctctttcttgccctagaatattttaatagctagtgttttcatgtgatataaaaagtattcccttgtttggctggggctggcaccatgtttccacataaatctctgtctatatcacagccttctggctctgcagccatcctgattccatatcaccttcttatgtggaatcatgagtttataaagcaggacttggtaaaaagacactctacacattatctcgtgctttgctctaaccaataattgatcattttgcttgaccaattcaaatgatagagaaccatgatttacaaagaaactcaatcaatctttagaatattctactggttttccatttttccataaaaatctgttttttggtttgtaacctattagttctagtcccatgctcttgagtcactgaaaatagatctgcccctgattcttgttgaaatcagctaacatgttcctccctgtccatgaatctatatactcaactatttcatccatttctcatagaacacagaaatgattgaaattattaacatttcaaaattctggtgtatctgtacagctttgtctctgtcctgaagtaggaaagctgtttttatgcttgtctcctgatggaaatccatcttagtttgctgctcagatcctcacctttgccttctcccctacccaccctactgtcccccacctcccactcctaatcaacacccagtgtgatggtgcagattgcccagaggatcttccacaggatctaccgtcacctgcccctccactcctagtctctactggtcataagctccctttctggcaggggctaaggctccctcacaaatgagaagtcaaggaaatatttttgtttggctgaattctaaacactagtgcatttatttgttttggtttgctgttaatgttatatatcaaaaatcctccagtggatactcttctgatatgttgaatgtttaacttatattgaccatctttaatggcatctttgtgaggaactctgttgaaaggtgaaattacgtctgtgatttctgttccagtttagaggctggagtgtcacatggaagttattacagtgtactgatgtaatctgatcaacaagatcagtactcttcttaggttgtggtttcaaaaaaaagtctttaggcaaaacagattgtggagagggttattctgtgaagtttctaggagttattgaaattgttatgttataaaaacttttggtttggaaaagtcatgagatttggggtttttatagctgtgacaagaagtcccagaggaaattgaaatataagcaatctagataaggcaaagaattagttcctttctgagacgaacctcaaaaaaaacaagagtcattatgaggtgctccaccaggccctttttcagtccagtaaagccagaatcttccctctagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggtgagtttctgacttctagatggttctctgcagcccaaacctgatgggaagtgggtactgacaagagtcttctggtgatgcttcccagagctgggattcccaggcttaaacgaggggcccaaaaaaacctagatttttgaaatccattcattgtttttgaaaactacatctgagcccttatttgtatgtgtccaggtatattgctgtgtgtgtatatccatgtgtgtatttggataaatattcatgaatagtgttctgatttttctggtctttcctgttgaatgatgtgttactgactgtaaccctactgtgtaggcataactgaaaaatctagcaggtgttatcagtgtattagaaagttatgtccctgagcatcatttgctcctataaaatggaggtgacgttgcatggcaaaatgatatcaacacggatgatggtaaaaatggtaacacaccagctggtaaaaatggtaacacaccagagtgacaagacaataataactgctgtctcagctcttcaggaataggaagtggctcatactgaacttcatatttttttagcttaacccaggtacaggcacacatatggagctccagcgtgtgtgtatgtgtgtgtgtgtgcgtgtgtgtgtgttttcagtgaattgatatattcatctatctttaaaatgaggagcatttaagactccaattttctccttgaaaagtggagttagcctggattaacaataactatataaaagtaaatttattttgaagactaaacagcacgtgctgcatatcttcagctacagaaaacaaattcagattgtaatatgcatctaatttacactaaaggacaaataaggacagtggtttatctcaattatgctttcagaatggtttctatgtaagaataagaggaactactttagtaatgttttcagggatacttccatctaaagagagagaaccataaagaaaagtgtctatccactttttgccaacaagaattttttaaatggagctatacaatccatatttgggcaatatgctaatttacctctgacatgtcactaagatgagtccattctattggcacttatgtgttcaccttgtactttgattccattaacatccttatgcatcacagaacctactgggcctcctagagcaatgcttcagaatagcaggcatcctagcactaatttctagaaactgtagtttctgccaaaaaaaaaaaaaagtatttgataaaattaatatgcaaagtattataggatataaaaagcattaagcaagaaagaaaataaattatggagtcaataatgttgttggaggtaacattttgtcttctacattttcacataggtggaatatacctgattttccatgaactacttaacttcttagaatgtgttttactttcttagtatctttgttaaattcttattcccattgaatggaatttacatgttctttctttctctttcttacatgtgatagaattgtgtctaccctgttgtttaaaaaactcataaaattatttctcacttacatgattatgattatattttctaattcctgaatttgtattttctcttccttctcctgttcttttttgttttgttttatttttcttttaaatattttgattggaattccttagtaaatttattttcattctttcttattaataatagcatttaaagctatgcactgacctacagttacaggtttggatgtattccctacactgtaatatatggtatttttacctgagttattttcaaaaaaagactgcatttctgccctggtttccacattgacttaaaatgatctatatgtatatgtgcctgtgtgtgattgagcatgtgttttccaatctgttgtagttgcttcaacattgattgattgattggcaggatcttgctctcttgcccaggttggcgtgcaatggtgcaatcctagctcattacagctccaactcctggcctcaagcaattctcctcccaagtagctaggactacatgtgtgcgtctacatacctggctaatttttaaatgtttttatagagatagggtctcactatattgcccaggctggtcttgaactccttggcttcaagtgaccctcttaccttggcctcccaaaatgctgagattacaggtataagccactccactcagcctgcttcaaattttaaaactgaatttctagttttattttattgtcataaagggataaaattcacatagtttcccttttaggaagattttttaaagttctttatggtctttggtttgtgattccatgcttctagtgggggaatccagtaactattttctagaaacaaattcatagtttaaagaataaatttggggctcggtgtggtggctcatgactgtaatcccaacactttgggaggccgaggcaggcagatcatttgaggtcaggagttcaagacaagcttgaccaacacggtgaaaccccatctctgccaaaaagacaaaaaattagctgggcatagtggcacgtgcctgtaattccagctactcgggaggctgaggtaggagaatcacttgaacccaggaggcagagattgcagtgagccgagatcatgccactgcactccagcctgggcaacagagcgagactgtcaaaaaaaaaaaaaaaaagaaagaaagaaagaaaataataagtgtgatggcaagtactatcgtagcttatgctgaagcaggatggcatccatgtcaggtgctgtggttcagaaatagaggagaagaattctggagtggaagggacaggggcggacgtcatagggagggaggtgagtgaccagtttgcttagccacattgagaactcagattcagagaaaaaggtgatgaatatctggctcagtaaagatttagccgttgtctagttagcaaatcatgctgctgggtagtcgaatgcctaaggctgatgctggaagttttgggaagtaaaattacggtaggtctcttctatggactgaactgtgtaccccgcaaaattcatatgttgaagccctaacccccagtgtgactgtatttggtgatagggcctttaaggagatagttaagattaaatgaggtcataaggatgaggccctgacccaatataactgattccctgataagaagcggaagaaacactgggtgtgttagtctgttctcacactgctatgaagaaacactaggtaatttataccaaaaagaggtttaattgacacataattccacatgactggggaggcctcaggaaacttacaatcatggtggaaggcacctcttcacaggacagcaggagagagaataagtaccaagtgaagggggaagccccttataaaaccatcagatctcgtgagaactaactcactatcatgagaacaggatggggaaaaccacccccatgattcagttatctccacctggtccctcccatgacacatggggattatgggaactataattcaagatgagatttgggtggggatgcagccaaaccatatcactagggatgagaaaatgacgtgtgaggacacaagaagaaggtggccacctaggagccaagaaaagaggcctcaggagaaaccaagcctggccacaccttaattttggactttcagcctccagaactgtgagaaaatacacttctgttgtttaagccactcagtctgtggtatttgcttgtggcagccctagcgaactgatacagtatccaagtagtttcattaggactgaactatgtttttttaaaggactggctttttagagttgaaggaaaaaaccagaatcagcaaatataaataatgattttgttccccaaaaataactttttaaattgttatgtgaatattatggaacgtctattttgctcttatcttaataagtgccaccaacagtgattaaaatatgccacacatgtgcagtcatttttttcttccagagcccatgggaaaggtgctaactgaccccaacagcctttctgaataagctgaggctgaacctctaagtccttctcaacgcagtgttctaggtggctgctagcaactgatcagaattgtcatgcaagatggaacctgttgttgccccagaagcagagccttgaaatttataaaagatacaacccaggatatcagttccatgaatagccctcacaaagtatattcatgtgtaagaagtgataaatttaaatgattcttccagatttgcattggctgttagatctctttctagagctattttcccaaagaagcaaggtttattacttcttgagggttagtttaacgctggtgagaaataatcaaacgacaacaaagccacagtgagttgcagatgctgggcattcctcttcaggctgagttaactggtttgctcctgcacagctgccttctaacttacaatgcaacaaaatgagaaattatgctttaaagcataggctttggaaaccaacaatcctaggttagagtcctggatgcaccgcttgttagctgtgtgatgtgtgcatgtccctgaatctctgagcttcaaatccctcatctgaaaaatggcaaatagtgcctcaagtatggggttgttactaggatcagtgagcactagatgaaagacttggcacagttatccaatatatgatagtaatattatatttttatggtctaacaatagcacatgatgtaataacagtagtggagaggtggtctctggtctggttaagagcatgaacactgggtccagtctggctgaattgaaattcctgctctgctgttcgctatgtgacccctctgtggctcaattgcctttctataaaatacaacactaattgagccttcttatgacatgttgtagacatcaaatgaggcactctcatcatgcagagtggttcctggcctgtcgtgagcatcaaggaactgccgttgcattccttggaccctcatgatcagacgtgaagagttaaaatgaccagtgacagtgcatgaatgcccagagtctactgcacagagaatctgggtttacagaccagaaagataaatgtgtctaaagagctagaggtgttctctaattccttgaaaatctcagggacacaacccatttggttacccattcatcacctgtcattcaggtaaggcacatctgttctccaggtagcacatgctcagccacctggtgcttgtgagaactccaggccacctatggttgttccccaagccaccagtttcacttaactgctgcctggacagcacagagctcagaattggggactcctgccaagcagccccaggccctgcataccagaagacttggaaagcccaggctcaaaaacactttacggtgactcgtaggtttatgtaatattcacccaaactgacatttattgttcatttggggaactccattaataactaaaaatagcaattaacattttattcaattaagagccaaaaaggttacttagaaaaagctaagttgttttctaaaacattgagctccatttgattggggtgaataccttttagttgcgttttttgtaactcttattttattctcagtatgtgattatcttaggacacaattaacattaattaaataaaattaaactcagctttagatgtagcagtctcttttaggaatcttgaatagggaattaaaatgtctctgacttttaaaaatcccattgttttactcccccgttagagcagatgacattgtgtacattctgagcacatcttccctaataagcaggggctttatagagtgtaaagaaatttgcatagttcaggatacttaaatgacatgtcccagaatctgtgctcttgacagttaatcatagaatatgtcccctctcaaagacgccttcttcatttaaatcctattctttatcatcatataaaggatgatctggatatggaaaagacattgaagtccaataaaaatagtgttttggcaactaatatagtcctagaaatgcatttctaagttagaaatataatataagctattttccttctttaggggatgtattagtttcctgtggctggtgtaacaaattaccacaaaacttaatagcttaaaacacagacacatttattatcttatagttctagaggtcagaagtctacaatagatcacactgagctaaaatacaagtgtcaccagggctgtattccctctggagtctccagcttctagaggctgcccacattccccggcttgtggcccccttccatcttcagagccagcagtggccagtcaagtctttctcatactgtatcactctgacacttactcatctgcctcctcccacatttaaggatgctgtgattaccttgggcccatccaggtaatcttggataatctccctattttaatgtgagctgataagaaatctcagtgccacttacagccttaattccctcttgcatgaaagacaacatattcacaggttatgggatgagggtatggacatcttttgggagctaactattatttttcctgtcacaggggaaaaaataagtacagttggcctttgaacaacgtgaatttgaatgttatgggtccgcttatgtaagaatttttgtcaatatattggaaatttttttgagatttgtggcaatctgaaaaaaatttgcagatgaaccttatagcctggaaatattttttaaaattaagaaaaattaggtatgtcatgaatgcatgaaatatatataggtactaatctattgtatcatttactatatatatacaaatctattataaagaaataaaatttatcaacatatgcatggaagcacttacagaccatacatagcaccattcatagtcaagagaaatgtaaacaaacatgaagatgcagtgttaaatcataactccattaaattaactgtagtacagattatactactgtaataatttcatagctgcttcctgttgctattcggcaagctcaagtgttttcagtatctgcttaaaataccatgtgatactgtcgtctccatgtgagcagttcctctctctggtaaattgcatatcacggtgaaaagtggtctcttatggttcttgtgtatttttccttgtgtttaatgcaatgctgcaaacctcgaataacaccatgggacctatacaaagagcaactaatgatgatggacacgctgccaagaagcagagaaaagtcatgaccctacaagaaaaagttgaattgattgatatgtactgtagattaaggtctgtacctgtagttgcaggccatttcagacattcaattcatcttgtaaacagatgatgtaaacttatggtatcgataaaataccgtacagtactgtaaaagtattttctcttccttattattttcttaataccattttctttttttcagcttactttagtgtaagactatagtatagaatacatataacatacaaaatatgttaatcaactatttatgatatagggtaaggcttccagtcaacagtaggctattagttgttaagtttttggggagtcaaaacttaacatgcatggaggatcgaagcccctaatccctgtgttattcaaggtcaaaggcctttaacctgtgtcttgtctgttagacattcttagtcaaatagtccaacaccgagtgaagaatttggatccctgctctgccagtcactacctattggagcaagacacgtcttctttattgataaatttttatttatttccaataagccttttgcattcctacttcatcttctcatgtttactcaatcttctcattcctgcagtgaggatgacatatagctctcacctcatctaaatgggataagtttaagctttactgtgatttgtttccaacaattatgttatttattctaggaagaagaaatgaaaatgcctgcaaaggagctcctaaaacctgtaccttactagaaaagttccccgagacaacaggatgcagaagaggacaggtaccaagagtgtcgtgctggggagaatacaattaattgttaggaataagggcgtgttgacctttacaaagaaatggttgtttcctttggcccaatgaatgcctctttttacatgccctttttactgaaacataattttatgtggttgacgtcagaattgagggtggaaaatgttcagtgtttatagctttgtggaaaatgtgagtgcttatttttagttccttcacaaagaaataagacttgaatataaatattaaatcttacaaaggctctaatccaaactgacagtaattttgtactgtcaccttaacttagcagttcctccacaccttgataaatggctgaatggagtgtcatgttttctatgcagatcaaatattccatcatgcaccccgggactcacgtgtggccgcacacagggcccacaaactgcaggctccgaatgcacctgggcttggtgattcccaaggaaggctgcaagattcgatgtgccaacgagaccaagtatgggtcctctgttatccgtcatatccgtcacctcagaggatgagagtttgttacaacacagttgtgttcctttggattacttatcttcttttgtagctgaagtagactggagcaaagtgatattaatccaaactcttaagtctatatcccttcttggtgctttctattagcctggagacattgcccagctctagggctgccctcctccattatttctcggcagagtacttatctagttgaggagctgccttgtttctctctctgggtagacagatgtgcattcagagtcagccaacatgcattgagccctgcagatgttatgcattgtgcttcctgctttgcaacttgacttattcatgactacaagaagtacccctaactgaagaactcaccccatgatatttatacgttttgatatagaggagatggtatggtgcaatggaagctggctgcctttttcaaatcccagctctaacacctaacctgtgtaaccttggctagttacttaatcccttcaaacatcagccttcttgcttataaaattggcagtgataacatctactttgcagggttgttgtatggattaactggaataatgcctataaggtgctcagtccatgttctggtatcagtcgggacgtgatgaatgttagatctcctctccctcccttgcgtgttactttcctaatcctgacatgtttattcatgatcttttgaacaaaccatacttgctctggcttctgtacctatgatgctgataatctctgtccctagaatgcccgtcttttcacctgtccaaaataaacctattactaagatccaatttagttttataaaaatagaacctctcagagtatatatcctcagtaatcccattcctatcttctattactctttattcattaatatatattacccttatctccatagcaagctgtatgtaagctcctggagatcagaaagcaagttattgttgtcttacacatttcttattgttcttagtagaggtctgagtggaggatgagtgttcaggggtctgcagaattgtctatttgattattggcagataactgccctgggcagcccatggtgctgtgggaaattcagagatgactcagaaggggccgtcctcttctgaggacacctagcaaggtgtgtctgctcaggaagataacacaagattgaaggccaccgtggtcatagaagaggtactacagatggcctctctacagataagctaaaaatactacagatggctccatgagcaggagcctcacctgctcacagacactcaacttgcagagtggtggtttttaaagacaagaaggattcggacattgaaagctaaagaggggtattctggaacagtatccattaaaggcacagaggccaaaaattatggccacatatgaagaatattgaataataattcagcagccagcagtgtatggtacataaagaataaggttgcaaagtgaaagagtcttttagaaactaaatcataggaggctttgaatcccaaactaatgggatcagacctttgttaggaagttactgtggaacccatgggtgaatcctatggggacagtgggaagaacaattagcaggctgtcacagcagcccacccaaaagataaacagagctggaattgggatgctggaaagaaatggagactagagagcagatgcaagaggtgactcttgaatgtgtgatacaggaatggggcatccaagatgctgctgcaattgcagtctttggacagtggagggtggcgatgcttgagcaaaccttgggaatttgggaggcatgaggcaagttcaaggaaaggaagatgaatttagtgcttatgtattttatttagttgctattggaacacacttgtagaaccatccaggaggtggctggaaatagagacctggcactcaggggagaaggtaagtctagagataaagatttgagagtcagacttatcaggaacttctagaggaagcttgagacaatcgaaggatgacagaaatgaaaaggttccatgaaaacatctgtatttagaagacggaaggaggaaggagaaccaagaaggaaatggggcaagaaaggcaaaatcgggtagaccaggaggaggaatcagggatcactggacaggcagaagtttcttcaggcatggaatgaatcttgtcttacactgggaactcggtttgggtcttcagggtctctctgccaaagtgaaaaggagcagggacacattggaggatgcaaggaattcagagaggaggttggagaatgctggagcaggcagagattgacaaggtaactccttggagatcacatgagagcatgaggcagtggagatggagaagagcacccagcctcatgcctcagtgcttcttaggcttttacagcctatttgttctttcaccagctcacttgctctctccctcacctcctacctcctattttttctctctccctccctccctcccttctttccttcctcctccctcccttctttcctttctgcctgcctgcctccctctctccctccctccttccctccctgtccacccgcctcctgcctccctgccttcctgccttcctccttctcttctatattctgcttgtagatacttggaacaaaatcactagagaaaaatccacttaggaccaggcaaggtggttcatgcctataatcccagaactttgggtgcccaaggcaggaggattgcttgaggccaggagttcaagaccagcctgagcaacacagtaagaccctgtctccacaaaaacaagtttttttgtttttgttttgttttgtttttgagacagagtctcgctctgtcgcccaggctggagtacaatggggcgatctcggctcactgcaagctctgcctcccaggttcacactattttcctgcctcagcctcccaagtagctgggactacaggcacccgccaccacacctggctaattttctgtatttttagtagagacggggtttcaccgtgttagccaggatggtctcgatctcctgaccttgtgatctgcctgggcctcccaaaattctgggattacaggcatgagccaccacgctcagccacagaaacaacttttaaaaaattgcccaggagttcaaggctgcagtgagctgtgattacaccactgcactccagcctgggtgacagcaagaccctgtctaaaattaaaaaaaaaaaaaatctacttaggcataggcagggagaggaagagagatggaactgagcctagtcttcagtagcctgatgcagaaagagaaagccaagattggaagaatgggtgtggcagccaagaatgggagcaggtggatggtgccaggaggcttagcacaaagtcacagagggcttaagatgcatgttgggcatggtggcatgggcctccagtggctgaggcaggaggatcaccagagcccagaagtttgaggctgcagtgagccatgactgcgccactgcactccaacaaacatagtgagaccccatctctttaaaaaaacaaaaaaacaaatgcaggagtgatgctgggagacctgcctcaggagcacatttgtaggtgcattccccaccccaggctcccagcaaacaccttgtgtccatgcttgataaagaaaacaaccaccaacccctcccctaaagcttaaaacataattaggttaaccatcttcacctagcagaggcagaggagggttagaaggaccactccagcctactcagaggggggtcttgaatgagaatattaacttggcagcccctcagtttctgctgaggtaaaacacaacctactttgtgtgacaggatggagctgctgataataataatttgcagacgatgtattttgcaaatccacagtgattatttaaaagtgcttgcaactcacctgcctattgttgggccagggagactgcaatgcttctgtcctctcctccctgaagagttgctgagcacaggggtccttctgcctcaccatgactgctggtcagcagcccttctccacgttctttttattttaccagctttatgttgtgttacattctcatccttaatatttcttaattcaagggtggttgagttgggcttagcacttcattacaaaatagtgcttttcataagagaaatgggtcaattaaagtgctgtgcaatgcttccagtgaaaagagctagaaatctgatagtagacagtttataaactctgaggacagaaagagtctagtatgaaatctggaagttctgtgctatgattgtagaagtacttttggcatggaaagaaaaacacacatgccaagaaatcagtttccttgtgctagccaaaggcagcaatttttcagactgtctcaacttctaaaagaggaggttatctgtagcaatttgtacattgttcttttcaggtattaataatcggattaagatttccaccagtgtgtatactgtttaaatattccatccctgcaaagcgtagcatagctctctgaggatgaactggcaggtatgcagcccttaccactgtaaatgaaattattatttcaaattaataaatgccttctgattagaaaactgatacacgtccctcacacataatttgtataacacagagaagctcaataaaaatgtattgttttatcccaatacccagagctattgccaggtgcttctcaatgtctatatatgtgtattgatgataatgatgatagtaataatatacattgttccaaaattatatctgtgtcaaacacagctctaagcactctacatacgttaactgattcatgcttatggcaatcctgtataattaggattattaaaattcctgttttacagtggaggagactgaagtataaagataagtaacttgcctgaggctgacatttatatatgtttcctaaggctgccacaacaaattatcacaaactgaatgacttacaacaacagaaatgtattatttcgtggttctggaggccaaagtataaaattagggtgttggcagggttgttccttctggaggctctaagggagaatctgttcccctgtcctagcttctggctgctggcagcccttggtgttctttggtttatagacacgtcacttcagtccctgcctctgtgttcacattgctttctccctgagtcttctcctcttttcttttctaagaacatttatcattggatttagggcctaccctaatccaggttgatctcatctcaaaatccttaacttaattcaatctgcaaagatcttttttccaaatcaggtgatagtctcaggttccagatggatctatcgtttttagcagggaagggggacagggcggcttatggggacattcagcccactacaatattagtagtgggttcagtcccaggcattctggcttgaaagtttgtgttctagacatgatcacatagccttgcttgggctttttggattttgttgtagtttataaaattaggatcatgctgtacttataaggtgatcacttcaaatgctgggttttgtttccagacaagtagagaaagcagctgggagtttccctttctgggccttctgttcatgtcacctcagggggaccatgctttgtggtctgtaaaataagctcgttagagccgggtgtggtggctcacacctgtaatcccagtactttgggaagccgaggcaggcggatcacttgaggtcaggagttcaagaccagcctgaccaacatggtgaaacccagtctctactaaaaatacaaaaattagccgggcatggtggctaatgcctgtaatcccagctacttgggaggctgaagcaggagaatcacttgaataatggaggtggaggttgcagtgagctgagatcacaccattgaactccagcctgggtgacaagagtgaaacttcatctcaaaaagaaagataagctcattagcaattttgatccggagctgagtaaacctgagtcaggggataaacatgtccccagcaagtgggaattaattattatactcaggaggtggctgagtttgtgagctttgaatgatcccagagagaaattcattcttctgaatctccaagggcattccacaatgtgctggaactgtgctaagagaaggaaccgtgaccttggagctctcctgcagattcagcattattgcctgccaattactagcctgaaatgttgaacaagactgataggttgtcaggaaagcacacatctacattagcgtcacttagcgacagactgaaaaaatgaattggcaatcaatcatttaatcctatagaattctatattgctgtagaaataatggccttcctccatagacctcaagtattttataacatatattttcattcatttctcaaggttccaattaggaagattgtgtgaaagtcatgctaaaatattaacagtaagagagacttaatttttttaattcatcatgaattcctcatagacaataattgtttagttttcataaagtgtccaaggagataattttaagactgtcttaaaatttttgaatcacatgtggaagctgcaatttaccaaatcatttagagccaaatattttcatccctcctttctcctttttttactattctccctgaaatcataaaccttctgttccacaagatattctcccatcttcatctgcattgcagtgtgaccttatccacaggtcatcactgaagcctgcccatctaggacaaaaaggacagtttttaaccagataggatgttttcctgaaggtttgttgttgaatagtaacattttttcctcttctttcatttgagcaacttggtgagttaaacacatccataccatgtcttgacccctgctctgtgacccaatggtgtgtctgtggctgttcctacacatgagtacatagaaagtgcacacatacatttctctacctccacagggaatggcatttcccatatggaaaatggattatgttccaaacatttgtttgttgaaccgattggtgaaaaggtgggatccatttttctctggcaatagtaaatgatgtgtggtggtttctaggtcagctcccagaagctttttaactaataatctttattaatagggctctagaaccagtgactatttatagtaatgtttctgcaggaaaaaatgcatcctgagcttttatttcagattttagtgttatgtatcttcataaaaacatattcagaacattgaagtctcatgacttgggttcaaatcctggctttccctcttgtaaagagtaactctatacaacttacataacctcattaagcctcaatatccccatctgtatattaggaagagtaaaagtatgtctttgtatggttttgagtattaaagtaatccatatgaatgcactcagaactgtatttataaagtgttgtgtggtaaatgcactcagtatatttgagcttttattatcctcctgtctgattgctgcagaaatggagacttctgtccttacgttccagggagtgagatcaagcactctcataacactggaggtggtgcttacagcctggagtgagtactttgacagcgatgggggaagggactttaaggagttaggaaggaggagtgaaataggagctggtcatgtgggccagggcaggtgaaggaatggtacagataggggcgtgatttgataggcctggagctgggagggaccctggagaagggaggtgtgacaagaatgcagcagagaccctccccccctactcacatctctcctttttctctctgtgcccctaccctggaactggagaggtaggggaaaggaggaaggcatcccatctctacagccctattgtcagaggcatttgaaccagagcagctccatcttgaataggggctgggtaaaatgaggctgagacctactgggctgcattcccagatggttaaggcattctaagtcacaggatgagataggaggtcagccaaagatacaggtcatacagaccttgctgataaaacaggttgcagtaaagaagccggctaaaacccaccaaaaccaagatgaccatgagagtgacctctggtcgtcctcactgctacactcccaccagcgccttgacagtttacagatgccatggcaatgtcaggagattaccctatgtgatctaaaaatgggagacatgaataatccattccttgtttagcagataatcaagaaataaccatagaaatgggcaaccagcagcctatggagtagccattggagtatccattcttttattcctttacattcttaataaacttgctttcactttactccatggactcgccctgaattctttcttgtttgagatccaagaaccctcttttgggctctggatcagggctcctttccagtaacactatgactttttctttcccttttccccttctttttcctcctccttcagtgccttcatctgagttacaaaccccttaaatactggtgacctggaactaagaggaggaaggcagaagttgtttgtgtgtgttagaaggggagagagagaagaagaagtgtgacaatgcagttttacgttttgcttacagtgtgtgccatcccagggctttcaatggagtctgaactggggaatttcagtagatcagaatgagtaagagctgtgtcaaatattcttattgacacagtaagagctgtgtcaaatatccttattcctgagctctctgacccttttctgttttcaactcagcctgtttcatgccttgcaggccacctcagcatgtcatctacagacactaagaatgtctcttgaccatggtcttaagtcaatgtgttgggctgtaatgactttctgcttctgccacagaatcacagtgtcactgcagacatctgaacctgtttccatgtgattcctttgcgtgaaaatcacagtcatgtcctttgcctatctcagaacattttagcaaagatagctaagatattatctataaaatttgtaggtagaagactctataagcacctagtatcattacttagccttattaatatcaatggtaattctgtgaccaaattatagttattaaatatgcactgccaccattttatcattatcattatttataattataataatttgagaagttgacagattatggaatactgttttatcttaggacgagatattcttatatcttttgacaacccagagagagactttcttctcttagtggtaagaaattctaacagaaggccaggaacagtggctcacacctgtaatcccaactctttgagaggccaaagcaggagaattgtttgagcccaggagttggagagcagcctgggcaacatggggaaaccccatctctacaaaaaaatccaaaaattagctggatgtggtggcacatacctgtagtcctaggtactcgggagactgaggtgggaggatcacctgagcctgggaggcggaggctgcattgagctgtgatggtgccaccacactccagcctgggtgacagagcaaatcctgtcttgaaaaaaataaagggttaggtgggaggagagaaagagagagaggaagggaaggaggaagttccaacagtgagccaagcttccagggatggagagcagtgcccacccccaatgctgcttctctgggtccttagacaaggctgtaacagtacttccaggcagacctctgtcacaggccgctctgaagattgtttctccaaagggctgattgtatgtcgtaattcgagtgtaacttaatcttatttgatggagctttgttcacaaagcaagtggcctgaaaactagttctttgcattctaatgagagtctttggttttcagtcagaagcgatttgacatctttatgctcctctccctttgttgtggaaaaaaaacatcctttcccaagcatgtgatacatctcgaatttaacctggagtcacttaagtctggacatggcttgtaggatgttttattgttcttcattttccccttttaggtgaatcgtgactacagttttagtcattctatctctaataactgattgaaagacaccatttttttaagaattcagaagaaatctacattaaaaaatctacattatgttattgactatctttgctattttctggggaaatgtatgaaagaaagtggaagggcaaataagtccgacagcactcactttccccatagagttttatgaccctgaaacaggccaattaacaaccctttggtatacctccccaaatttcttatttatacaattggttaattaatggtttacactgatctgtattgtacttaatgtatctggaaagctgcaagcctgtggttcttaagttctacttttatatgcactgatgttccatgagtgaccagcgtgttccggtgctaataacttttcccagttctcaggaatttaatttaatgaatggaatgcttaaggcctttttcccagaaaacaattctagatctttggctttgttatacgtatcataatctagtgaaaaatgtcattttgtgtgggctagaattttctattcagttattttaattacttctagtgttttaagtagtttccaggttctctgccacccaaaaaactttgaaaatcacttgtcattgctgtacaaactacatttcacagatgctctgaagatgtttttatatctcatctcccttggaagtttttagttgtctcaaaggaaggcagacaacatcataaagagtgatgcatatgtcatttttgataacataccacttcccaacatttcacctctgtcttttatcttttccctatttttctttatattttcatttttctgtcattaattgaatatctactattgccaatcatatgctaatcctcacatcaattatgccgatgaagacacaaagaatcaattatgctaagtagctcaccttaggtcccataagtaataaatgccaaggtcaagaggattcccctcaaagaccataaatttccatcttcctgtattgcttctttctttctcctctaccacatgctctcctttgcctttcccttttttctctatttaattgtagtaaaatacacataacaaaatttaccatattatccatttttaggtgtgcagtttagtgacattaagtacatccatattgtataaccatcaacatgatctatcctcaaaactctttctaacttgcaaaactgaaactatacccattaaataactcccattcccgtcctcccaccggccactggcaaccactcttctcctttctctctctgtgaatttaactactagtctaggacctcagatgtgtagaatcaactagtaattatctttttgtgtctggcttattttacttgacataatgtcctctgagttcatacatgttgtagcatgtgtcaaaatttccttcctttttaaggctgaattaatattccattgtatgtgtataccacattttgtttgtctgttcattcactgatagatacgtgggtggctctcaccttctagctgttgtgaatagtgctgctgtgaacataggtgcactgcctttcattttgagtacacttcctccctcatcttctacataaattataggctcgtttgtggtacccactgacattgcttaatcccggtgacaacactgagacctagaaaatgcctgcctaactgtggaagctgtggactgtttcactgatttttcttgtcagcgtatttccccgccttggttttgcctttcttctcaagttagattttgcatggtaatgaatgcatattctgtcattttctcctaagtccatagatttctgtcttttgctacccttgatggaactccaatggaactctaaaaaccttcagaggagttgtagaagagccaatcaacatgtgtgtgttgaatgcaagagatgaggcaaggtgtattagtccgttttcatgcagctgataaagacatacctgagactgagaagaaaaagaagtttaattgcacttacagttccacatggctggggaggactcagaatcatggtgggaggcaaaaggcacttctttttttttttttttttttttgagatggagtcttgctctgtcactcagtctggagcacagtggcatgatctcagctcactgcaacctctgcctcccaggttcaagcaatttcctgcctcagcctcctgagtagctgggattacaggcatgcgctaccacgcctggctaatttttgtatttttagtggagatgggggtttcaccatgttggccaggctggcctcgaacccctgaccttgtgatccactgtcctcagcctcccaaagtgctgagattacaggcgtgagccaccgcatccagctgaaaggcacttcttacctggtggcggcaagagaaaataaggaagatgcaaaagcgggaacccctgatgaaaccatcagatctcatgatacttattcactatgatgaggacagtatgggggaagctgcccccatgattcaaattatctctcatcgggtccttcccacagcatgtgggaattatgggagtacaattcaagatgagatttgggtggggacacatccaaaccatatcacgaagtgtatgagatagcacactgggtggaggtgggagggtgggtagtagaagtagaggttcagttcccaacttcagtgaactttcaacttgcaaatactcagtactttatctgttagtttacataacttggaaattttattatcagacttattcagtatgtcagttattttccactggaatgatttttgctcctgctcccaccctggacatttggcaatgactagagatgtttctggttgtcacaactatggcaaaaactacaattacttttgcaccaacctcatggtatagggaatgctactgccatacagtgggtggaggtcaggggtgccgctaaatatctcatagtgcatggaacagcccctacaacagagaatgatccagcctagatgtcagtagtaccacggttgtgaagccctgcaatatatgtagtattgctcagtttatattagttaatcacctgatatggaacataaaaattcaccactagttttcgcacagaaaacctctttatgataatatagtaacttgaaatcaagctagcatttcccatgctataatagtcattatttgctaatccaggatgtaaaattttgaaggcttaagtggcattttagtatctaaggaaaattttctagcaaaaattttattttaaaaacataacttggtatttaatatattggcagttaatatctatttttaaaataaggaaccatcagtgtccctcataaactctctttggatttgaaaagcattgtgttactgcctcctgtatgtttctctcttaatagactaacactatatttagatcgcagtccctatacagatatcttatgaggtaaagttggaagctctatagggtgttttgcagcattgatttaaaatatcccatggataacccacttgcatagaagatgatactaaaaatataaacaaaatttattcccaatctgcccattttcttcagctggaatactagctaggaaactcctaatttagttttctgctttatggtactgtgtttaagcagattcctttcttccataaaatgaaacttgaacaagtggagtgagctgaaaagacaattgattggaagtgtcttgagaggcatagagatgcctgagacccagtcactgcccatatgtctaaaccagaataattgcaagacatgtaataatatacagaataattgcaaggcatgtaatgagaccaatatgtcttcatcacaaatcctctgttgtttgtacatctccagcactgagcaatgaaaactgatgttcatagcaagatttctgaaattctttcctaatcatcaagggaagaataaacttgggcttgatgttctagttatttggttatgtcccaaaggttgttaccaaaggtagttctcgcacatggacaggaatcgatcctcagacatctgaaccacacaaaactatattcaggaatccttgtctttctgctgcaggacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaa

SEQ ID NO: 37460 - DNA, 50960 bp, Homo sapiens
gatccgggagttgaagagggctgcaaggtgggaagtgaagtcagtgcctcagttgctggtaaggtgtagctgttctgtcccagtccccgtagctctgcaccgagcagaagaggtctagggtcacgcaggggccatggctgaggcacttgggcttggttctggcaggcggagcggacggggctgagagcggggccctacgggcgtaagcgaggttaccctacgcgagtggcgtaaagcgggtttgtaaatgccgcctgccggcttgggcccgaacgcctccaggaagtctcctctaggtgggggcgggaggggaagggcgaggttggcccctggtgccccgggagaggggacagggcggatgtgcctggggtggggtcctttgaaggtgtggcttcggaccgagaggtgaggctgctgttttccccctgctttgtaagtaagagaaaagggaggaggaaggaaagggtgcttgggagtcggctcttgggggtgactcgggttatgccctttgagggaagaggagcactggaagaaggaagagacaaatgttggggtctacggattcagttccagtttaatgatgtggccctctaaggagataattttgccttaaacagaaagacttgaccctcttaggtgtcatacctaaggtatgtttttactcctttactgctttcagagcgctttcattttgggatgctgatgaggaaaccgagggattatatgacgtgcccaaggtcacacacgtagggacagactttctgaatctagttcggttcgagtccagctttagagtagggacgttggttgtgctttttgaaaagggtggaggaagttacaaagtaaatgtattttatatagtatatctaagaagccattgtgagataaaaagttgtttcttgaaccggagtgaaattcctcaataaaggaaagatccttttggaaaaaataaaaatggccagtttcaacttttacagatttttcccctttttttaggggtgtattaaatgatagactctactctcacagttcatttttacgggtaggtaataggatgggagaacaacagttaaacaatatatcccatccttagaagaatattcttttctttttctaccttaggactgtttttactctcattttgtaaaactgataatagtgggattggaattctttcacaaaactacacttttttcaaataatgtagcgttaggagagtttagtgtgcccattactagaaaagaaggtattttgcatttcttggaggtaacatcgtcttttttgagactttacttttcccccattttcttgactctgggctgtatttgtgtgtgtgtctgcaaataataaaattgggctcttgcatatttttatttttcttagcatcaactgtgactttcaattcattcttactttacattgaagaatgaaaaaacagtacacgtatagttcatatcttgcagaaagtagtgcctttatgcaagtcttatcctctataatgattatgaccagttatagctcatgactattattattggataagtttttaatagaattgttagagtatgttcattgatggcagaatttatttgtgataactttatatccatacaggttagcatgtaataaatcatggcttactcttaacatgtaataaatcatagcttactgttttatatataagttgatcatcagactatgctgaattttgaatgtactctgcagttactatattatcaacaatgtgcttcactttttaatggaaaaacattttttcggaacagaggtattatcttccctgatggttgaaattaagatggtctggaaattaatacgatttttaaaatagaaaaagtatgatactatagaatgaagtaaaatcaggaataatgtaccataagtaatgtagtacacagacaaggaagacccagttaaacaaatggaaaattatgtggtgataactgactttgtgctggattaagaaaggtgcagtgatgtaagtagaccgtaaactgaacatgagtcagtgatggtaaagcaagaatattaatctgttttctagatgacaatgtaggtatttgccttttgttgaaggaggtatgaaataagttctaacctttggcatgtaactctgtcattatggaaagagcttttgaactatgaggaaattttggaaattagttaatgtaatgcatttgttcagtgtgttttagattttgttcttggttcatttctgccactactctttatctctgaggccaattatagttttgatatttcttctattcggatggtggattaatgtttgtattgttgttatcatctttcagtcacatgctgcggtactgttgtcactttagatctctgcacgttggataattaggagttcacagagttatgtgtacacgtggtttgcagctcaccagtgtctgcatttcttctcattttgaactttgcaggagccttatgtcagcttttggacattatttcttagaggacttgggatgtcttccgtatattatacatctgtctgtttctcttaaggatgtaaggtctgtaagaataggggctgtttattattgtagtctgagtaggtaagataatatttacaaagagaatgaagaggctcaagttggttaagtgacttgtaactggtgggagtaagacaaaatcgagatcttctgactacagatctttaatattttggagtaaagacttagttcccttagattatttacatgagaagaagacttaacgtgacttaaatattcaaatactattaccttcttactctgtttaacactaaaaatttatctcttctcctatccagctctccgtccttatctccagcctttctcatttaccatgcctttcagttactacatacataagctgcttcctgacttggtggcctttacatattccgtctcactccttggactgttcccctcacgcctacctaaatgtggccacctggtagtcagttttcacgtctcaatttaaatatcgttcgtcaggggagccttgcccgccttcccaaaatcagaataggtttccgccatgtattcaccatactctgtactcctttgtggcatcatcataatagaaacttaattatttctgtatttatttgacaaatactgtctcctcactggactataagctccctgagcagggccctctcatttgtcatgttttaccccactacttacgcagtacctggcacattgtaagggttcagtaaatatttgctgaatgaatgaaggagtgtattcatgcacagtgcttccagcacttctctggggacagaaatagagaaatgaataaagcggatatgctttctggattgaagtatataagaactttcaaatgagccataatgcttaggcaatttaggttatatgtaaaggagtcattgacagaattttaatataaattgtggaaaaatgtttgttctttttggaggtctctgaaatcaggattaattttctaagtggaaatgataaaggaatcactttcatttgccgcagaattgctgtgtaacacagcattttagagacttatcactgtcctgctttttgcaagcgatattcattataacaaaatatagacatggaagaaacttctaatggactcttcttccctaatgttgtctcgttttgccctaaaaacctttatttcctctaggtagtagtattaatactgttttatagctgaagacatcaagaaaataagtaaatttacttattaaactaaaaaaagtttaattaaattgctagagtttccagaacgttggtactggaaccatggttagaatctggatctatctccgtattctagaatccataattttttctttttctttgcttttttgttttgtttcttgctttttaaccttgctatcttcctatgaattatacctttaatatcacttgatttagacaaggtggctttgtaaaattgagtagtttttgtttcaaaggaacttatattttgggtttcctgaaaatttttctaatacttttctaatcttatttgctttatagctggagacttaagcataaaaagattatttttaaaacatacaaactgaattttagggataaattgtgttaggttttggtcttggaaacaagttctgcagtcatttgtagtaccacggtatggcatagagtaaggtcaacagccctgagtttctgtagccttgtatgccttcatggatttaccagtttactcttccacaagatcttgtcaaaaagagattgctgataatttggctttaaaatttggtaatactatccattttattattaaaaacaagtctttgctaaatcctaaacttactttttaaaaagtcagtgttgatgttacttgaatcttggataaaattttcatatttacctagcataaccagtatgtggaggataaaactgaaatactgctttttatatgttgttggataattaatatcattatgataggtgttactaagaattttaagccacttacatgataagtaattttttccataatataaactgtaaaagtgatttagaagttaaatgtcattgttatctatgttattgcatttgaaatattatagtaagctgcagtgttagagggttatgctttagggacacacacacacacacaatgcaaaaaatgaaagcacatttattatagcaattagaaataatttatgtgctgaaagataaacactgtggtttgatggttcatttttgtctgtatgaagatggtaatttcaattttgtcatttaagctacaaaatttaaatgtgtcttaagtgtattatattacacttatttttcaagctcacccttacatttttggttatgtataaccatttttaaaatcacccaaaagtgattttctgctgttcagtttcattcttatacagttgatagaatccaggttgcctatagggttaaaagaaaaagaaaagaattttattaacaagcttatgaactattgggtaacagcagtggaacatgttaagtggtagtcactaacatatacttaggctggtcccttgggaataagtttaccagaggttagtctaaataatgactttttgattcatttacttattgaatgcatattacttgtgaaattgccttaaaccttctttggaatgaactggaacctaatataatagctagcatttattgagtattaagtaactaagtgccaagtctcatgctaataagcattttacaggatctcttataatccttacgacaacccttcgaggtagaggcactattatctccagtttttaaatgaggaaactaaagtacagagaggttaaggaacttgcctacggttgcaggaaaaattgcttggaattaggatttgaatccaggctggctgactcaagagaccatgtttttcatcattatagtaaaaatgatgttagtgattgaactgcattggagagagaaattagcattaagagttgtagttacagagcagttatgtcttaaatgctaaggtcagtgtggcaggcagaaattacttaatattcaaactttttaaaaaacctattaggaaatacacgttgtagactaacaacttcaacacagccagtttttttctagcattggagtagatttcttttgagtaccaggtgaagtgtttgacttgttatgcagagaccatattgaaaaaagaaatatgtatattataatacaagagtcacaatcagtgtggcaagctactctttgtgagagctcactgtggctctcagtctggtgtggggagtggcagatccacgtttcttatctgtctcattctgggacttttgcatagggaatggaattatcacatactgcagtagttatttttagtgaagttatttttttgtttgttttcttcaaacaaatgttcaccatgtctgttgaacttgcatagggtaggagtatcatgtgaagcaggtacgctccctggagtgttaatgccaagtggcagtgtgacatgtcactgtatttctttactgtctctcttccctgccaagactacataccttcaagggtatgtgctgtttgacttttcatcaccatatctccaactaacactgttgctgacttagactgactatgcagaatactgtgttggatactaggaaatagagaaatggatacaacttctctttagggagtttatacttcagtagatacaaggggaaagggttgaaagaccattgtatggacatttagtctttctaatatactaagtacttccatgtgcatcagttcattttacaattttaggttagagctgatagaaaaataaatgattgtttctctaactgccatctggtccctggcactgaaatgggtctccctgtcttattcagtcattctctcttacttcaagatagactggaattcaactgagattgaagttatggaatgacaaaaccctaagatgttacacaccggctgcctcctcagacttatataaggttactacaacagaagccagttgggaatgttaaatgagtcagacctggcctctagacagcaactgcaccctatacgagtttagattgttgctaggctttttttcatttaattccaaagcatttggaatcctttttttttttttattgagaactgcacatctttctctatgtctttatccatattaaaatcggtatttatgcagtactgtcaaaatttgagagatttccaaggttctaccttatttttggtatgctcccttaaaaaataaatcacacttttgcgaagtgaaggttacaggaggaacagtagatgcagtaaaaacagatactatcctagccctaatttcttcttgtaagaaatagtatttgtatttgagatcaattgggagctaaaggtaaagttaaatgtcatcatcaagatagaaccttggcctcattagcacctaatgttaaataaggcagaggctatttattgtctggggctaatagtttctgtcaacatttgagtgccctgtggcagtgtttttggtgcaaagaaattgtgtaaagtaatgaaagtacctgttgcatgttttagaggatcttaagccattaggagtcattaagttaaattctaggtatctaagattataagtgatacaaagcaagtagctctgatccagggtggtacagattcttttaattgtacctttaagcagagaggacctaacactctgaggaattaagtttagttgaatttctaagggattttaaaggaaagctttaattaacatcgtattggagaaactaagacaaggaataatactaataaaaaggaaaatagacatgtacctcaattaaacaccaaacaactattcaactaggcattattcatgaaccattaggttgagaactttatgggcaaaagatgaacatattcaaggggacagatttgtttcctgtcttccaacaagtgttttcatttaaattttactcagatcagaatttaccaaaaatttagacataggaaaaaaaaatgaggattgtcacaactaaagagatgtatgtttttccccctgaacaagttgctttgaaatatcgtaggagccaattgttactattttgttactgtttccatttcccatcagctaattctgaggtaatgagctctttaattttgttgtcaacttttgattatcttgtacagattataaaccttttatgaattatctcaagggctttgatcacatcttgatttcagtgtgcaacccagcctgctacccagcctgcttctgggccatggtttcctttgttaagtttatctatgtacatttagaaaagtaattttaacattggtttggcaaaaagttttaaaatgcacctgatggccaaattcttttatgtaagccaaaactaagtgtatttatgcatccattttggcaaatgggagataaaaggttttgaaaatatgctatgtaggtggcctttatgacattgtgatatcagtgtttgactctcattgtgtatgttatgcaggggcaggactagggtgaggcaagagatatgcctagggtacaaactttgaagaagcactaactctctcagtcatgcaaatcagagcaaaattttgtgttctaggcatctggtttgcctcaccctagttgcaatcgattccatgtcaggttcctagaattttggctaaaatattaataacaatatgaatagaatggttattatgtgttagccactgtagtaactattttatatgcagttagtactcttaatctggggaagtgagtacttcagtatttctgtttctcactagtttagaaatagagatttacaaaactgaaatgatagcatccagctgagcaaaaattcaaactgaggtttttttccttccaaactgagcactatctcctgctgtatactgtctatctatgtgtagaaaaagttacttcttacccattttataaatttctgtattaagaaacagtactctggccaggcacagtggctcacgcctgtaatcccagcactttgggaggctgaggcgggtggatcacctgaggtcaggagtttgaaaccaaactgaccaacatggtgaaacccccatctctactaaaaatacaaaatagccaggcgtggtggcaggtgcctataatcccagtactcgagaggctgaggaaggggaatcgcttgaacctgggtggaggtacgccactgcaccccagcctgggtgacagagtgaaactctgtctcaaaaaaaaaaaaaaaaaaaaaaaacagtactctacaaaatatgtaagtgcatacacttgacatggtgcagttaacttttaagatgagctggaagtctcagcagcaccaagttgaagatccacaagcttgtgctgctaagtaccctagagttgtcagacatattaaagaagaaaccaaaggatagagaggtgaaatgacttgttcagagacaaagatagtttatgaatgacaggaccagaatttgagcccatgctttgagactttaaatgcttatgctttttccctgtatctttctgcacaaattgtccatttaatatttttaaagcatatatatatatatatatatatatatatatatatatatatatatatataaacgatacaatggtaaagtgctatatacacttaccattaacaagagattgcttctagatgtccctaagtgtaaaattctgtaagtactaaactgacagtagtgtatgttcagggaggttaggttccacttaactttattaagaaaactggaaatggaagacattgaattatagaagatgtaatttgcaagtcaaggagagagatgtaggtatatccttaagacatcaagctcattttactctaagtaggatcactgacttaccctattcctctgcctccctttttcctagctttctcctctaaatcttggtctcttgtttggaagtgactaacagcattttggcatgagaaagccctaaaaaggtacgtaaactgtgtcagcaaatgttaaccccaccccgctttgttaaatggccagactaccatctatacagtctttgtaaaaatccattttctctaagagtttgatgagtgatttttttttttttttttttttttttcttttttgagacagagtctcgctctgttgcccaggctggagtgcagtggcacgatctcgactcactgcaacttccgccttccaggtccaagcaattcccttgcctcagcctcctgagtagctgggactacagaagcccaccaccgcatctggctagtttatgtatttttagtagagatggggtttcaccatattagccaggctggtcttgaactcctgacctcaagtgatccacctgccttggcctcccaaagtgctgggattacaggcatgagccaccgtgcccagctgatgagtatgattctctgtgttatattattgagagaaagcaaggaattgtcagttaattgaaatcctgggttaaccaactcttggggaggacctccttaattagaatttgtaaataatttttaatgatttgatgcttaaagaaaaatttgtcttaaagaaattcctattagattactttggaaagtatagctgataacaataatgaagtcttattatcactgaattttggttccagtgataatgtggctgggtccaggctttgttaatagaattaatttgatttttgtgtttgtttttattttgctaggcatgctatttgaaaagtatattagcaagactgattcaatttataaattgcccatctcaactcatgaatttggtcattcagcaaacattaagtgtctgttatgtgcccgctatgctgactgtaatgtctctattgggaagaagaaacacacttataaatgggaacataaacacaggattctgctcactgctagaatgaacacacttctcttaactgaatgttcatgcacatttgttggagatccagcatacatcagtcagtcaatcaatctttccctttttagagagagaaattataggaattataagaatttagggccaagagggctgagtactggattttactagagagaaaagcaagacaaaaagacctgcctgcctacaaacgttttaagtgtagaattacttaaaaagctgtttttctaactgagaagtgcctataccagtaccaagagcttctgttgttcctctcctttcatttgatagtaaatagctttggctctagacttatctcaagtcccagatggagtaaagtaaggcagtttcaggaaatactgattctgagccctgagatatacccatgtgtggctctttaaatgagcagactcgagttggttagggagggcagaaacaccaaagatttaagagtttggcagcggagtggcgaatacctgtttttgggcttcttactctaagcaagtgataattatcttcagctcaggaagatatttaaagctgattatcttctgttaaaaattagcagtgctattttgaatattcaagaaaatgaggggtaaattataagtgagaagattgcttatactctgtgttgatatcccaatatcacaatgggtgtttttgaagaaaagtgtgtttaaaagtatgccttttgtctaggttctttcaacatttcttgttcttggtttttattttgtggatgccaacagtacacaaagcttactttgaactgaagatttccctgcaaagcagcacatttgaaacgtgagacgtaaagttcttgctatgttgttatcataccaacattacatttttattatgtatttaattattagctagatgttgtgaccaggagcaagtcactacatcctttttgtacttcggtttctgctgtaggtagtgaaatgggtgaaataactttttaaggccatttcagatgtgggatttgtagtcagtgatcttcagttttctgtatgtgcataatcagcacctactccagaaaatagtgtaccttagagggttgaaattttgttaatgtgctacccagctgccgggacttggtcacactcatcctaaaaggaaggcaccttgtcaaagggggcctcagacctcactcagctcagccaacccttgctgtttccatagcaggctctttgttgcatggggtaattgcaggttgtcccttgaactatttcaaatgaagaagcatgcggaaggaatgacaaaggcatattttaactcgaagttgaaattgacagtaattcaatattttaaaagccgtattggaattgttgatttctaatctcatgtaaatgctactgaaactgagtggccccagttgttaatgtgtgttctaaaaagttcagttttaaattggttctttggagcatttttcataagaacagtattaaaagatggcatgtatgccataggccagccacttatgtagcccatgatgttgccaaaatactgttctttttgttgacaaataagtactgtaaagttagttttagagaagagactatttattaaacatgagttttaaaaatattaaatgccagtatttacaaaaggtaaaaattaagtatttgagtaggtttatagggggtaggtaggtagagatgtcagcagtaattctgaaagtgactctggccacttaccttatccctttacctctggcagcctgtacatctgcagttatatgcgtatgtgttcaaaagagtgaaacacaagagtaattccattgtgcttacttttctcataagtatttcacctcctttataccgagattcttgaaaacttaccagctcactctcttagcccctgcagggatttctcaccccagtatataagtactccgctctttgaaggttaccgctttaacctcatcaagaaatcaaataattttttaaaagttactttccatactcagtagcacttaaaacttttggctaccttcttcttgaaacttgtttcgtgatgctggttttctccagttctcctgtagcgatatagcagcctgacttctcccttttgtgcgcaccacagttgtatgttttctgactttccttttataaaacacgtttaatggggtcagagactgtcttgtcttgttcactgctctatatttaataccgtgcctctttgtgaccattgaaatatttattaaataaataattttttttctgtcacacaatgagagctcttcaaggtctgttcttggttttgttttgccatttcttacttgatttttcattgatgataccatgccttctgctgctgtctatattctgcattcattctgtccttttcattttaactgataccactgccttttagccatcctccttttccccaggttttttttattatgaagttttcccaatttattttgaagtggaaaagcagattaccaagtgacttaagtagctaaataggaacagcagggccacaattggtatttatctacttctttttgcttattattttggtcttgtttatttctgacataggtatactgagtctgttaagttttccttgtcgttattcttcctccattctctccatcatgctgtgaccaaagccatctacttaactaagttacataatcaggtaatggtattctttttccccatagaatgaaattcaggaattcgccttttgctctttttgttctgtcaagtcatggagtaggtttcaggtgagaaacaggaaaactctttgatgtttagaactgtcagaaatgggactaaacagtttccgtaggtgttgagttccctttcactggtagcgatatggtggaatactaagcagctttccaatggaacaggttattggagctttttgaagcgtcactgcaggcctttgattgtatctttcagtcttgttaggtcttacacattctggcacagataaatttttaatgattaggaactgcacttcatacctagcagtgttaaacatactctgaacatgttgagtgaataataaattctgggtacttttcttgagtagatgaggtggggttctttatttccacttcaaatttggttttgttatgtgagagtataagatctgtattcagagtcctgggatcaagtcttgggtctctacctgtgtgatcttgggcaagttatttattatctctgagcctgctttacacttgtaaaattagaattgcagttttttaaagcaagttattataggactaaatgcatgtgcaaaatgttttatactatgaaaatgctttacaagtagtagaaattaatcaaaaaatggctttttgtttaatatatgtatgtcactactgttattcacttcatgattaggatcatttttttaaaccatagtaaaggaaatatatagttgtattctctttaaaaactaacatatttccttaacacctcaaggcaaaatttcttttattgttgaattcttgattttaatccaaactaccagcctctgggtttttcttctttctcactttttatgtcagatttggacaacaatttctgtagttcttctaaataccagaaggtatcactggcacaattaagtagcaagtattttaccaagtggatcacatttggtagaatttttttcaattttatgtttgacatatttggtgcttgttatgtttgtgttattttcaggtgacaaaatcaataaacaagtagcaaaaaggttttaataaaaatgttaaaacaccctagttctttcttctttattgattcttcgatttggttttctgcacacacttacacatcatgcatttcctgattataattttatattatgtataaatattataagtatgtgtcttattcatatgttctcttagattgtatatggtggcatgacatacatcattattccatggtgcttcatagagagctctctgagttcaggttaagcagcgtcttaagtcactgctttgtgaagtagtacctaaccaaggactttaggaaagggcagttgttgagtctttggaggaaaaggtaagtttcttgccaactaggtttgctttcacaagtagaatatattaaaaaatagcttttcataaaataggaactctgtaatttggaaaggaaaattattggtatttgtcgtttctccttaatatagtaagtctctgttctttcttcctctttcaccagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgaggtgagttgggtaaacatgttcttgcatgaactctgcaattctttaattcctgctttatttattcgtctgcttgttcttttgtataacaaatactagcatgaatgaactcttatcggtgcgttaggcattgtatcagggcaaaaaatagtgaaaacaaagccaagcagatatgcctcttccctctagagattatgctataatgggaaagagacatttaataaaagaacacaaataattatatgaatgaacaatggtgatgaagtactatgaagtgtaaaagcagagtatgttaagaaagaaaataggtgggacctactctaggggtcaggacaggcctcacttaagaagagacatatatcctaagacctgaaagagatctaaaagagataaatagagttaattgaagagttggagataagtccattctaggtagccagaatagcaggcacaaagatcttaattatattgtcagtggtgacaaaactttttaaaccgatatttggaagatatcattgctttgtatctggagaagatgtagttgctttttaatttgaagaattgtcttagacttaatattgatatattttggggttttcttttaaattaatattaacatgctaaggtatgtagagaattctggaactgaaattttcttagagattatttaattccttttctataatggggaactaaggccctgatatgtgaaattattttcctaaaattacctataacaaatcaaatcaagatctccagacttcaaattcaatggcttcagccttttaaaattttaatatttttttgctattttattaatctaatttgcctttagtaccattaaccttattgttactgttatagtccatatgctctcaccatttccaatgaattttcatctctctttgtaaaatactttcattaaagtaagattctgcatttcaaaaccatttttttccacattattggatttgattacagttttattctataatcttaagtcttaggggcagtagagagtgatccatttacactcgttgccatgaaagccacagatttagttgccaatgcagtcaacattttaaattttcaaacactatctctcaagtaatgttaggtttgacaaccatagaagaatggacaaaatggtggcttggataaaaatttatttctctgtcacataaaagattctgaaggtaagtggtccagggctagtattgttatgactcagtatgagaaactcaagttcttatcttctgctctgtcatcctagtgtttggcttccattatcaatcaaggtcacctcagcatacaagatagctgctgaagagccacccatcacatcctaagttgttgcctggaaggggaaaaagtggggcagagagtggggtcccgcatctagctgagtttgcttccttaaagtagcctttttgaaaggcctacacaagacttccacttaatttttttgtcaagaacttaattctaatgacgaaacctagccacaaaggggttggagaaattcaggagtgttatcaaggaagaagcatcttttgaaaaacctcctgttaaactgccaccatggtagcattggagacactttttaggtctggttatgtccctctttggcagctgtagccaacaccagtaattaatttcaccattttttttctgatacttacccattcatttcaaggagctactgttagaagcaagtggcttcagttctgtttagtaaatacttactgaatgccacccattggtttgctgaatacttctgttagggtctagaggtgtgaaaaaggctgcatgcatgttcttaagaatctattcggaaacacagatatttaagcaagtaaatttttaaattattcttgccctagaaatttgataaggagacagatcctataagctagtgagtaacctatcttggtaacaatttagtttgaccttctcagttactccaggaaccattatcacaattccacccagagacactctttcttttcatgtctatattctgaattgataagttattgggcaaagttgtttggaagaattttctttatttatctggtattttgagcccttacttgaatggagggaaatttacattgcacatcttcagtttaatcctctagtgaatgaagagaaattagaaaaggtttttgttctaacaatttcagtggcctttttcttgcataattctcaaattgaatttactgatcaaacattaacagcatggtgtcaagcgtttaaaaaaattatttctgtcatgtattcaaaggcatgttcagaagtatagggttttagaaatagggatggtacttattagggtttcctctttgatatggagatgaaatttagggcttgaattgggagtggagtaaaataatgttccttcaaatatgaggtgtttggttaaaaaagaatgaaatactaggattattatttggtgttttagtttgttaacataacatataaataagatacctaatcaattaaacattagtgtttatagtttacctatgaaattctctatatatctaatagggaaattatattttagtttggctttttctgtgctgtgcagatttaaaggtgaaagtggttgtcaaattaatctgcaaaattgtaccatagtaaggatgaccgttttactctgaagctaaatgattcactaaatcttgtctacagtgtattgtaagagttaaaatgattattccttctcaccttaacgttagatccatgatagctacaatggtagtctagtaatcatcttttaaaggatttctagctagtaggacatgtttacacctgaggaaattttagtactgttactacagcttgcaagccaaagttatttatggcattctggaagttcgatgtttgctagacttaataaagctatgccaggacagctgagaagaagtaggcttcttgtttaatcagctgctgtggagttcagagtccaagtttattgcatgtgttgtaaatgtactgtgaaataggtcccctgattgcattatggaataatggatttctggaaacctaatttcatgtcatatcaggttctcacataactattactttgtagtgattctttgtatatcggggaggagagaatggtgattcagttcttgattccaggaaaaaataaggcttgtgttttcttttcctaagaccatttagaggaattgttttctcaagcaatatatattatgttttgaaaaataaacaattttgcaactaaatgtgaattttaggtcaccaaaggtttatatgtttgtttactaataaattacacaaaagtatgcttctgtgtaagtaattaatatgtttccattcagaagcatctgaatcagctatttctgcgaattattagcagatatggaactcttaatttttcctagttagcaaatgaaacctggaatacctctccaacgttacctacctactttttttttaagaagataaaatcttatttttattatttttaaatttttttaaatttttgtgggcacatagtaggtgtatgtatttatggagtacgtgagatactttgaaacaggcatgcaatgcgtaataatcacatcatggtgaatgggttatccatcccctcaagtatttatcctttatataacaaaccatccagttatactcttttagttattttaaaatgtataatttagtgttgactattgtaaccctgttgtgctatcaatagtaggtcttattcgttattcctatgttttagtacctattaaccatcctcacttcttctccacccccactatcctcctcagcctttggtaaccatccatctctctatctccatgagttcaattattttattttctagcttccacaagtaaatgagaacttttgaagtttgtctatctgtagctggcttatttcacttgacataatgaccttggttccagccatgttgttacagatgacaggatctcattctttttatggccgaatagttctccattgtgtatgtgtaccacattttatctgttcatctgttgatggacacttaggttgcttcaaaatcttggctgttgtgaacaatgctgcagcaaacatggaagtgtagaaatctcttctacatactgattttccttcttttggctatatacccagcattgggattgctggtaccagaggatcatatggtacctctgtttttagttttttgaggaacctccaaactgttctccatagtggttgtactaatttacattccagccaacactataccagggttttcctttctccatatccttaccagcatttgttattccttgtcttttggttaaaagccattttaattgggatgaggtgataccacattgtagttttgattttcatttctctgatggtctatgatgttgagcaccttttcatatgcatgtttgtcatttgtatgtcttcttttgaggaatgtctactcagatctttagcccattttaaaattgcattattagatttttttttcctgtacagttgtttgagttgtttatagatggtggttattaatcccttgttagagtgacagtttgcaattttctcccattctgtgggttgtctcttcactttgctgattgtttcctttgtctgcagagctttttaacttgatgtgctatttgtccatgtttcctttggttgcctgtgcatgtggggtattatgtaagaaatttttacccacactattgttctggagagttttgtggatgttttcctgtagtagtttcatagtttgatgattgagttttaaatctttgatccattttgatttgatttttatatatggcaagagatagggatccactttcattcttctacataggaatatccggttttctgtgcaccatttattaaagggactcttttctccagtatatgttcttgggacctttgttgttattgagttcattgtaggcatatgcatttgtttcagggttctctattctgttccattggtctggttttttttttgccagtagatggcattttggctactatagctctatagaatagtttgaagtcaggcagtgtgactcttccagtttcattctttttggctattctgggtcttttgtggttctgtataaatcttaggattgttttttctatttctgtgaagaatgtcattggtgttttgctagggattacattgaatctgtagattgctttgagtactgtgggcattttaacaatattgattcttccaatccattaacatagaatatctttcccttttttgtgtccaattgccttcgtcagtgttttatagttttcattgtaaaggtcttttagttccttggttaacttaattccttggtattaaattttatttgtggctactgtaaatgggattacttttttaaatgtttttttcagatttttcactgtcggcatatagaaatgctgctgatttttatatgttgatttcatattctgctactttacttaatttatctgttctaatagtttccttgtggagtctttaggtttctccaaatataagatcatatcatctacaaacaaggataatttgacttcttccctttccaatttggatgccttttatttctttctcttgtatagtttgctctagctaggacttccagtactgtgttgaataacggtgacagtgggcatccttgtcgtttaccacatcgtagaggaaaggcttttttgagagtttttatcatgaaggatgttgaattgtatcatatgctttttcagcatcagctgaaatgatcatatgatgtttgtccttcattctgttgataagatgtatcacattgattgatttgcatatattgaaccatccttgcgtcctgggataaatctccttggttattatgaatgatctttctaatgtattgttgaatttggtttgttagtattttgttgaggatttatttatcagagattggcctgtagttttccttttttgatgtgtctttgcccagatttggtatcagggtaatactggctttgtaaaatgagtttggaagtattcccgcctcctctatttttcggaatagtttgagtagggttggtattggttcttcaaatgtttggcagaattcagcagtgaagccattgaatcctgggcttttctttactgggtgatgtttttattacagctttgattttgttactggttattggcctgttcaggttatggatttcttcctgattcagtcttgataagtggtatatgtctgggaatttatccatttcctctagatttttcaatttattgccatactgtggctcatagtagccactaatgatcctttgagtttctatggtatcagtttgtaatggctaccttttcgtctctgattttatttatttgggtcttctttttttcttagttggtttaaagttgtgtcaattttgcttatcttttcaaaaaaccaagtttttgtttcattgatattttgtattttctttgtttcaatttcatttatctctgatctttattatttcttttcctctactaattttgggtttggtttgctcttttctggttgtttaagatgtgtgttatttgaattgtttgttctcttttgatgtaggcacttaaagctataaacttccttagtactgctttcactgtatcccataggttttggtatgttgtgtttctgttacttgtttcaagaaatttttcattttctttcttaagtttttgatttatccacggttaattcagaagcctattgtttaatttccttgtgtttgtatagtttcaaaaatttctcttgttactggtttctagttttatttgattgtgtttagagaagatgtttgatactagttgaatgttttaagacttgtattgtgacctaacatatgatctgtccttgagaatgatccatgtgctggggaaaagaatgtgtattctacagctgttctatggaatattctgtttaggttcatttgtctatagtgcagatttagtctgatgtttctttgttgattttctgtctgaaagatctgtccaacactgaaagttgggtggtgaagtctccagctattattgtattttgctcagtctctctatttagttctaataatatttgccttatatttctgggtacaccaggactgggtgcatatatatttacaattatcatatcctcttactgaattgacccctttatcattatataatgaccttgtctccttataatttttgtcttgaaatctgttttgtctgatacaaatacagctgctcctactctttttttggtttccatttgcatggaatatcttttttcgtctctttattttgagttcagatgtctttataggtgaaatgtgtttctcgtaggcaacaggttgttcttgttttttaatccatttgccactctttttcttttgactagtttagtccattcacattcaatgctattattgataagtaaggacttacctctgccattttgttacttgttttctggttgttttgtggtcttctcttccttttttccttcctttctgtcttccttttagcaaaggtggttttctctggtggtatgttttaattttttgctttttatttttggtgtatacattgttttttgtttcgaggttatcataaggcttgcaaacactatcttattacctattatttcaaactgatgtcagcttatcactgattacataaataagcaaaaagaaaactaataaaatctctatacttcattactgtcattttttagcttttgaaataaacaagcaaaaagaaaactaataaaatctctatacttcatccctctcattttttaacttttgttgtttctctttacgtcttattgtacggtttgtcttgaaaagttgttatagttattatttttgattgattcatcattagtctttctacttaagagtagcttgcacaccacaattacagtattataatattctgtgtgtttctgtgtatttactattaccagtgagttttgtactttcagaagattttttattgctcctgaatgtccttttctttcagatcaaactccctttgttatttcttctaggacaagtctagtgttgatgaaatctttcagctttcatttgtttgggaaggtctttatttctccttcatgtttgaaggatatttttgttggatattctaggataaaaatttcttccttcagcattttaaatatatcatactactctctcatggcctgtaaggtttccactgaaaagtcttctgctaggcaaattggagctccatcatatgttatttgtttcttttctcttgctgcttttaggatcctttatgcttgacctttggggggttgattattaaatgcctcgacacagtcttctttggattaaatcttcttggtgttctataaccttcttgtacttagatgttgatatctttctctaggtttgggaagttctctgttgttatcactttgaatacactttctacccttatctctttttctacctcctctttaatgccagtaactcttaggttcaccattttgagactattttctagatcttgtaggagtgtttaattcttatttttacttttgtctcctctgcattttcaatagcctgtcttcaagctcactaattatttctttcacttgatgcattctgctattaagaggttgatgcattcttcagtatgccagttgcatttttcagttctagaatttctgcttgattttacaaaataatttcagtctctttgttaaatttgtcggataggattctgaattctttctctgtgttatcttgaatttcattgtgtttcctcaacacagtcattttgaattctctgtctgagaagtcacatatctgtgtttctgcaggattggtccctggtgccttatttagtttgtttggtgaggtcatgtttttctggatggtcttgatgcttctggatgttcgttggtgtctggtcattgaagagttaggtatttattgtagttgttgcagtctgggcttgtttttgcccatctttcttgggaagactttctaagtgttctgagggacttgggccccaagctcaataatgctgtggttcttccagtctcctagagataccaccgccttggtggtgttgactaagatctggaagaattctctggattcccaggcagagggtcttgttctctttccttactttctcccaaacaaatgtagtttctttctgtctctctgtgctgaacttcctgaagctgggggaggggtgacacccctgttgccaccacctctggaattgcactgggtcagacctaaagctagcacagcactgggtgtgacccaaggcctgctgtaaacactacctggctaaagcctgtgttcactcaaggccctgtggttctacaatcagcaggtagtgaagccagccacatttatgtccttcccttcagtatgataatttccccaggccccagatggtctggagatgtgctctgggggccaagaattaagagtcaaaaaccttagaaatctacctagtgttctttcctactgtggctaagctggcactgaaagcacaagacaaagttcttcccatttttctctctcctttctacaggcagaggagcctctctctgtggtcactggcacatggggagttctgctaggccatggttgatgttcacttaaaacccaagggctcttcagtcagcctgtggtgattgctgccgagcctgagcttcactcttcaggacaatgggctcctctctgggccaggacaggtctagaaatgctgtccaaaagcctaggcctggactcggggaccccaagatccaaagtggtacctaagatgtaagacaaaatccctcttatatttccttttgcttttttcaagcaggagtctctcaccatagccaccacagtgagctgggaatttgctgggtttcacctgaaaccagcatgtctgaatctcaaccaaggcctacagtgtactacctgggtatcgctgttgtttattcagggcccgagtggtctttagtcagcaggcgatgaatcctgccaggattggatccttcccttcagggcagtgagctccattttggcccagggtgtgtctagaaatgttgtccaggagatagggcctggaatggggtctcagtactctgcctgttgcttatcctactgtgactgagctggtatacaagataaaagacacactcctgttgcctttacttgttgccttcctatcctgaagcagaaggaaggagtctcttattctgtgagctctgctgcctgggactgggggaggagtgacacatccattcccttggtcgccctgtctggtgggtcttttggttgcatgctgtcctagtccactggctctaagcacaacactaagacgtgtccaggaattgcagtccttgtgtcctagactgcctttcaagtttatctgagactctagagcactttagcccttggtggcaaggcttactcaatttccaacctcttggatcggtgattctcctctgaccgtgtcacgtccaaatgctaccttttgtgggtggctgctagctgaacccagcacacttttgctctccaccgtgattgatcagcactaagtttagtacaaagtctcccagttgctgtgctctctccacccaagtgcacatattctttgtccatgccacacagctgctattgcgggatggggggaggggtggcatcagtgtttcaagatggtcttttccactctctttattgcctctttcagcaatatgaaattaaaaccaggtactatgattgctcacttgatttttggttctttggcagtgcttttttgtgtgtagttggtaaaattggtattcctgcagaggggaccatcaatggaggctttgattcggccatcttgcttcgcctcccctcttagtttttttttttcatgttaagataaaataaaccagacctcaaactttgagcatagtaaacattcttcacaatgcaggtagggattttatctgcaatcctaccatcaggaagtgatcataattagcattttgggtttgaattattgctcttcttcttagtaagctatttaatcttatctgtttccttatttataaaatggggataaacagtggtgtacttcactatctcaacaactctgtgaaataagtaagttgatgtattgtaaagtgtttaaaatagtactagttgtatagtaagtgttagttattgttaaggaatctttcgcatatatttcacagttttgtatacttggaggcagtgttttaatggaatatttttataataggtggttctgcttaccttttttgccagacagcttggcagcccacagaactgattcttttagaagcatgcgttgaacttcacatggacaaatctttctctgtgacagttcaaaaactaataagtgacttcttgattccattacttctgtctttctagcaagcttgtttacttttacctggctcacctcatttttatttgaatttcaggagatgtatttgaagtttttattcttgtaagttggcccagtttagttctttttaagaaataagatcaacaatctgttcactgtgggtagggagaggggcgtgaacatggaaaaatcaaatcttgcctgattttgaggaagcaagtagatttgtacacaattcaaaaccagttaatctaattattttgacctttaaaacaaacaacaacaacaacaaaacacacagctttcacaaaagtgtgaaagcaggagtcttttaaaacttgagtaaccaaagggctaaatggcttttttttttttttaattatggttttaggaaacttgatgctggaaaagtgtagaagaaactgatacttttggagagagcaaaacaacaaatgtcctctccatggaatctgaattatatggaagcttttaaaatatttttataagtggaccagagtaaatttgcctggtttgtggttgatagtaagtgtaagtgttcttaaaggctatcaacaataagttacagaaggagttcacaaaacagtaggcagaatgggggttgaggtaagacctcctgttaggcttacccagcctatccattgtctccaaatgtgcttcaggaggcacttttccttctcttttaggagagatgaagtatgttacaaaccttttctctcactctgattctcttattttctcttactcttttactggttacatggacatactgtgtaactgaggcccaagcagtgcttctcactgtcgcagtatccattaatgcaaggtgcagtcacaatttcctccttcaggggacccaaaatacagtgtatgcactgtcagttactactaagaagtttattgtgtttaatctgttttttttgttttgttttgttttgttttgtttttgagatggagagtctcgctctgtcgcccaggctggagtgcagtggtgtgatctcggctcactgcaagctctgcctcccaggttcacaccattctgcctcagcctcccgagtagctgggactacaggcacctgccaccacgcccagctaatttttttttgtatttttagtagagactgggtttcaccttgttagccaggatggtctcgatctcctgactttgtgatccgcctgcttaggcctcccagagtgctgggattacagacgtgagccaccgtgcccagccttactgtgtttattctttaaagttaccctagccaaagacgttatccctaaagctcggaaagtgctggactctaaagagactgaaaacaaagtggaaattttctttcctaaatttacatgaaatcattacattccatgtgttaccaaccctgaagaaacttctaagtgggagaactccccaggaggatgattttaagaggccggaacacactttttaaagatcagttcaaatcccatgtttataaagacttctttctgcttcaactgatggcagtcactccacttttcatatagctgcttcacgttgtacatgtaggaactcaagtacatggtaggaactcaagaatatgtcagtccttaaagaaccaggttgaagatattcagtgacagagtggactccagtctggaagagtgagtacagggagtcagggtagcattagtggcttgtatacaggattcagagtcaaactgagtttcttcctttgtaaaatggagaagaagataacatattttgctacctaactagtacaggctgaaattataaatagatttaagaacagtttagataaatttatggataagagattaaattcagttcaaacaatggatatatgcctggtactgtcctggacaccatgaatatatcaataccatatgaggaagaaaggcttttgactttattgtaaggcctatgggtatatgcagtcatgtggcacataacatttcagtcattggtagatggatggcatatatgatggttgtcccataagattataattgagcagaaaaattcctctcaccaagtgatgttaaagccattgttcattgtagcgcaacattacctcttttatgtttacatacacaaatacatagtgttacagttgcctatagtagttcagtaaacatcaggtttgtagcctagacacagtaggctgtatcatacagcctaggtgtgtggtaggctatccctgtaggtttatgtcagtacactctgtgatgtccacataatgatgaaatcacctaatgacatttttctcaaaacatatccatccccatcattaagcgatgcatgactacagtgtatctccaagtgactcccaacagaattttggtgaagtgcttctcagctcacagatttttgatttagtatatgtctgaccttcctgtgacttattctttttgtaaggttcacgtaattaaaatgagtctagaaatctagagatgctgttacctatctcagataatcttgttagctcttcatgaactttctgggcacttttacttgtctggatcctttcacataccattcagggctatacagagtgaactaataacgctgatacttgaaggcacacagctgactcagacctttttaaaagaggtcagagtgtggtgtaaacctaagtaaggaaatgggttcctatcaaaacagaaacattcattctttatatctgtccctgcctttcttgaataacaagaacttgagatctaatgagctatattgttattttaatcttagtaatagtcactataattatattaattacttggaagtaggaaacttttttcattttttggaaacatatctttgttaattatgaactacttatatagttatttctttctacatttgtttactgggctgtttatgccttttttatctactgaggcaatattagattttacaagatttgttagaagtcatgttaaatattaagctaaatggttcattgttttttggcagataaattatcttgtcagattctgttgcttttgctttgtgcttaaagttagtcatttgtagggagttgcaaggttcttggcatttgtaactgtcttgtttagaaaataaattgatttaatgtgttagagatcccatacaggagatttctgaagcaaaacttacacttttgttgcctcaagggaagactttattgcataatatgatatatgttcataaggtttgtgtagaaatattatacttggtaaaaatctatatagattacattgtttccaatttaatattgtcccaagtaaaaaatatatacaattgagttttattgagttaactagctcaatccttaaggactgaaaaaatcagaatttaacagaagctaggttttttaagcctggcagttaactctttacaaatggaattatttttatgaaattatgaaattctgtgcctttggttcactgaaaactgaattaacatgtgtagtaaggatgttaatcttttgaaattataaacctcacatgtttgatataaaaattaaaagcatatgggttgcttttaatttttttaataaaaaattaaggacatatattttttcattgaaaattttgatagcctaattgaagaattacggtgatgtacaattgttaacaagaatgttgattaaatgtttaatgtgttcatgtgattgctacagaatggaatctcagaaatgtgctttttccaagaaagttgatattcataataatttaaaatttttattgcagctagaacgagtaaatctgtctgcagcccagacactgagagccgctttcatcaaggtgaggtgcaaataatttactatgattattaaagtgtatgttctttgtaaatgtaagtacatgtgatggttgccagtttattttctttaagggaaagcctttttagccatcttatgcctgttttactatattccataaagcttaaaacacttccaaaagataaactagaacaaatgttatttcgttagcattcatcttttcatcactttgtgcttttgaaactgagtttttcagagtgttctctccttagctgtagattatatttttgagggtttttttttttttctattatttgaccttttgaaaacttatatggctgggcgtggtgactcatacctgtcatcccaacactttgagaggctgaggtgggaggatcacttgagacctggagctcaagaccagcctgggccgtatagcaagaccctgtatctacagaaaataaaaatattagccaggcatggtggtgcgtgcctgtcattcttgctactcaggaggctgaggcaggaggattgctagagcccaggagtttgaggttacagtgggacgtgatcatgccgctgtgatccagcctgggtaacagagcaagaccctgtctcaaaataaagtaaaaatttaaaagtatttgtaaaagtgtaacttgaaaaggtattctttctattgtttaattatagaacatgagtctaaaaaacgtttttcagtgggaaagtaataccttcaaatatggtgaattaaatatactttgaggatatacagttaagttactcaaaataaatgttttccttgtctttagacttgagctgttcagtgggttatcactagccacatgttgcttttgagcatttaaaaataagactaggtcagatcaagatatgttccaagttaaaatacacacagattttgaagacttcatataagaaaaagaaagtaaactagcttagtaataaatattttataatgattacatgttgaaataatattttggatgtactattaaaataattttacctgtgtctttttacttttttttaaatgtggccgcttaatattacataggtagctcatagttgttgctgatattacatttctgttgtacagccctactctagagacttactgtacatgttgaatgcattctttaatataaaacttttatctggtcctccatcccaaatatatattatggtgcccaaaactttaatttttatttttgcattccttcccatcagtagctcaaataacctgtgttttaggtaaagtattttaatgtttaaatgtggaatacatttatattttaattggagttgaaactataagcccattctgcttgatttcttccatgtcacacaagtttattgataacactcttttctggtagcacaagtcatgtcactaggtatctcatattactttaataatctacattacgtatgttagaatagagcttttttgatttaatattctgtgattcaaggtgagtacatatatatttagtagcttcattaaattgcatcctgccaaatcattgggttaatgaagcaacaccataatcattttctttttttttattgttgttttcttctttgagtgtcagtttggctttggaatggcatatttggtcattagggagacatgatgctatcttaagcatctttgtggccaaaagaagaaggaaaagtaatctgtacagtagtattgctaagagaaaagtcaatatttcagcttttctaatgccaggaacagagagaagaagaccctgtccgaaggagtagatagtatcttcaatgacattcataaaataaaataataaatttcctgagggtttttcttgtaacatcctaacatataagctaattatctaacacttaagtacaattatgtgaccgtgatagatgtggtttgatccatggataaagtttgttgtctatggcatagattacttattttggaagaaaacaaagtaactaattttacactgatgtatttttaattatcacatttagtttgttacatttcaagtgaaattgaaggaggacatgttaaaaatgtaaagatgcttgtattttttaaattacaacttttgaaaaagatgaaagaaacctcaccagtcataaaatcttttatattcataattccaattattggtccgcaacgacaataattttcatcatggtttttgttatttggagggaaaagaggattaaaatagtttttcccaagataataccattgaatattttaatgtatatacagttaacctttgaacagtgtggaggttagaggtgctgaccccctgcagagttgaagatttgagtataagttttgacttccacaaatcttaactactaaaagcctactgttgaccagaacatcttactggtagcaaaaacagttgattaacatatgttttgtgtatcctatatattacatactgtattcttaaagtcacagaaaagaaagtgttattaagaaaatcataagagaaaatatatttattattcattaagttgaagtggatcatcataaggtctgcatccttgtcgttttcacattgaatacgctgaggaggaggaagaagagaaggggttggtcttgctagctcagggatgtcagaagtagagaaggtgaatggggaggcaagagaggcaggcacacttagtgtaactttacagaaatatgtttaatttctgacttatttgctttgtcatttctctaaaaatgtttctgtacagtaccaatcttccaacatttgctttagtttcagtgcttgtatcagagaagggtccatgtcataaagcagccttgaataaagagaactcttctgctgggttgtctaatgtccatttgttttctggcactcctttgtcttcttcctcattgtccattagctcttaaatttctctgatatccatatcttgaaacctttcatcctctacgttttttttaaccatatctacaatctctttcatgatttccgtggctctgttgtaaatcctgtggagtcatgcacaacatgtggacacagttttctccagcagaaatttattgttttaggctcgatgggtttttctataacaacagtagcatcagtggtgtaattcttccagactttcatggtattctttctaccaaggattgttgacagccatttccatagaggccttatggttccatgtataatgagctttaaaggttcttgatcccctgatgtagaggctgatttagaggtgtggtgttttgggacaagtaggccactttgatgcctttcagtgttgaactcatggggttctgggaagcaagggacattatccagtatcagaagaatttttttgaacaacaataataataaaggctaggtgcggaggcccatgccttgtaatcctagcactttgggaggctgaagtgtgaggccagaggccagaagttcaagaccagcctaggcaacataggaagaccttgtctctaattaaatatacaatacatatatatgtgtgtgtatgtatatgtagatatctctgatatctatatatatatctgatatctcaatatatatctgatatctgtagatctagctatatagagatatataggtatctctatagatatatatagacaatcagaagaacttcagaagaccatcccttcctgccaagatgctttctaaccgcagaaacaacgcattgatggtaccaggctagaacaagggttctctttgtctaggtcttcttgtacaaccacaagactggaagctggtgtttttcttctcccttcaaggcttgagggtttagcagcattataaataaggacagtcctgatcataaaccagacttcatttgcacagaacagtagagttgtcctatctcttcctgccttaaattctggtgctcacttctctgctttactaataaatattctttgtggctattttttccttcagaatagggcactttgatctgtattaaaaaccttttcaggcagatatttttttcctcaaagattttcttaatggtgtgtggggacttatttgctgcctcttggtcatcagaatctgggtctcctgttatcttgacattttttaagcaaaacctctttctaaaattatcaaactatccttggctggcattaaattcttcagctttagactttccttttgctttaagttgtcatagaatgactttgctttttcttgaatcatattagggtctataggtatgcctttcttatagatatcctgcaccaacataaaagctgcattttcaacaggagacaaaaaggtatttcacaaaacatgcaaggtttttgtacctgctgatgtagctgcagcaatggctttgtttcatgaatttccttttttttttttcttacagtgagtcttagactgtattcaagcaattcagtatcatgcaatacaccttcttgtaatgtcatgactttgcttcttgagcacacttccaacatcactagtggcactttgtcgggtcccatggtattatcccatgtttaaagtattgcactaaacacgatgagaaaaatatgtgagggctgggaggtattactttgtactgggatgtgcagtttgctggagagatgaactgttcacatggagttgattagagtcacatggcgttttaatcatatacttactaatacttgaactgactgcaatagcaacaggaggtggcttcaaacttattacatatacacgtgtactacagttaattttgtgcagttatgatttaatattgcatctgtatatttgtttatatttcttttaactgcaaataacaccatgtacagtctgtttgcgtgtgagttttgataaattttaactttttaataatttgtatctattttatagtaaatactaaaatagactagtggataactatattttatgcattcataacatgtgtttttattatttttttcactacttataggctactcagtttgtctataagttttttcaaattgttgctgatctccaaaaatttttcctatatatttattgaaaagtatctgcatgtaaatggacctgagcagttaaaaccagttcttcaagggtcagctatattctacttgattccctctcccccttatcctctatgagaggttccgataggttgtccgtcttccagactgagaatcactgatccacaagagtgtatgttgctgcccttcggtttatttttttcttacagctggattctttacaaagattagacaccctacagggttcatgttgtattctgagggaaaacctaagagttgtagattgtctccctgatttaagaccatatttattcattttgtcagtcagagccatttggtaaattcaagcttttgaaataagaattagcttaaccaggtttttagccaggaggtactgagactactccttccaaactatgtactgaggtacctggtggcccatagcaaattcagaggggtgccacgaagtattttaaaattgtgaaggtgtacagtgatactcaacatctgtttgacactgcatggactcctagcttgagatggattgcaatttagcatattggattgtccttcactgctttcattggtgttagatcattgagaagctggactttttggccagtgctatgatctaacagaagtaccagaaaaaaatatatctgcaagaggaaatgagaggggcaaggtccaatctaagaccaatgtttgagaaattatgaagtgcccagtaggcacacacatcccagtaataagtgacaatagttatttaagaacagagtaaaaattgtttttttcaatttatgtgtattatttttttaaaggctaggtagttaggacactatacttattaagttgtttagacctaagtatttaataaacagcactgtgaggtgtatcttttggcactaaggacactgaaaactgagaaagttagggacctttgtgagacttttgtaatgctctagctttagcattttggggtcccagaccagcttggtattgaaaactttattctcagactttcagcattttaacctttcagtactttattataacttaatcagagatatgcttttctttttctgtcccctgcaagcacatagagaatgttccccctctccccaagataattcattatgtaggaagatttattgctagataagataaagtattgttactgaatgctacattatatgtaattttgtggcagttcaccgcattaatgctataacaacacatcttaagccatatttggacatcttataaaggaaactccttttttaaaaaacacagttttttttgttttgttttgtttttaatacgaggtcttattctgtatcataggctggagtgcagtggcatgatcatagctcgctgcagccacgaactcctgggctcaagcagtcctcccatctcaacctaccaagtagctgggaccacagccacaccccaccatgcctggctaaaaagtagattctttttaaaatatatatccatggaaggaaaagtcaacataggctgtaaaagaaacaggattcagtcaaacacagtttattgttattaatcatctatcaaaatgattttcctgaatagtatctgacagcatttaaaatgatccgaagattggaataaatgcgtgtattttcttttctcatttcatcccacaacccttcagtttttgatacttgagatctaatgagaaacaagatgttataatggaaagagcaataggaagagaagaaaactgtatctgcagtgataatcaatggaattgaagaggcggaggttaagtgtgcttgacacataaggaaacaaaaagattgccatctgattaagatcgtaaattgtgtttctattttgctgtttaatattagggcaaaaaggaaagaaaatcatcagcataatgattaaaattggcaggcatcctacaggaaacaaacatcaagtgtgattacagaatttactgggaaaaactgaaatctgaagattaactctggctttggtaaactcagaactctatgcccagtcttgaaatggctagaaaattttagtgtcttggggagtctaagtaacatagaaccaatgcaaactcaatgaaacaagctcaaaaggtagtaaaaggtttcatgatgttctagaaaccagtgaaggaaatattcttgctacaaaaataaaataggaaatgaaaatcattgtgtgggaaaatagttaaggtattattatataggttcagtaaaaccttcaaaataaatccttttttgtttttcctggcattctcttaatataaatggaaagaatatgcaaaacactagtcagatgagttattgcttgatccttgagttgcagtattagcacattaaaaaaagcttaaattctcaagatatttaaagtaatgagaatagcaattgatagattactaaaacatatataatccttaattctatctttgttattagttcaattgcaaaagagtataaagaagagtagaaaatactaagttctttctgttcaaatggaaaatggaaccttagtcatagtaaagagtcgggtgcacaagctctaacaaagccttagtgaatgctatcatgacacctgctttacaaagatttctgcccttaaaagttatcagtgtaagacgctcccaacagattctaaacaattaaactttggctttaaaatgttgattccttatctgtatttcaaaactagttttctctttattataggctgaaaaagaaaatccaggtctcacacaagacatcattatgaaaattttagagaaaaaaagcgtggaagttaacttcacggagtcccttcttcgtatggcagctgatgatgtagaaggtaacggacagaagaaccttgtttaagttatacaattgttaaatagcacttcctctaaatcattattatttgaccaaaggatcttccttccctactgttttccctccctccctttcacttatgatgatgatggtggtggtggtgatagtgatagtggaagctaatgtagataaaatagaaaaatggtttttcttgctttttatatttgtgagatttaattacttgaactttgtttatgctgcatacttcaatttttcccccctttatgtttggtgagtttcagttttactaaaagataagcttatttggaatgtgttgactttaagcaaacaacagtttgaaagtaatgaggtttttgttttgttgtttttttaactttagtacagcatctgtgtttcaagcacagatttaagagaataatataaccatcctttttacttttcttattttttttacttgaaattatttagacgttggttttacttaagtttagtagcagttttcccactaatttagaaaaatatggacatataatttcccagaattattaaggaagaacacaaagcaggtattttaactgattccatgattttaagaaagcccttatcattatttagagttgagcatttgcagcccattaggccataatatattgatgaattggtagagttgtaatgcttccaagtctgcaatgaatctagtgaagtctcctttccaaaattggtgttctgtgatcccagcctgtgtgttggatttgtgctggtgtttttgtttttaagtgagatttcaaaaatgtgtagaagattttattagattatttggggttttaatatgatgaagcaatgtatattaaatataggggttttaaatttttaatctttccagttggcaagtagatattacctttgcactagttatgacactcattatttaatttaaggtttccttgggaaatgtaatgtcagagtacggttgaacttaagcctcccttttaaatctgttttttttttgtgtgttttttttttttaagatttcatgggatgtccttttgtcccaaattgaaaatatttattctttctttttgtgatactttacttgaagggagccctgctgttgttactggactaagtcaaacgctaatgaattctgctttgcaaccttgtctttcctaattatctggcctttcacctccctcacctgcctttgaccaacattggaaattcttagatgtgatgaatttggcagagagtcgcaggatgttttttattatgtatttattttatcagagtatatgattgaacgaccagagccagaattccaagacctaaacgaaaaggcacgagcacttaaacaaattctcagtaagatcccagatgagatcaatgacagagtgaggtttctgcagacaatcaagtaagcaattatttgttttgtttcttcttttcttaaaagtacttccgaggaactactcatctacattttttaattttggtatgactaacttgaaatgcttatttgaaataaaatctcaaatttttaaataccacattttattaactttatggcgtttggtttcagagtacagcattttttagaatgtttaattttaaaacaacaatgaaatgtgcataaactggaatgtagtttgaactacataaatgatgggaagatataaatgtcagataaatgaatagagaaactggatatatcctagagattggtagtaagatataccaaaataatttttatttcagaaatagcagcagtcattaaggtaagtaacgtactcttaggcatgagtagtgttttctaagactgaccaaatagcctctaaatccttgcctttgggggatataggttaaataagaccaagaatactcatggggccagaaggctggctggtgagcagcagcaagaagggtcatcctagagcagtagttctcagaccagggacactcttctggagtacagtgaagggtgagagggtaggggattgagtgaaaacataatccctacataagtatctttaaactagaaagtctgataattttcttcagcctcagtggataaaaaacaaagaaagctgggaatacttgcagtgtcactatcaatgcatggttttggtgaaaccataggtagatattgctggggagaaaagatttagcgcaggtctttttctggaagaggctgtgacatatgtggtaactttgaagaacctaaggagactcacttggaataaatagtaacattcatcttttggagtttgggcagtgggaggagtggcagcagccaggcagcccagctttgtgaaggccctcagcatgccatggcccacatgcatctgatatgcgccttccccacttccaggatgcccaagaggacggtcagctcagctgatgggacagtgagggaagatcccaaaaggagattgatgtggttgtcagctaaacctgctctttcagtagtggaaattgaagccccaaaaggtagcaggaaaagataaatcttcaggcaaaaaagtgcaaacaaaagagaaaagagtaggaaagtgaaaacaagccaaagtagctaagaataaagatttacctgcagaaaacagaaaaactaaaactgaagagagtccagcctctgaagcaggagagaaagaagcccagtctgattaatatcgcataccatgtcttatcagtggttccccgtctctcttcttacataatccaggagaatatttttatcaactatgttgtaaatgcatgttttttagtagctctaatgttttttaatagctctagaaacatttaaggagggaattccactgcattccattttttaagtgtaaatgcttttttttttaaagaggtgaaataatttaatttgctggttattttttggtacaatgggaaaataatgttggatattgaattatgggaagccttgactgttatgggtgtcagcttaacattccatagatgggtggttagtttttatatcccataatataaagcatactaaatggcaaagtggagtcgcagtcctgcatttcatgtcttgaacatttttaattacttcactctgtcacccaggctggactgcagtggcatgatcataacttactgcaccctcaacctcctgggctcaagcagtccttccacctcagcctccagagtagctaggactactggtgtacaacaccacaccaagctaatttcttttttttttttttaatttttagtagataaccacatctccctacattgcccaagctggtctctaacctctgagctcaagtgatcctcctgccttggcctcccaaagtgttgggattacaggagtgagccaccacacctggccttaaattacttctactcttcatgttgttttttagtggaattgtttccttgggcaaaccactccttgagcctggctctacctatcagaattgtgtgcactctgtaacatctttggtcatggtagtcctgtttttctaataactttgttaatgtgctgtgaaagattaaagtatatagtgtatatgctattaaattgtgaattggtgggacgtatgtgacagcttatcaacatttgaaggtactggtacttgatagccttttaaggtaattttgcctcagttgtaagctggaaagtcactggaataactttagagaataataatgatacgtggctttttagattttgcagtacatatgttcagaattatgtacaagttgaaatgtctgtgtactgatcctcaacacaactgatgaaatctcaattatgaaagaaaaagaaaacattcatcttttgaaaatagtattctttgtcattcacattgagaaatgctattttagcttgtttggatacctagctagtttggatactctcttttgagtcacataaagagaggaatatgtcccatagaaaataatggttcgtgataggtatgcaacccagctatcaaggaatgaccctactctttgacaataattaagggccaggaatataaaaaaggcttttaattgaatagccaaaatctgtgtcacaagggacaaacactaagggtttttttgtttgttttgtttgtttgttttgtttttgagacggagtcttgctctgtcgcccaggctggagtgcagtggcgccatctcggctcactgcaaactctgcctcccgggttcatgccactctccttcctcagcctccagcgtagctgggactacaggcgcccgccaccatgcctggctaattttttgtatttttagtagagatggggtttcactgtgttagccaggatggtctcgatctcttgaccttgtgatccgcctgccttggcctcccaaagtgctgggattacaggtgtgagccaacacgcctggcctaagggttttgtattttacctttcctatgggaaagccccagcttccttttctacttttaatatgtgaaggaggaagataatcaactgttcatggagttttatttttaatctggtacaagttgagcatccctaatttgaatatcaaattctaaatgctccaaaatccaaaactttttgagcaccgtgacatgacaccataagtggaaaattccacgtctgacctcatgtgatggatgggttgtagtcaaaacacaatcaaaactttgttgtatgcacaaaatgtatgcatatatggatgcactttatgaaacataaatgaatttcatgtttatacttgggcctcatccccaggtctaaagacttctggtctcaagcattttgtttaagggatactcgccctgtatagttaaagtaaacatgtttggcctgtaaaaggataaattgtcagtgatcccaaacttagttgtttagactatttatttctaaagttttgaaataatttggtaagttttcatttgctttgataatcgtgtacttgttgatgagccatgacacatttctatgaagatttgacatttaaaataatatttgcagcagattttgcttcagatcatcgaagtaggtttatataatcaatgtcatcttaataacaatcatttatataggacttattatatgctaagcactattttaatcactttacatttatttacttatcacaacaacccagtaacaagtgaggaaattgaagcaggcacagaaaattaggtaaggccacagaacttacctattaagtggtagagctggatttgaacccaggcaatctaatgccaggtgttcactgctgtttcccaatcacagacttccaatgttgatgtaatctggagattgaaaaatagagtttctgccatttgaaagaaatgtgaaaaaggatattttaacatagaatgccagtacgtgagagagataacagtattgtggttgaaactggcatagaaatgtaggcccagagctctcatcctgtcactttgacatcctctttccccctacagagtccctgagacatctctgctaaaccgtctgtgactctagggagctgcggtttgaaaaccacattattagcagcacattttagtcataaggaaattgagcttaagagtcttgtctatagtcattgacagaggctttctttagggtgttgttttctttatgagggagtaataatacttcagttctgttttctagagtgtactaatttagcacaattgaattaagagtaatggtggcaatgaaaatttacttcctaaccatttgaggagggataatttgccctggcaagtttgttgatatgtatgttatttctgagactaaaattcaaccacatatgaatagcatagataggctaaagtataattatttgtatcactgtcatatattggtacattttcatgtatgttcttaccattattaattgacaaattagtggataaaattgcactaaaatagaaaatgatttcttcttcaggcgtttctccaatattttactttcttatatctaaggtagttatcccctttattcattttagcaacatttttcaataagcatatgtcatatacatattacaccaagtactataggtgatgctatagattgtatcaaagtacaagtaaaaaagaatcctgacagctaataaatattcaggcaattttgaatatattagcagacctagatttgaatctgtgttccaacatttagctatgtaaccttggatataagttgcttaacttctgtcattttagtttgtgcctctgaaaatgagggtaatgacttgtgagaattgaaagaaatgatgtacatgaagtgcctagcacagaacctagcatacattcaacagtacatgctataataacattgtgaaatgaggattttcctcccttttctcaatggagttgataaggaaaaatgatccagcaaatatttcaaaaggccttttgatcaatgaatgtgtgtgcctgagtacatttgagctatgcaaatatgttataaaattaatttgtattttttttgaagtccaatacatctcaactaatggaaaactagtggagactcgtgatttaacagaccaaaataaaaaagccaggcatttatttactgtttgtaatctgcatttgcatattcttaggctaaaattcagcaaggtttatttgttttaagttaggagttttcatgaagggttcagaatagattttttcagagttttccagtctaaaccaaactcaacataaagcacagggattccctttcattagtgcatttgcataaatgcgtatcatgcaaatttgggtggcatgattagaaactctacttttctattgcagttttttgataagatgtatgtttacgtttcatctgaagcctttgcctttcagtgtaatgtttcgcaaagctgcgctattaggttggtgcaaattgctaagttccttctccttctactcatactatctgcctcttatcacagaattcatctgcaccaagccgcattcattagttatgcgatatttattttaccctcaagttttttctcagttctttatctggttaattgtctatagtggtttttttgtcctggtattttctctcgtaggaaacaaactctctggtagttactaatataatttagcttctctatgtgcacaccttggtgccataaatgaaaatacttttctgtgtacatatggataacataatatttgacatacattgctgcagattgtttctagagaacattttttctacaatttggtaggcatttaacagtcttttgcctcgtgtccaaacagaggcttaggaataaatggccttggttgacagagagctctgttccaataaggcattaaaccttagctccaagttttcaaacctgactcatcagcagtcacctgaggagttgcgcctccccccacccccttttaaaatagagatttccagtatttatcagcaggtctttctttttttgtccagcaaaaccctcccttcttctcccctgtgtttttgtctccctaggtgcatgaggcaacatgtttcagacccactcttttgacttgtagaatctagccactgttattgtatatgaaacatacgctcattttgatgactagccccggaaacacattttattcctctttagcagaatattgaaatacactacaaagtaagactatataaacttctgtctgatcactatgtaatttgctccattatattccattttaaataactccattgtggatttggagaagcttgcatatttagagatttgacatgttttatttgttgaaattgtaatttttctcacagaatagtcctatgacagcattttattaaacaatagtgggtttatgtccatcacaccaatatacaaagattcaacttaagccataaatgaaaggaatagttatctaattaaaaactgctgttactaaaccagaggcaaaaaaaaattagataacatttatgtaagacttactgtcctacttgaatatgtaatgtttcaatgtttcagcccaataccagtgtttgacctgagagaggtaataagtaaaatattattgaaataatcaatgaaaatggaattactacttcagagtactctaaaatacttttttaaaaaatatcaaaattctgtatgcttttaattcttaaaatttctacaagcttatttactgaaaaatatgctgggaaacacccacatgcacacagaaacctggacactgaggtttttttccccttgaaataggaatgttgaaatgttttagataggaaataactgaaatctggcatttgtaattagtattagtaataaaatgttatgtttaggatggtgcagatttccatcttattcatttcttcacagttgcattgcatttgaagtttttgttgtgactaacagctaagagaatgactgtgaaaaagaaggtttgtcgcagagaatgtgagactatttgagaatgcagaattacatcaagttcaatttggcggaaaaaaattgctatgaggttaaaatgtggaaatcaaaaggggctagttagaaaggcaaaaaaaagttcagaaaaaatggtgcatggataggaagaacagtcaactcaaatgagaattattcatttcttcttttttttctttagaaaggggagggaggtgatgatgcatatatagtcaaaggatgattgctgggaaggttaaagtgcaagaatattgtgatgttgtctcctctagtaatttaaatattttccaaagggaatagtgactgatagtaagtgtttgaaagaggaggatatttggctgctagatagaagctaaaagtgtctgtaaaagagtaagggaggaagaatatttcctcaggggagaggaatattttctgaggaggaaatattttatgttaaacatcaaaactaataggtatctagcatacagcattgttaaatacagaattgagttatatgtaatgcagaatattataaaattgttccttgttcaaataacaaaagtagagaacatggtagcttgaatttagctacattagccagagcaaagaaaaattttaaaatgggaaaagacaggcataggtaatgtttatctttttataaatttgagtaaggaacgcttaatgaaatgtgattgatttgagaaagttggtcttggttggcaacctttggtcagcagtgcaagagaatcaggattacagaggggtataggctaaaatccccactccaaccagctagccgaaaaggctggctgttcttgaagtgattgcgcttaacataattaagagtgtactgtgattagattaagagtgtacttaatttctttcaaatgtagctgatgttcttttctctcacaaatttctttcaaatgtagctgatattctttattcttttcccaacagggatatagctagtgcaataaaagaacttcttgatacagtgaataatgtcttcaagaaatatcaataccagaaccgcagggtacgtttagtagaagccttgctagttgacaccctagatgttggtttatgcctagttgttttattgacttaaaaataagattgattgttggaaatagttttgtgtcattaaccattgagtttattcttgaatttaaatatgcctttttatttaaaagtgagtactccacaattgcttattagtaatattcatataaagtgcatcccatatcctgtgtaatctcttgtccttgcctttggcttttgtgattatttctcttatttagtactttatttcttattatattttgtgactgtaggcacttgaacaccaaaagaaagaatttgtaaagtactccaaaagtttcagtgatactctgaaaacgtattttaaagatggcaagtaagtactgtaatttatcctttacttttaaaattaaatagattatgtggttttatatgatatgaaaaccacataaattaagcccttttattttattattagtactccaggcaactgataatgaaggcagaccattaacaatagaaaatgaatggttgctaatctagccataactcctttctagaacaggagttatcagacgctttctgaaaagagccaggtagtaaatatgttagatttggtgggcctgttgccgttatccacccatctctgctgttgtagtacagaaacaagccatagacaatgtacaaacaagggggtgtgactgtgttttaataaaactttatacaaaattcaaatttcagtatcttgaaataatttttacctgtcatataatattcttcttttgttttttaaccatttaaaaatgtaaaagcaattttagttcattggcctactttatacactcctgaaacagtggttctcaaactttagtggcatcagagtcatctggaggacttgttacagtcaaattgcaaattgctcgagggtcccacttctagaatttctgatttcgtaggtctaggatggagcctaagaatttgcatttcttagaaattttcaggtgatacattacaggtctattgagaactactgcactaaagttaaagcaatagttgtcaatcctttctgtgcattagagtcacttgaggacagtttttaaaaaattcccactgcctaggccccacctgcagagattctgattcagttggctgggagtggagtcagggtttagatattttgtaaaagtgccccagatgtttttaaagtgctgtaagggttttgacccactctcctggaaagaggctttcacagcatcattctataaaataggaaatatactaaaatgtaaattggacattattttttaatttatatataattggttgtgatgcactatagaaaaccaagagattttatatattttaacatacatacatgcatacgtataatgtataaactgatggaaagtctggccgtataggtagttatttgcacttcaagtcaaatgtgagaattttttgaacaagattattttttaacagtgcttaaagtcagaaaagtaaatagagacctcaatcattccatcctgctattcaggttttaagatctctatattcatgtcacatcattacagtattattgtagtaatatttaaaaatgataaaaatacattagatagaattatgttaattttcagagtcatttttaacagttcaaacaggttgaagtatttacatttatattatgaattagagatatcgagctaaattttattacttgttttgtggtggtgttccatacacaggtttgtctaagggaaatgctccttgatgacttagtttaataagctggcatttgtgttttgaaaataaacttttatttgatttatgctaagctcaaataaccaaaaacacattaaaataataatttacatgatgggattattatttctgattttaaattactattatggaataagcacaatgaaaggtagacattaatttagagactaattttcattaattaattgaaattatttactctgcatatggattcagtgtcgttgctactactttctctccattcagcagctttttaaaattccagttctttgtgtatcaataatgtgcttgagttttatacctgtttcctcaaaacagaaaattattgatagaacctgatctttaggccatctttcagtagggggatggatttgcattgattcagctatttcttcctggcccttctcttttttttttttttttttttttttggagacagagtcttgctatgttgcccaggctggatctgggctcactgcgacctccagctcctgggttcaagcaattctcctgcctcagcctcccgagctgggattatagacacatgccaccatgcccggctaatttttgtatttttagtagagacaaggtttcaccatgttggccaggctggtctcacactccaagagacctcatgatccgcccaccttggcctcccaaagtgctgggattacaggtgcgagccaccaggtccagtccctgggccttctcttttgagaaatgtctaggatgcgggtgcatgctagatatgatactaggaaactgttgaggccacacagtgggactagggcatcatctctgaatcccagctgcatgaagatgagccattaggagaatgtggtggggctcaaagccagttttaaagaatatatttttatatgttgtcagctcccagattttgaaactgcatgattattttgttttaaaagtatgtttatagtaaaagtagtttgtagtagtttgtagcttagaatttctacctttttttaaggagataaagagattgggatgaatcagattggaagtaattagatttttcttgagtattatgcccattaattacaaattttgagattatgatactttgctggattttacttgttaacttctatgaaaccacagctggagaccacatctgaatcctccttttggccagttaacttgttccacctataaatgaactgggttgttgaggcactatcattagcagtcctccaacattttattaccagtcagaaccaccagggggcagtaattactagatagtttaaaatgatgcaagactattatatcctaaattggaataaaagttttaataatactaacttgtcttttttttttttctaaaattgattccattgctactgttaatagtataaatcttaaaagggtgaattttttggatgaaattaatgcttattcttttctttttaaacagggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaaca

SEQ ID NO: 37461 - DNA, 93532 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcggtgagtgcccgccgcagcctgggcagcaagatgggtgcggggtgctcagcgcggacccggcggcagcccctccggctgagtcggccctgggggactggagtcaagtgagctgtctgcgaagtgcattgggctccggaaagcagggctgggatttgcgctaaaccgttggagaatgtgtctgtggaagcaccatttggttgaaagaaaaagagaaagagaagaaagtttgttgggcaggctgccggcgcgcagttttgggcgaggtcgctagagctgcagcacatggcagaaagtaaccgttctcccggatgcgcacagtcgttgtctggactaacaggctcctgtgcccaagggctcgccaagccccaccgggctgtgtctaggcagggcagagctgggcggggcagagactggggctggaacagggcgagtggctgttatcaaggtggtcacagaagggatcacaattccaagtgtgagactagctggcaatgggttttccagaaaggggtcctgggttctcccagctccccactgagccttgttccaaagcttacagtccgcagtgtcactgccaccttagcgctgtggaagcttgaaccagctctgcggtgaggtcttgggtctccatgagattccagcctgggatagggagcatgaatatgagaggcaaccactggaccagctgcttggtcctcaccacctcctgcttctgccaatcagtgtggggaaatctcaacagtaaggtggcttatattccctgcctggcagcctcagagcagagagaagagccttgataccagggcaacatcagggaccctggagctagggctccaatatctcatccaaacagggtcagtgctttgtggtggctatggaggggaggggctgcgtgtaaggtatattctagcacggctcaactccaagcattctctttctttgtctatgtatgtacagataattacatggccgatttgcttatcgctggccaaaattaatctttcttttaagaagtgccagctgggtcattaagacagctcagcctgcatgcagtaaattctactcagcaaatatttattaacccagttccacgggagtactgagaaattgaaacacacagtctcacccaggtagtttagattgagtacccagtataaagtatcttgaattactttctgctttctctatcttcctactttctgcagtaggaagaaagtgaccctaggtggaggctaggcaggatgagttctctgtgcatatgcatctccctttctgtgtgagtgagaggtctttgctaggtggggatttggggatctaggatttatactactgaagctgaaataataataataatgatagcaacaacacagcctgtcatggtggcccatgcctgtaatcctaggactttgggaggctgaggcagcaaattacccaaggtcaggagtttgagaccagccttggccaacatggtgaaaccccatctttacaaaaaatacaaaaattagcagggtgtggtggtgcacacctgtagtcccagctgcttgggacgctgaggcaggagaattgcttgaacctaggaggtgaaggttgcagtgaaccaagattatgccattgcactccagcctgggtgacaaagcgtgactctgttaaaaaaaaaaaaatgaatacagtgctagctaccatttactgtatattttcactgtgccaggcattatgttaaatattttccatgtgttatctcattctaccctcacaatggcctagtaagaagcttcctgttatcaggcctgtttgacaggaggaaaactgatgcttagagacgttaagtgacttgctggcattcacatagccaggagcagtgctggatggaaacccagctccactgagctccaaagcctaggcttagaatatgttagactgtataagatggacgaacttggaaggatttcagggagggaaggattttggtggactctaggccttagggaaagttccaaaagggactggagctcaaataagcccttgaaaagtggaaacattcaggatgggagagaagagtcaagctggagatcagggagagccctgggcctggcctgaaagaagagggccctggtggtttccctatagtctctagggaagtttatttgtatgttacctaccagtgccatcttctgctttgtctttgggcattctgactcctgactccttccaacctgtctccccgttccttctaaaaggccccacttccaaatatttggcactgtcctaacccttgaggttctcccagagacccgcagtctccctcctgccccgtgtttccacggcccctttgcgcagcatcatttagaggaagtacaatgaagtgccagtagcaataactgccccggccctcgctttcatgtgcttgtaaagttgtttggcaggaactgggacttggaaaggagacatgactttgtcagagggcttggggctgggcatggtgtgggtggcgaaggggagaaggaggaaaggggaaggaaaggagctcttgttgccccattctggggagtggtggactctggacaaccacgaggaaactttggaaaggagcaaggctttgaggaggagtccagtctttgtatgggaaagcaaaaagtggagaaatggccaaatgtagttaagtgacattggacccagaaactctgagttggggaacagatatcttgaattcggggtcttgtgcaggaggaagaaagtggcccttggtggaggccaggggggatgagtccttcatgcacatgcatctccttgtctctgtgggtgaggggatctttttttttaattattattatactttaagttttagggttcaaccattgtggaagtcagtgtggcgattcctcagggatctagaactagaaataccatttgacccagccatcccattactgggtatatacccaaaggactacaaatcatgctgctataaagacacatgcacatgtatgtttattgtggcattattcacaatagcaaagacttggaaccaacccaaatgtccaacaatgatagactgggtgaggggatctttgcttgggaattgcatgcctggtgttgagaaagaggagagcgtctgagagccctgggtcttagggctggcacacacctttctgctcccttctctctaattgagcattagagactccgccccctgctgggagttagaactttagctgtgttttcccatgtgaaggagcaaagaggcaaagcttcatctctgttggggctagcatcaactaattcaggtattccccatttacacattggacatctacttgctgcaaaggcatggtgacaagtccttgtgtgggaggctggcagccagtaggaaaatgttccatttgttttttcccaaatttccccacaaaggaggggatgctggacagcatgaaattcttagttcatgacagattcccttccattcattcaggaactatttcctgactcattgtcatagactcagagatgggaactctaaggatcatttagaaaatctgaaagagagggactagtgacttcccctctctgcgacttgttaagatattagggcagggcatttctctcatgtatctctatcatgaggactgtgggagcctcaaccccaccccctgcagtgggtggggagggtgtggtctactggggtaacaacatttgtttcacaccttaaatactaccttacagactcattacagttttatatattactctacaatatacccaatttgagtttaatacaataataatgatatatatttttgaccatatagcaatgttggtgttcgacaatgattctctgtattgtcctggggcttctagcacctcctggaacatcgctagatggtcaggagcaccaaagttttaaaaacctgatgctctgctgtggtaccatatggtcctgtgtaaagcagggtcctaagtcctgagtctctaggaaatactgctcagtgagcactgactctatactagatgtgaagccgggggtagcacaggatatcttatctaagcctcccaacagcccaatacacctagcactctctttaactccattttctagataaagagatcgagacttgtggagatggcatgacttgccccaggatccagtggtggagttgggatttccgcattatctaacatcctcccatgttagactccaatgcttatgctccttcaattcattacgtgtctggaggactttggaagctatacgtggctctcccacactacctgtcccctgtggccagcataagtgaactcttgcatgggtggcttctctctccatccccggcaggctgtggactcttggctgccctgccctggcctgtctctccccaggtttggccacagatatcagagatgccaaccaagttatttgtaactaaaataaatcacatcccttatcagagtccagctgccctcccagatatgctctgatttacaggcttggaataaagagagaggtggttgcttgtctacaggacaagttagggcaatgccctctgcctgaatattaggaaagcagcattacaggagctctcactctgaccaggcaagcatttcacatgcacagacccagagacccactcctcacatgctcattagtaggttgtgcgaccctgggtaggaggctgacatgggtcttgaactgaaacccagtgtgtggctctaggtgacatgtggccacccaagtgaggtttcggatccacctgcagtgtcagatgcttcaaggctggggtcccctgatggagaggaggtggttggagatcacctgggcctcctcagcactgcctcctggctggggctggggctggggataagagagtaactgcaattgtgcttccccggcaccttcgctttaggtcactccaccgaagagcctgaaagggaagtggttcttgcgaaagaatgagctgaagcaggtggcagatgctaccaggcaccgtgtagttttcaaaggggatctttttctgcctcagagagaaattctggggtttgcacagcaagaaaccgatgactcaatttcctttgtgtccctgctttaatgggaaggttgtaggcgttctttagaatggcagggtaggttgataccttctaccttaaatttgaatcccacttttcactcacttagcaggttgaattttttttaagtgtaccccccacagctgcccaactgggtttgcgaggcaagcccaacttgccagagtaaaccggaaggggtgctttctaaagtttgtggttctggagtctggccaggcatggatacagtcattgtgcgttccagattttctgggagagtcaggatctcaaatatgcaaacactctaccaattgatgtctagtgcatattttgactaaatgtttatatatttttccacaaataaatacatgacttaatgtaattgaaagtcaaacactttttaaaaatgctttttgcataaagaaattcacatctttacaactccttaactaggatggtgtcaattaaattaatgtttgattcaggacatgtgtactttggaggtaagtatttcatattcctcccctctccattgctcaattgccccactgggtgacgtaccaagataagccacatgtttgattcttgtttgctggatgtggacatatgcacattgcaggtatgcctataagtacatgcctgaaggatctatgtgtgtggtgggaattggtgatgccaaagaatgctaaagactttcatgccccttaaaggggaaaataaccacaacaaaacaaattccaatgtatcttctcctgtcttctgcagcactgggggagtcccctgataacagggatcatgtcacattcatttttgtgggcccagatcccagtaatattgacccataactgttgaactgcaatgaatgtctagaatataaaagtcatgatatctatatatatggaagcatgctgtcagtatgggctaaggtgcaaatacatttatgtgtaagtgagaaccatggtgatggctgtgttgctcaggacagggctgacttggctggctgactgcccaccacaggcctcatgtttggtctaccccaaacagtgagctcacccatctgtttgtttgcggctttggtggctgcctgctgtgaccgctggggacatctggctaaagacagggttactagatagttgggctgagaagggagtgggagccagtgagatgaggacaccaaccccaaatttaagcctcaaaacaaaaacactccccagcagcagccaccttggggttctagttattttggagatactgatacgaggttgagatccttgggtgagaggcccacactcctccaacccccatgtctgcttctggaaggtggtggcagaggagagaagtagaagtactatatgggagatgcgggagattcttgccttctctgtcggtctctttgggcaattatcaagctgtcatctgaccagatactaccatagcttcttcgggggcaaatccgtagggaatcctgacatccgacggggagccactttggcaatggcaaacggtgtctcctctccacagagcttgtgatgtcagaaattacccataactggggcaggttttgtcttcccaaagattgtctgcccagctagacctgagagacagggagacaaacacagaatgagggggtgggtcttgtgggggtggggaacgatggaaactcacagagccagatctccccgagtttgagttgcactggctgcctgggtgtgtcctcctgaggtaagtgtccctgcgaagtgcaagtgtgggcagacagatctcaggtgggtggggagggactgagtcaccaaggaggtgatttgcaaaactcaggtcccagaaactttcaggtcttcagcttttaaaagtaaaggttaattgcaaaactccggggttgagggaagagattattcacatagaccagtcattttgagcatctgctgttgtggcattgcaagtctccttcgcagtgcctgaaagttcatttgtttttgagagctcttacgctttttctgtttgcatctttgcacaagttctatgtttctgagaaccctcaccactattagtaataatagcaaacacttacagagtgttgaccatgtaccagcgccattctaattgtttcctatatactgccttgtttaatccaaacactgacttcatgaaggtggtgctgttattatctgtcttttacatatgaggaaactgaggcacagagaatttaagtagcttgcccaaggccatgcagctgataagtgatggcgctgggattcaaactcacatctggctacagagttcatgctctttgtcactatgttagagtgcttctcttggtatattaagatatcgaggcaccctagaaatccagacgattgtacctggaagtactgtagttgttttcaaaaacttcatttgggaatctagttgtgggtgaggtcataacatccactgagcttttaaacatgatgtcagaggaaggggttagaattgcaaaaatgaaggaggaggaagttgtaatggaaacttctgccaatgcatattctgagttgactcattcattctgatctctgaatagaagctctactctcttccatgtgatggaaagttgaggatagggtagggctgagagggatgtgaattgagttgtttgttcattaggataggatagggctgaaagggatgtgaattgagttgtttgttcattatcacttcattatttgtcacctggatgaaaggtaaaggtggctgattagtgtttctccatcagctagaactttgactgggaaatgagccaatcaaatagcagcaaaatatttgccctcaccttacaggcccttggttccagggtcttctctccaccggctagaatggatgagggagggagagaaactctgagaaaagaggctgtcaggagtagggctgtacatatccagggcacaaggaatttggcaaaagctggaagtatactatagcccttctctccagccctagcctaaaccagatgaccaggcttctatttggcccagcatgtgaccatcccatcagggagcaagagagtttcctctgggtacccctcactgagaaaaaagccacccaggaagggaggaggcaaggccccctgggaacatctggctcagtccacaggaagggatgcaggccttttcctgggaatgaggactcatcccatattccagcccccttcccccaacttttttttttttcaattttagtgcatctctttacacttaacaggtctgcagtgacttctaggaggatccacacaccaatcgtggaactaggcagcatctttttccacttcctttccaagatagtagcacgataacagtaaagcccctttgcaagtgttcactattatgcacattaagatgccagggagagggctgggaaaggtggctcacacctgtaatcccagcactttgggaggccgaggcaggcggatgacctgaggtcgggagttcgagaccagcctgaccaacatggagaaaccccgtctctactaaaaatacaaaaaaattagccgggcatggtggtgcatgcctgtaatctcagctacttgggaggctgaggcaggagaatcacttgaacccgggaggcagaggttgcagtgagccaagatcacgccattgcactccagcctgggcaacaagagcgaaactcggtctcaaaaaaaaaaaaggtgccagggagaaatgaacaattccatgcagccaacacctggtctcctgcgtttggcttagaagggcatttctgcccaagcccccagctctagtctttgcacactttaaatgagtagctactacatgccaatcacagatgttgcctctgctgagtatccagtcaaaaaaccagaatctaacagagctaactaagcaccatcttgcaggaaaccagctgacgtcagctccgcagccaccagtgagttactgggcccacatctgcctgcaagagggggaggggaattcaggtaacccacaagaggggataaaagttcggggaagaaatctcctgtcaaggagtttgtttttgcagtggatcctctgcagtgagactagttgtctttacaatatcattagaggtcaggtacattcctgtagactcccttaagtgacttgctttctcctattgttccccctgaaaattcataaaaacctcacaaacacatctccatttaaaaagagaaagtttaaaggatgccatgtaatggttatctcttttcttttgccagtgagcataaaagctccttagggaaaagcccaaaccctctatacattttcatattcatgatagccctgagcggtcagcacagttccccaattatagtgggtgctcaataaacacttggatggcttactgaattaataatgtttctagacttggctagcaaagccatctccgttacttatcttttgtgatttttataggttctgtctaattctttttcttcattttttttctttctggtctatacaaatcttctttcatttttctctattgctacttgtagcgatcctcaacccgcctcctcccttgaaatttctgttctctgcactctcttcagtctaaagagatctttcttgaggtttgaaatgttacacaaggcaggggaagtttagagctaattgtattttgtccagtagaacggggatctggatttcctataggtctggctgcctctttgtctacacctttacttccaaatctggcctcatgtataaaaagaccccaaaccttaaaatcatgttctcaacaatactcagagaaaaattgttggctttttggtcaccatgctagaggaataaaagggcagttgtttctttcggtcaatggtttgaaaacctcccagactaaaaatcacctccatataatcagatgcttggtgtggtgtaatgaagatgaggaggtctggctttgataagagtcatttagaaggtataaaggcagtggaacaagacgggaggacccatacaccagttgattcccctcttgccacttaacagcagcgtgagcttgggcagttgcacttgttaaatgtctggaacaatacttagcacgtaatttctaaagcttaatgtttagttcacagaaggtatcccaagaatagaaatgattattatattttagcttctctctattactgattcactatgtgctgctaggcaaagtatttcacccccatttacttctatttttccatgtgtaaaatgcgagggttggattctagttgatctgtcaagtcctttccaggcctcatgttctataaattcaccactctgtgggcttactaacacctgagcctcataaaacctaatggaaagaataacacaaaaccaccataaggcagtgtcaaaaaaaattgatgcctgatttgtattaaatgtcaaaagtgaattattaatccatgccagaaataaacatatggacccaattacactctaactccaatgggcaagagtgttgtagggacaaagtgctttgcccgtagtacttcatagaatcctctagaccatgtggaaggtgagcagatgaagcagctctggccagagaagttaggaacatgtcccagtcacacaactgaaactgcaggaagtcagtcctgggattaactgcaggatctgaacactgtactctttatattgtactttaaaaacattgcttcacatggccagaaaagccaacctctgaagaagagaaaaattgttcccttcactctcagagcttcatgagcaccttggacttgccagctttcctcaagcaacccctgtaacttgttggcacaaaattaaccacaatattcagacaaagcagtacttacagggtgagtgctagtatcctatgcaactagggtagcctgagaatctaggggaaaaaaagctagaccaaacaaaagattatatataatctttccccaaatcaaggcactgagcaaggcaggcctgagagatggtgaatttctgcttctactgagagtcctccagacccccagtaaaaatttcttttcatcataaaaccagagaaactcttgctcaggaaaaagaaagaaaaatggaaatcataaagattgcacgacttaggattttgtcaaaatgtgtcagaggctataatataaggctagtttttggcattctgtcagtcactgaatgtccttcgtcagatcacagctccttttggttgtgctgactttatacccatctggaatccactgaccattagctgaaataaaatcccagatgtgctcagatctcacatcctgtgcaatgccctcagttattgctgatacggttcagtcatctgtctctccagctaatcatacagacacagtattctaggagaagtgagaacccactcatagccaggagagcttctccctctcagtcacagggtgactgtgggcaaggtccttcccctgttggttgcctctgtctccccagttataagatggtgacaaactgaccaacttaaaatttccttaaaatgtattggcactgtggacagaaatgaggaaagtggaagacctagtttctgtcctcagggagcttaccatttggtggaaataaagttaaacaggtgaaagaattatgcaagagagcataaccaagtgtcagaagacaggaaaaacagacatctcgattgcatgtgaaggcttcaaggaatttgaggatgagttgaatgtggaaaagaagatagacagagagaggggagaggagagaaacccagggaaaggcaaaacatgagccaggtgtttaaagtgggggaataagaatggcttgattggggccaggggaggggtctgtctgcttggataagagaattcatgaaaagaacagtgagagatgaggtcggacagattccaggcaatcaagtaacagtggcactgtccactggcagaagatccaatttttctgccccagaaactcagaagttctcatgaatcaccctctcagacagtgctagacagagttcagaagcaggccagctccaacagtgagaaagaactttggcaactttgcctgggttagagagtggcaatttaagtgaatcccaaacaagacctactgtggcaatagcaaatagattttagctcaaggaacatttcccattgactcctagaggcttcccaaaatgctgtactaagaagtcaaaccttggctcaggtatggagagtgctgtgatccattagtgatgtctgctatgggcacaatatgaaggatttgacccccatgcatcacatggacatcaccgtagtggagcagcaggctttctttgttaatgtttctgagagttgtgtgtatagtcctctgggagtttagccattctagaatctgtccagctagccatactatagactctatctccttctagaacagtaaaaaagcagtctcttgcccagagggcagaggttagtcacttgagccttttgttaggattcactcccattctgtcttcccatttacccacatgaagttagatgctgggagccagatatttcctgtgtttgaacaagggccagacttcctggcaaagggtcccttcttcccatcagtttcttcaactgcaaactgagaagacaaaagtgatgcctcacccgtggtggcgacaggaggaataactagctaatgcgaggaaagcttttgaagatgaaagggtggtatgtgcatgttaattacaacttttatcagccctggagcctctgcattctcagctgccactggaagctcttctgtgcctcccaaatgcaaacagcagccacattccatgagctggcctcactaagtcctgcttagagcatccaagtcaagaaggttggattttgagctcaggctggccagctggctcactctgggccactcaagtttcccactactcatccccaagggaaaaagtaggctagctacctgggcaggtaagataagatagaaccaaggtataaacaaaaggctccatcaaaagtctaccagaaatagcccctgggtaagattaggacactctgctctaattcccaccctgtgaaagcctaattgtttgaccttgggctattggctttatctgtctaatggttcaatatactgtgtgaaccatttggggataataatccctctgcctcccctagacctctccacctttgcctgctggtgtgaaagtgttttgtgctagtaggcagaaacacgtgatataaaactacaaggtcctattattacctaggataactttcgcctctatctatgtctcctgttgctggttgaccccaatcattgaaactgtattctttggaatgctcagcagtctcctccaagctgccattccctccttatctaggtgggcccagtattggctcaggcttcttggttgtgccacttcctaaggcttgcaaatgcattcagcctgcccttgctctcagtgccagctctcagtgcccttgctgggataactcaataaagggctagaggtgggaatgggataatcatcagatgctttgctagtgctgacgggacagcttagaaggtataaactgagctgggcccatgcagcaacaccaaaatatgtgttcaaagagggagaagaggagaaaaagagaaaggaagttatcgtggtctgataacagggcatgtcagaatgggaaagggtgttaggaattatgtagccaacttgtttgattggaaagataaggaagcctcaagggctgcaagtgactttcccaaggtcacaaaactaattggtggcaaaaccgtggtcttctgacttgtccggtttcctttcattttatcctttgagacgataaaggagaggacactaactaaacaagaagacaatgatctgatcaggacaagaagacttggagtacaaaatgagaagaagataatagggtaatggattttttagtggcacagtgggaaatggcgtaggtgtttacactgcactggagccctcactgtgcttggaactggttccctgtgcacagtcttgcacacccatatttggtatttttttatcctttttgacttaatgagcatttggaaaccataaggcccacagcaacctgacctttgacttgcccagactctctgagcaattttgtgagttgagtcaacaatcaatggttttcaaattattcaattgttcactcaacgcatactagttgaacaccaatatctgtgctctgctaggcactggggataccactgtagacaagagaggcatagtctcctctctcctggaacttacagtctatctggaagacagacagtaaacaactaatgatgcctttgtttaattacacttgtggtaagtgctatgaaggagaagcactggatcttgtgagagcataatagggagatctcatctgatttaaagcaccagggaaagcctcccaggacctgttggatgaatagcagtaaccatgtctccaggatccccacaattccttgaggacccttgttgtcagacttctcagagctgtaccagccctctcactgtctcaccattgggtcttctgagtaagaaagcaagaaaaaaaattttactcctcaaaattctgaaagcaagtggtttatcatgtctgccctgtaatagtggtgggaagaaaatcatgagaacctctaagctgactcaggattttagaagcacacatttggggagaagggaaacaaaaattctggagaagcaaaaagtgtcatatggtatagaagttattttaagctactggggaaaattcataatttacttagggatcttgagtgtcaagcattggtttagagacaaatcttatccatttcgttgaaagttccttgatcttgtggctgaagcttgggcctagggttttattagtgtacatttaggggatggtttacagggtgtctttcaaggtcatacaggtgcctcttttggggtcaggcaggaggaataggacaaactctgggatacgaatgtacaaccatttggctcctagggcctcagtcctttagctccttgcttctggtgacttcttggagacaagagtagactttttcagaacagcgagatagttgtgctgacaaaacaaaaacaaaaacatcatttaagatgccttcagatgcaagtacatgtcataatagaaatatttaaaaattagtagagtataggcactagctaattcaaatgcttggttgtaaacaactatgtcttgtaaatgagaataaagtttattctctcaatgacgatgataacatctttctcactcacttttactcaaattggctttattgggcaggagagacagagatggagttataggtatcatgattgaacttaagctacaacccatctatgcatcaaaccatcatgtgtctcgtgtgattgttatctgttgtgtatattttggtatatccctatctgtacataccagctgaatatttctgtaagtaacagaacaatcagctctcataaaatattacctcccagggcaagaagtctgggatgattccaggaagtcaatgatattatcaagactcaggtttatttttccaactttcaattctgccactcccagtgtcttcctgcaatttagcacccctcatgttcctaaactaaatcccacagttccaggcatcctaggaaaaaaaaaatcaatatttagcagcagaagaaagagtgtatattcacaaacatctcttctaaaattggaggagcggctttttgggaagtccttaattgacctctccttatttctcattggatgaatggggtcacatgcccacacctaaccaatcactggcaagaagagcttggaccacagtgcttgacttagaccaatcatgatccacccactggagctgggatttgaggtctcacctgtcctgaagcacaaattcagggtttctgaataaaattgcacttcaggtagaatagaataactttttttgcattggtaacaatgtgggctacaatgagtaagggagtccatttacctgctagagttgtggtttgagactatttgggctaaggaaagaaggcaaagctaagtttttgtgcctctgtgccacaccctcaacctttttctgaaaagacatgcctcatgggtagagctcacatgggggacacactgcagtttgaggtttagatggtctgtggcttatactcaatgataatacctaaaactttatcctttcctgtcttctacaaaagagaattatatcagggaataatcttaaatctgttataatttacaagaaatagccagtcttctgcacacttgagtactttattattagaaactcattacttgcaacccatctcagcactgttggagctacaccatgcatgaggaccgctgctctagagtcatccattaaaaaagaattcctacgaacctgaatgagcatttctttctctaaattatgagatgatgaccctcaagggaaatggccgtcttcccttttctactgcactcttagagtgcattaatgtgtgtgaagtgttttcggttccattatctaaagcagccctcatattaacatcgtggttggcattactggcctcctgtatgggatgaaagtttaatgacttctgcaaggttatgaaaggtcaagatcacagctaattagtgcaaattcaggatttgaattctagtttctaccccagagctgatgtccatgtcaccatggacatcatttgctcccaatatacctgatttactttcaaggggtctggaattgactattggattttatattaaaaattgctctttcataggcaggaaaaagtccttcctaatagtttgagtccaaagcttaagggtctagcatctcaactttttaatgaacccaaaaatgaacaggagggttttctgagccagtcccctgcctccacacagttagctcatgaatccaacatcatgggaggaagtcttcaggattttgtttcccattccttttttatcacctaaatatagttaaaggatttgtgatgactgcatccagagatgtttaaaaatggacctgaaggatgtgattgtgtcttaggcaggaagggtgccggttcttttcagtatctaatgatgaacgatctaaaggaaatggattctaaaccatttgattctaaaccaaaatggtgtatgtttcttttgagggtgaatttcctgatcatgagccttgttgagcattagactggccggctggttcctaatccatccttcagttctcagctgcagtgacatttccttagagagacagatctcctttggggacagcacaggacttgagaaaaaaggcttccctttccactgagcttggctccaactacacctcatgtgtctgttacatttatcatgctgtgttgtcaacttgtttaatgtctgtcagtggctcatgcctgtaattcagcactttgggagcctgaggcaaaagacttactttgacagcagaggtttgcagaggttgctgggcaacatagtgagaccctgtctctacaaaaatatatttttaattggctgtgcatggtggcatgcacctgtagtcccagctgctcaggaggctgaggtgggaggagtgcttgggcccaggagtttgaggttacactgagctaagattgtgctactgcactccagcctgggtgatggagccagaccctgtctctattaaaaattaggaaaagaaatagcctgtctactctattggtccataacctctatcgagacagtgaccttgtctgctttattcaatgcctggatcttttcctagcacagtgcccagcacatggagacactgaatttggattctcctttttgaagtccccatatccacttcagtattggggtgattttgatgggattgtgacttaccatggtggatgcatcctgtgagttccaaactcaacttcttaaaaaaccttgtctatcatctatccatctatctgtctgtctgtctatctatctatctatctatctatctatctatctatctatctatcatctgtctgtattctatgttccatctatcatctatctgtcatatatctatctctatctattaattatctctatctttatctatttatatctatcatctatctgccatatatctatctctatctcttaattgtctctatctttatctatttatatctatcatctatctatatctatcatcttttaacctatctgtttctattggaataagagacaagtgcttgaaaagcagaggagagtcaatacacaggccacatcttctctcactccctccttcctcctcatagctgtgagccaccccagtccctgtacctgcttccttggctggcatcatctaagaaatcatctcttccacagtttcctgcaagggcatcaccccaagggaagctgaacacatgcaacatctgcccactcaggataagtgtgagggataaggaggaaacatttttcctctagagacaggactgttggggcaagggctggggaagcaagacatggatactccaggctacttcttgctggggctgaggggagtgctcggtgtggctcccctctgggacgtgtttagggcagctctctcgcctctgaaacaagcctcatcagatcatccccaggcttccttccgcatagtttctgatgatataggaaaggagcccgattatctgtttgagcttcctgttctttgtattgtttggaaggctaaagtcaacagccacttttgtattctgcattgtttgcgttgttaaaaactctggaaaactcatctggtttcttctccaaaagtagcttcccagagccctgggagacactcagaaataagatccttttcaaataggccagcagggaccagggtctctcagaaccagctttcctatcttcttccaaaggccggaattgagaaggtttactccagcccacataattgagtctctgggctgtcaaggacgcattggggagtttgcttctggtgtgctgggtgcttagaaagccgtatgaattgcagagatagagttgggttccagttctgccagtcaccaattatgtggccttaagcagtttacttaacttttctgagcctcaattttctcttctctaaaatagagttgtaatatacctatggcttagagttgtgtaaggactgacgcgatcacagacttgaaacccttgatagaacgactggcatggagtaagcattcaacagtcataattaaggtcattgtgatgattacacttggggcctctccattcaccatttgccccaactgtgttcctgctgcacttgaaaatgattccagctgcctctggaagattttcatcccatttctgggaaaaacattagccaataaactctcattgaatttggcagggcgggcacaccagcaagctgacactatgtgcatacaggcttcctggaacaactgttgctgagcaaatgaagcagcatggaatgttccgggaagcaggattattgctgtagctggtgaaagtgaactgggaaacgcactccaggtcctgtctttacttgcacaattacagtcaatccccaaggctgcttgtctcagcaggatcagcctcttcctgccttctgtcctggcagtgggtggtggggctggaggaagaaatggtgttttcctccctctcccattgcaattgtttccttacagtgctgttctctgaggccagagaacagaagggctctttccagaggcagtttaacagagtagcttccttttcattctgagaagtttggagtttcccagagtccacttcctccctagaagcgcaagcttggaatttcttggttgccaatgaggtgccagcttctgagtgcataaagtgtgtccatcgtttttaatcaattctctcatctccaaaaatacctttaattgcctttagctgcttagttctgctgtcctctaaagaaaacaagatctggccactcccagccacacctcagaagtgagtaaggcttttgcaccttttaataggagtatttacatgtgtgtcggtttctcatctgcttttaatttcattagagtgtgattttggactgttgtttgagatgaaagagcagattatcaaagtgcagatgattttttcatggtgcaaacacatcataaattagaaactatgagacccctttgcagcggggaagactggggccagtcatccaaggtttcatcttcctgtaggagaagggaaaaaaaacggacatttattaactatctgttatgatccagactctctactggtgctttttgtatatttattctctaactcccatcaacttctctttgagagaggcagcaaatgacaactgaataaatgaatggctgaatttcatcagagccagtttacaggcagagaaactgaggctcataaagcggacgtaacctgcctgagatgtctcagcttttatatggtggggctggaattcaattcagagctccttctcccttttaacactacactgcaagttcccattcagcttcatgggattaatcctgttcttctgtccctagaatggagccttgaaagttcaaggtgtctccttttcctaagaaactggatttttctggctccttgagaattgaggagctcaaaacaattgagaactcttgggaggcatcttcaggaaaggaggtggtggaaactttcctctcctcactctccccaggggcaatggggcctccaaggccatcaaagatcaaggtgccaggtgggggatgcctcccagcttcccattcatttttcagttgggggccactcagcagctcctcaggtgaggattgtctcagaactgaagaatggttcaaattggcccaagatgctgaaatttattgcagggatcactgggacagtgtgtagcaatttaggaggcttctctctaagggaatcagtagctgctgcatttctcttaattgaaaccactctttccctccagcttcgatggggcaggttctcatatctgcgtgctgaaaggcgtttatttggtgtattctgagagcaggatgctggtaacactttcttttgtgttttgccaattgtttctttttactggctagtccaccctgtctgacgcattcattataccataaccaccttgacaccagagtgaaatgccatttctctgcaggtaggagagagtcacacggattccttgagtgtttgtagcgtaagtgagaaagatatgtagccttcttctagaggcagagggatgggttggctgggacttagagatattcaaatccaactctgttcttgtctgataaagtaaacgaggcctctgaaggtaaagtgacttctgtaagtactcacagcttatcagtaagaagcctgatattaaaactccaggtcactagaccttcaacctaatgttcttcccactaaaccaagttaacatttattgtacaccatactaaatggcagacactggggacacaaagatgaataaggcatggtcccagtggaacccactttggttatatgggttaggacacttgaggcaggatcctccttagaatggtgttttataaagtctctctttctctttctctctctctcatctctctccaatctatcctctctatcaagagagaacacatgtaatgtagagtgagagcccatgtattggataattaggcttctggctcctaattatcaggaagcctggaggtcttgagtggttgtaaccaaggatactgaaagtggttgaccagttaataaagaattaagttagagtaagaggcactttacttttaagctgcctttaatacactttaatctttgagatgattggctaatatctgttaagtaccaggctctttgcagagagtcaggtcctttgctaaatgatttaggtatatttcttcatctaatactcaaaaagcaccccataaggaaggcattacttttattttactgatgaagagactgaggcttaaaggttaagaaaacatagcatgcataacatcccacaagagctcaagccaggacttggacccaagtctttcttggatctttccgatccaagccatatggttactgcaatctcacaatacaatgagggtaaatccttgcaatcaccagttaccagcaattgtgaagcaatggatggcatagatgtcagggggtcaggagagccttgcaagcgttcagagggcttgggagtggacacatcacagttgcactctgctgggcagcgctgtaagtctctgattggattttgccttgaattttttctggtcaagactcagaaaggatggatgtagcttcacttacaccaattctacccagcttgtgacccaaatggaactcttatcccttaagccaggtcattcagttgttgtagcctttgccttccaagtttcccttgtctaccctactgagtctgaattctaaggacatcttcttatggactgtgggaggcaaagatgaattccaaatcttatttaatctgtgtgctgggggggaagaggagtgtatttccttttgccaggtatctgagcctacaaaaagccccataaataagtaaaatgtgtccatgagttcataaaagagtgagccttagacatacagaccacctgtcaaaagagccctgtcattctctattatattatcctcttttattttctgtgtaacactatgagtatctgaaattaccgtattcatgtattaatcatttacctgtatactatatcctcactctagaggtaagctctttgagggcacagatcgtgtctgactccccagcccccaagattgtatctggcttgtatcaaccatatcatagggaaggtgctgtgaattgacaccttgcaccatgctttatggaaactaatggtgctttaagaggcacagatttcatagaaagagacccagttgttcccaccctgatggttctaggtctaggtctaggtcaccaatgtctatggtgaaagaatgggcttttgcgaggtatggtctcctgtcatgtatgagggtcatttatttaagggaaaaccaagaccttattttctttgacaactgcacacaagggtcatttgtaatgtccttcatttccaagcctctggatctttgcatggatcatgctccttaaaagaaggaagttatgtttggcctgcttcagctaagcatggaatggtaaagattttggtccaaaccctgtgacttgagttggatttaaaagcttgtcagaaatgagttctctggagcttggcatttgagactggcatccgttgttccagatgagatttcacggattgaaagctcaggaagaggtgtgaattacaagcaattagttcacagggcagttggaactgtagtaatcctggaaaccttttggcccacattttaaaaatatccccacaatccagcttctccctctgtagggcttctgcttgggaaagtttgtgtaactccccaaaacatctgaagagtgaatagcagtagtgttcttggactgcgaaggagaccctgcttcttatgtgcatgctcttgtgcacacagacagaaacacacacatacatgcacacacacacagacatgtacacccatgttcgctttagcatctgatagaaaaagaggaacatgaggaaagacagagattgagtcaccaacatgtgacctggtgatttctgagtcctctgactttgaaatcagtggaaatttagagctctactttgtcacttgtaatgctttgttgttgcaaataaatatttttgcagctgcatcacttcattgctaatatatttgaagaaggcaagataacctaaaggcatgaatcttgttctgttttaatccacctgtaagtcagtggtggttgtaaggtaaattgtaagtaagagctattggccaccaagtgccaagggttatgaatgatttacctttttttttttttctaaactgaaggaaactcatggttgttcctagaaaaacatgcacactcacttgcttgcattcggataagcttctttgagtaacagggaagaggccactaggattacaaggcagttagtgcccattggagtgtgactggcattgtgcaccctgtgaatcatagtggtggtatggggaaaggggtaaaaaagcatcaatctatggagtatgcgaaccagatggcatctgtcctgggaagaacaaatatccttcataggagaattagaggactatactagtcaggcagaaatccagtccattcatcaagcttttcctcttgctgtggtccctacagggtcagccctgtttaggctcaagcctcttaaatcccagtgcaagaccaatttctctatgaaattctccctgtcttctttggtctcatggctacttcctgggaggaaaaagtagtaatcagctccctccccccagctaaatgtgcatggtattagcaaattctaacccaagatgttaaaactatctgagaagaggcatgattctgcttcttgtctgtaccctcctaaagtcaaggtgcagcaaggagagagacatttgcatgtggcccctgagaaagaagagatttgtctgcctcaccccctgctggtgcaaacttgcacctctctcagcctcagttttcttatatgtatcaagtttcaatgatcgcaatagtacttatctcatgtgactactgtgggattgaaacgagatagttcatgtgaagtaccgagcacagagcctggcacacagtaggtactctattagtgttaatatcactggaaaacccagctgggggctcagcagtagaagctgccagagccttagtgttacagccacatccattaccccaccattcacatacatttcatgccccagggtgagaatccacatatcccaagcagagaggcacagctttggtaaactgagtcttagctaactcatgtcagaaaccaagtgttatcctggggtttgactcctggctcttgccacattcatagcaggatgctgagtggattgtactcagcctcacttgttgcatctgtgaaatgggggtgattttttgacttctcaaggtatagcatctattaaggcacatagactacaatctgacacaaattagcagctccatacattgcagaatcttttctttttcacttaaggagatgctaaaagaggcaagaggaaagaaaatcaaatttggagatgccgtgggctgtgtgttgaagttgggctctggtggaattggtggtgaccttttgcttctctccatctggatggctgtatcttcaaagacaacaagtcttaactgcagtttttgattgtataaatctggccaagtccactatttacccagcccagtctccttagagtaggattggaaactcaaactttgctatctcctctgcagagtgagcaagggacaatctttatgaaaaactttaagttgcaagatatttgtgttcttaataatgaagggaagaatacaaaaatgataatactaagcctggctcatggatagcatttttgcacaatatatttcatttgggctgcagcctttgagctgtactaattgctctgagcatctgtttgtatgtccgttgcatgggatgatttaccctcctaggtttccaaatgctttggagcccctggtttattgcaggacttactaagtggtggccatcgtcactttgattggcccctaccacagtattttccagacttttccaccaaggctcttagggctttgtggtgggtgccagaacaattgatggggtagggtgggtgctggaagagaatgagcatctggtagattgagtctctgggtctgcccttccaccctcactccagcccccattagctcagcttgattttcaaccacttgaaatactgtggttgtgcctaagacatcatgtcagggagagaaagaaacatctgaaaaccatcaatcttctctctgaatgcttccactggtcccatttgcctgttgacaacccaagttgaaaaggcagcaccagaggggaatggggaaaattagcagaactggaaaatctgagttgagatctgggtttaccaaactctccgtaagactttgagtctgtgaaacttatgtccattagtttcttcaccttttaaatgggtctgtagtacctaccctctgggcctcacaggctgcttttgggtgtgaaagtgctttataattggtgaaggaaactgctacgtggcaagaatagcaaagcctgatgtactttaatccattcggttctgctgagggtggagccccaatgtgtcttaattcatatgaggtttctgagaagctttttgagattttaatactgtcccaggtatgcacatcaaccttctcacttttatcccccaagctccaaaatttcataactttttatttcatcttgggtggcaggaaggcaaggtgtgcctgggggagctacagggagttattcaaggtcacataattagcttataattaacagagtttaggctagaaccagtgcatcccactcccagatgggggcccccggcttatctcagcatgtcagcaacccatgaatcagccctgaaatatagatattacctatgagtaacagtttctcatcctacctcaactgttacgaaagtcttccctcaaactaaagctaagcagttccacaaaatgccagctatagacattagcagaaactgtatattgattaggtgatgtatcagtcattgtaactacccagaaaaaaaaatacaatgacaaaaccaagtggcccaaccttattttctacttgcaagaggaaaaaccctatttgggccccaagatgcttttttcatttcatttaccacatcctgggtttgtgctagtcaatctgctaaatcaataagatccgaaaaagcagaaaacaaagatcgtgaggccagaggatttcctgatcaccatggcaacacacaggggtgggtactgtggtttctctgcctgaagacgcactcgtcaaagactacttggtgttacagaattctggtgcagtgaagcaacagttctgggacatatactttcttttgccagaaagactctgttggatccaggaccaggagtggggggttaaacagttctccataccctcacctccaagtccccatcatcccattaggagacagggacagtactgttctccaaactctcaaaacaacccaagagctttctaggctgtgcattgggttgatcatttggtggccttggctgaagggccagggtaacagctaggagaacccttgggattcttctccaatgtgacaggcccctccatgttggttcagcgttgactgccatgacaggctccaggctccacggaaaaaaggcagagaaatcagggggtccagccaggcgccaagacgttggggtgccttgcatttctaagtgccaagtgatgaatagctcagttgaaagcaacccagggcacattctggaggaaattctctgggtatgattgtgcatgactgttttctctgctcattaaaccctcatctgcctccagggcaattccgggagagactgagtcactcaagactcatggtctgcactgggcagccaaaggcgattcggccaccaagtgtgattctggcctcattcagaagtggatgctaaacaatacaccctttcaccaggagcccatcacatgggcatcaggagatgggggcgagtgatgtgccagccttctagactggcaggcctggggggcagcagagggcacaatagctagaaagactcccagatgaaaacttctgggctttgaagccttcgaacaaatgaagaagaaaatgacttcttcgtgtcctattaagacagtgagttgtggcttttttgagagcagcttgctcagacctcttatgaaagatagatcagtagcaacagcactggtgtaggagtcagaaatctgcaattatgaaccactgagttttgtgtgtgtgtgtgtgtgtttttgtttttgttttttgtttgttttgttttgttttttaacttgctggaggaccatactcggctatccttgattttattttctcctgtgtcacaagagaaattggttagaagcttcccattgtgcctcctggctttaaaaatagataatccaattaacaataatgctttaaaacaacaaaaccttgtccttttcccttcctacttctgatcagaaccagctcagtaagatttattagttgtgcaatctgttttggacatgagctcagcaaatcagaggacagaaatagaatcctggctttttaatgataaacactgtaaaaataaaaaatttggagagcttaccagtgcttctggctgcccaagtggtttgtgtgtggttgactcccaggagctcaatcactttgggtgcagtccacccagagagctatgttccagctacatcaacctggagccttagcttggtcagtctagatttttgggtttggctgcagacatctcgtaatgtcacaaggacagcctgtgtccttggtgacccaaccctgggccaaccccaagtcctggagtcctctcctaagagccctgcctaattgtagagagagcattcaggctgtaaagggcaggaggcctgggggctacgactaggtttgggctttctaaattcccaagagtatgatgggaagaccaacaggcagaatcagagagaagcagtcagcccactgctggggaaagccagtcaaggtcaagacttcagaatctcctctctggagagagagtgaaaattccattagtgaagtttgttccactgaagccttaccaggccttggtaaaggcccctatcttgtggtccagaatcaagggacttctgatcttaaaataatattcaataagctcaaattcttctctctagggctctcttttcatgatcacctctccacactttattaaaaaatcacatgaagggtaagtgggcttcctgtcatttcagtgtctgacctgtgcataagttggaatttaacactggaaaatgatcagccagattgcccagtctgaaacccaggtcccccagtgactagcacaagttacttacatcttctcaatgaatcagttacctcttgtgtaaaatggggataataaaaatgcctgccacacaggattgttaggaaaattaagtgaaatattaggtgtaaagtgctgaataccttgaacccagactaggcactcagtgagtgctcactgtggttatggaccaggagctgcaggaattagaacaccattgagtagcaggaactggctttattctcatcttcatgataaagcaacttctccttacatatagcttaatctggaaccaaaaatctaattctgcctcatccctcctgaggagatgacaaatagggatcaggcacacctgggtggctcaagttagaaaacaaattaactcattttgcagaatctggagacgtctggtctggagaactgacagtgccctctctttgggcatagtatgactgtaggttgtctttgggtggtcttcatatggaatgtactgtgtttgccatgttccctaggagatctggcctcagaaatggccctgtgatggtatgtgaacatactgtcctgtaactgagatgatagcttgcacattcagacagacaaagccagttacaaaactaaaagttggtctctgaaacatttgctttcggggaaaacagcaaatgttcacagaagcaaagttctgggttaaagacattttaagtatccaataaggaattctcagcaaacaccagctggtgattcctcagatatgatgtgggaaaggaacctgataggtgatctttttgcaccctataagactgcagcctgtcgggggttgggggcagaaagagagcatttattaattcattatttcattcaacatttgcctaccatgggaggctgtactaggtactgggaatataattgtgaagaagggagacaccatttctgttgtcaacgaagcccacagagaagttccaaaatttcagaatgctggaatttctggttactagagaccttgaagataataatttcttgtaattctttacctggttgtgtcacagactttgaaaaccaatgaaaaccagagatgttgccctacctaaacacacacacacacacacacacacacacatccatacacacaatcttgcatataatctcacaggtccatggatgtattgaccagctcctggattccatattgaaaatcccttgcagcccagctccaatactagtaccaggccactcacctctcaggaaagtttgggaagacgtagataatggcaacttgggtgaaaattacacagtgctctcttcccagcacatgttgtgattttctacaacttcagaaataactggggtggaccaagaagctattattcctcgcaggccctacaatctaggcaaagctttgaaatgtgctcggacaattttatcagagatctattttccttgatctgaggcttagggggcagtatagatgagattaatggcatttgggatcagtgatggtttatccaggagagaatgcatagtacctgtaaccaggagcctgaataggaggcaacatagcatagaggttagaatcctgactttcccacttggatgacattgggcaaaggacttcaccactttgtgcctcagtttcctcatctctaaaatgggtttagcaatagtgcctacctcatagcatttttatgagaattaaattagctgaagtacataaggcacctaataagtgtgcaatgctcattggctctgattattaagtgtcaaacaccatatcaagtgtttgacataccttatttcatgtaatagtcccataaaccctgacaggttcgcattgtcatcccatcaaggaagaggtggagagtcagagaggttaagtaattaacaacctgtgtcacctaaagtgagtggcagggtcaggaattgaaccaggtttgaggaggtcctaactaggttgaactactgaccttcataaaagtttggcactacagaccagctttataggacaaaaaaaccttctttcagagctcctttttctcgccttcctgacagctccctagcagacctcttcccatgtgggtagggagataaggttcctagacactgggacactggtctccatgacccctctgtgctgcccacagccctatagtaatgagcgtgctaaaggcctggtggcatttctaccacgggaagtctcctctccaaatccaaaagtggcctcaaacagtcagtgttttcagttgagctcatttatcgctcagagggaggcacttgggacattttattcattacatgatgcaggagatttattggagaccagagggctcaacggaaaacattcttggtttatttccagccagaaaggcttgtttgagagatgcaatcagccatttagtattagcttcttgaatcaaagtggatcctgaatcacagagttctctgtttctcaggagagacacacagacatctgaggagtcttgcctctctatagtggtttgcagcatggctagcaccattgccagagacactggcactctgtcaagcaatgttctgtggtccatggctattcacatcttaaccttgccttaattctacttcattgtgagtttgggcatgtttctttatttcttcccctctctgtgtgttagtttctccatctggaaaatgaggatactaatattacccacctcataggaatgttttaaggataaaatgagtaaataattctaaagtgcctaaaatagagcctggcatatacacaatgaatgcacaataaatattagccactgctcttgctgttggcattattaatatcctcccgggtaataatttgggtttgcgttagtatcaaggaaacctgatgaaatgtcttcataaattatcagggtttgaatgacacacagccttgaaaatgttggctccttttaagtcaagagggacctagagtagaaggattgtgaacattcacaggatagttgaccagaaatgaagtatttgacaccattcttgcaactcctaagtagctaaatagcgtcagggttaggagttggactttctcatgagatcaagataaatgtaagctgtggaatttttactttgcataggatttcttcatccaatcagcagccctttgcagatacctacaatgtgtcagaacctgcttaagccttcacatctaggaaggctaaaggttgagtttgtctgtttcatcctgtcttggctgatcacatgcacatacaaccacacactcacttgcatacaaacatataagtatgaggagaattcaaaatgttcatggaaaaatgagattaaaagataaaagtttaaagatgtaaactttacttctcaacataagcaccatcacattcaagatactgttataagctatgatagcggccatttagtccatccctaaagaactgagggtcctgggaatttaatcacatcaatgcaatctttcttacattgttaactaaagaaaaatgggtgccctttgaagatttttaaagattaagtaacaaaaaaaaaaaagtcagaaggagtcaaatttggactataaggtggatgcctaatggcttctccatagaaattctcaaaaaaattgcctttgtttgatgagaataatgagcaggagcattgtcatgtcatgatggaggaagactctctggtgaagcttttcgatacattttttcttcaaaagcttgggctacctttctgaaaacactctcataattagcagatgttatcgttctttgaccttccagaaagttaacaaacaaaatgccttgagcatctcagacaacggctgccatgaccttggctctacactggtccacctgctttgacttgtccacttttgctttgactggaccacttccacctcttggtagctattcctttgattgtgctttgtcttcaggatcacacacataaggccatgtttcatctcctgttataattctcaaagaaatgcttcaggatcttgatcccacttgtttaaaatttccattgaaagctcagctcttggttgcagctgatctgggcacaatggttttggcaaccactgagtggaaagtttgctcaactttaatttttcagtcagatttgtgtaagctgaaccagttgagatgtctatgatgctggccattgtttctgctgttaatcattggtcctcttcatttaagtcacaaataagattaatttttttctcccaaattgatgtggatggcatatcgctgcaggcttcatcttcaacatcatcttgtcccttcttcaaacaagttatctgtttgtaagctgctgatttctttgggacattgtcctgatgaacttttcataaagcatcaatgattttttcattcttccacctaagcttcaccaaaaattttggtgtgtgttcttgcttcaattttagcagaattcatgttgctctgagagaggatcttttcaaacatgtcttatccttgttagtgcctcaaactagatcctgttcagatatatcaagttagtgagagtttattttggtgcaaaaaaaaaaatttgaaatctatgtatagttttttcatagcacgtatttttcatggaacttttggaagacccgtcatatagacacactcacacaatggatgcatgtattgtcagtgaagttatgttggcttctgaaactcaagggattttgctgaaactcatgaaactcaagggattttactgaaaagtctcagcctcaattggttcctcttacatttgcatattctgtctgccaggtggcaaggtagaattgactgtaataagaaagaaactaccattgagctccaattattgtccatgcctcagagttgatttttaacctgagagtgacagcagccacctgggccaggggcagacaggtagtttgcctcacctggaatcagaggctcccctatcagccttatcttcaagaagctgataggaatgctttgtttttcttttgtgtgctggacaaggagaggccccggaaggtctgtcatgtagattgacagtttccttttgtaagactggccaactgaggccaaagttgaaaatgtcagtaaaaacaaatagtattgcaaaagggccttatgcatttccttctctatcctctcattgccccatcagccgagtgctgcatgagtggcttaagagaacaccattaggcttgaaaaagagtgaactgcaaaaacacattttctccatttcacctagttgttattttccccccatgtgctaatgatgcaaacaaaagaaaataaaaataatagacattggcttatgtcttttcaagttccatttcttgtttcttcttttactattttcagaatcaaggaagataatacagaattttaacagttttcttacctcattttgcatttgttagacattgtttcctcgtggttgagacctgcttcctgctcaggaaagagaaagcagtggttgcccatacaattcaataataatgactctttgtcattatttaacagttgtttaggtgtgcctctctcctttcttcagttgcactaatgatagaaaaggatccttgggcacatagtaaagtggttcaaatcatgggtttgggtggtaaacaggtctgagatagatttcctgctctgccacttaagagctgggtgacgttggggagtcatttaatttttctgagcttcacccataaataatacatacatacataaaactcacctttcaggtttctgaagatgatgcaacacagaatctcaaaggtactgggtacccagggacactgcagtaataggtcccctctcctattgctgtcagctcagaaatacagaacagagcaactgggattcagaaaggagactataggctctagatagaggtactcactcacttccttgggcaactcacttccctgagcctcaactttcttgttggtaaataagtggaatcttcctacccaccactagaactgtgcaaggaagagatggagctggttaatgccagttctgtctgattccagacctggttcttaactaacaacaaggagtggtgcctggccaggcacttggggcattgtcccaagaggatgtcaacatgtcttcttagagaaggacagtcattgaggcctgaggaagtgttcaggaggaataagcttcaccaggatagtttcaatgacttaaccctttgcatgcagtttcctcaagtgtaaaccgggggtcatatagtcccaggagttttcaattacagcctttgaagtcttttgagattgttacacaggatcaagtagaagaggatgatttctagctctctattggaatttcagattaatgtctacaaaactcactaaagtccttgtattgaataattctttacccaactgatagcagttaggcttcattttcaatgccattaactctgagagcaaacgacaggcttttggtctgccaatatattaaaagtgtgtttctgaggaaatttcaatgagtcattcgtttatataacaaatacttgttgagcatctactttctattgggtactgttatagggattagagataacagctgcaagcaagtaaaaggcccttgctttctcagagctttcattccaggaaggagagaaagagagtaaccacacacatcaatagatgaccaggctgttgtgaagacacaaaagccaaatgagttgagggagagactgggggttagacaagggtgtttagggaagcactctaaagtgaggtgacgtggagttaaaattctgaatgataaaaaaaatgaaccacctatgtgaccatttgaggatggaacattccagacagagaggaaggcagatacaaatattctaggatgggaaggagctcagaatgtctgagagaattgaagacaagctttgtgcttagagcagagcaagctactttgaggttagagagggagccaggagccagattatgttggttttagccataataagaacatttatactgggtatgaacataaactcttggaggttgtaagccagggagagatcacttgattgtgaaaaaatgctcataacataagattaagtggaaaaatgactcttaaatctagaactgtatattcagtaccatttcaattatgcaagcatatgtgtgagtatgtatatttgtgtgtatgtgtgtatgtgtatatagatacatactttatgtatatatgcataaagtacgtgtgtgcatgtgtgcacgtgtgaatgtgtgtattcagtaaacaaactggaagaagatatagaaaagtgtttgctgtagtttttgtagtggtggacttattttccttcattgctttcctgtgttttgtaagttttctgtaagtttgtatgacatcaataatcaaaattaaatcatttgctttttaaaaactttgttgcagagcaatcaatggagagaatgtaagagtgatattattttaccatgtcttttctcagatttgagcttaatatcatggtgctttggaatgctggagtgaattttgaaggctctggctagcagagaagtttatttggctttttgtttgtttgttctttttttttttttttttttgagatagagtctcgctctgtcacccaggctggagtgtagtggcatgatctcggctcactgtaacctctgcctcctggttcaagtgattcttctgcctcagcctcccaagtagctgggactacaggcatgtgccaccacacctgactaatttttgtatttttttttttttttttttttgaaacggagtcttgctctgtcgcccaggctggagtgcagtggcgcgatctcagctcactgtaagctccgcctcccaggttcatgccattctcctgcctcagcctccggagcagctgggactacaggcgcccgccaccacgcccagctaattttttatatttttagtagagacggggtttcaccgtgttagccaggatggtctcgatctcctgaccttgtgatccgcccgcctcggcctcccaaagtgctgggattacaggcttgagccaccgcgcccggcctaatttttgtatttttagtagagacggggtttcgccatgttaaccaggctggtcttgagctcctgacctcaggtgatccacccacctcggcctcccaaagtgctgggattgtaggcatgagccaccgcgcccggccttatttgactttttaaggagtctgtcctaaactgaacttattactgtctccaaattatttatgcaaaagaatctaacatttctatttcttcccatagatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtaagagaccagcacccgaccactggggaaagctggcggcctgggaccaggcagctgggcttagaactggaaggctcctttcccacagctgaatggattattgcctaaggagtcaaccccacgtattaatttggccaagtcaatctgcaacctgtatgacaactggagtttaaagtcagctaaagacacctttgtgaatcatagagcgggaacccagaggaagccattaggggtcctctcggctggaatcctcttgtctaacctgcttccacagagctctcctggctttgaagaagctgcagtatcattgtcagaaccacaagaaaacataaaccaaataacagtgtttgaaataaatatgtggctgttagagtcttggccctgcagacttggatcaaagcagacttttcaaactactctctcttactctctcttaaaaaaaattttttttggtttctcttctatgtttctctggtttgaaaaagtaaataaaaaggcatgaaagttattaagctatattatattaagatatattatttttgggagccctgagagggctcctaccagttattctagagctgcatagagccttcctcaaactatggctccaagcaagataatcacaacaagcaaggactttattttttgaatttccaatggccttgcggtaagcggtgcacaagaagagcaagccacggtggcaatcacagtgaattgttgtggttcgatttgttttcactagaagaggactgagtaacctctgcaactgctctgaagtttctaccccagcctgtagctgtgcttttgcagtgtctttaggtaatatgattcccctttctctgcaacacacactcacatgcacacagactgcttttgaaaagtcaagctgcagaactctacggaaaccatgaagtgtaagttaagtgcttctatcctccaacactgggtacagtcatgcacccacattatgagtgatggctgagactcttgctgaaagggaaaaggaaagtcttttgcctaaaattgccctgtctgatatggtagccactaaccacatgtggtgacttacacttaaactaattaaaatactaaaattaaaactttagttcttcactagcactaactacattttaagtgctcggttagtcaccgatggccagtggctactgtactggatgacccaggttagagaacatttccatcattgcagaaagttctattgaggagcactgctctaaaataaagagcagatgtacatagacatctgtatgtgttcagagctaggtctgggggaatatgaaaggagcagagagagggagaaagctctggtggctactgaacttgcactgtaggatgcaatgaaaaaaggccatttagcaaatccattattctattcccaaggctaattgtttaattatggccctgactaggccactggcctaagaaagtgaatttagtaagctgaactttgattgtgaaatacaaacaaggcatacttgcaaaatatagatatgctgccatgtgctgaggaccaggggagttcttacaactgccactggccaatcatcaagcacttagatgctgggagccctactgcccacctggccaaacccctcacttaatcctcaaactgcagtattggtcaatattatcacctcattttatggatgaagcagccgaggcttagcgaatttgcacacacagcctgcctatggaggagttaggattctggttctgcttagcctcagcccaggacaggattttaatgaccaagtcctcctcaggggcttaaaaggggaggaaagtatgcttcctggatttgctgaatattctttcctccttgtgaacagtaacttactcatgccacatacacacatataaactttaatatccccaatttacagttagcatgacccataaaaccggtaggcaacatgaggtggcaaaaactcagtaatagcttacaaagagaatgcaatagattctagaatgttggtgttatccatacttgatgacatgatgtgatgggggtgagttggtgggtaggttcaccaagaagtattatttagaaaaactgtgccaaagaaatctatcatttcacccataactggtattaagtattgcaaaactcatttccataatttctctcaggtagctatgaatcagctttctgccacaggacagatggcagagtctcatgggttaggataaaaccttagcagctactctcttttgtctgccccaccctgattggtagcaactcttagatatatgaaaacttattaccatttaattgtgcccacaccccctgccaagctaaggaggctttggggaaaccagtttgtctgttcagatgagaaattagtcatgcgagctacaattgccacataggtaggagttctgtgtgcttggaaacttcagactcacagacatttccatgggtcgtgcagggtgatgcactccatgctgttgcccctggcaggaaagatgaaaagcatcaatgtgcattttagccagaattgcattttgaaaaacctgctggatttagcttcctcctctctgccctcctgctgcaccacagcttcccttgcacatggcattttctcagcccacatctcattttttgaggcattttatattcaaaaaaaattgtgtttttagcacaattaaaaaataagcaagtttttagccaccaggatgctgctagaagaggctgggctgtgtatgttgtatctgtatgtcgtatccagctgtaacacactcccagagataccttggtggggagagaggggctatgcatttctctggctgtgctacttctggaaagttcctgagctacatgagccgttgctatctgcttacttaattgctatgactcccattgtaatgatggttaatttattcccactggcaatagaattatgcctgcaatgctcaggaggcagtgtgctgtgctgtgtacttggcatataaacaaggcttcatgtttagggcaatggagtatggagtaaggggactcacaggaaaagttgtggctgagaaagaagtgggggaatgggacatgaggcaggtctggaatgtgtgcactgaaataaagaagcaccccttcctatctatggaagctggccattttgtgtattttctggaaaacatgaaggtattccagagccagcatgaatcttacatcaaaacttctctcttctgtgactcaggcttccttctgtttgttcaaatagactcaacactgctgaacacaaattttaactgaaactaattattcctttcatgatttttttttaaagctctttataggtctctaaataaaatcactttgtttctatcagtcttgttgatctctttccctctctatgctgttatttttggatttcaaataactcggttgttgaaacctccgatatccctaggggtgaactgaatgaagtgttgcacggcattaaatgtcattgaatgggatattatgaaattcccatcttagccatttaggtcaatatcctgttgtttttctcttacaggtatgggttcatagaagggcacgtggtgattccccggatccaccccaactccatctgtgcagcaaacaacacaggggtgtacatcctcacatccaacacctcccagtatgacacatattgcttcaatgcttcaggttggttctcaggggggtgtctgttggcgtgaaaggctgtgggagcctggtctttggagctcagcttaagtggggattcatgtagcctccatttacataacaaatgctcactgaatatctgtacagcagagccaacattcctgtctccatggagcttacatgctaaattggggaggcaaacaataaacaaataaatattaaataccattcaggactgtccaatcttttggcttccctaggtcacattgggagaagaattgtcttgggccccacataaattacactaaaactaagagtagctgataagctaaaacacaaacaaaaatcacacaaaaaaaatctcataatgttttaagaaagtttacgggtttgtgttggaccacattcaaagtcatcctggaccacacaaggcctgtgagccgcaggttggacaagcttgccctatatgaagtctgaaagtgataaaagtgctataaaaaagaaagcaaaatacgaggctaatgagtgctagggatgcttttattttctgagaaggtggtcagggaaagtgcctcctggactgttctgagaatatcagtgctcagaagggagaatgccaaggaataaagtcagagagctaagcaagggccagctaacggggtgattcattctcagtgtgatgggaagtcattacaggttttgaataagggagtgacatgaatctaatgatagctttggggtgtaagtcaaatgtcttagctgagaggtatttattatatgagagggctggaaaaaagccttggagagtatatggtatgcctttgaccttcttaaatatcccttacccaacagttgaaagaaccagagaagaagaaacctaagttaagatgtagatgctaggacacaggccagcctttctctatgtctttgtgactttctcccaaccattaacctagaaaatcaggcttatgagccttattcaagtcctagcaaaattaaagaattctatgcatcatgaattttcagaattttttgagaaggatcaaaatataaatgtcaaatatctcgatgccaactatcaaaagtcttacctcttaaactgggccttctgttcccatggaaggtttgaagttgggtgaagggaaagatgaagccttgaggtaaacttggtacatcttgctggagtgtcagttttccctaaagatgtgaaggggatgttaaattagctggaaagggacttaagacattatcagcctgagacaaacacagatatatacatatacatatatatatatttatatatatatttatttatatatatttataaatatttatttatatttatatatttatattcatttatataaatttatatttatatatttatatttatttatataaatttatatataaattatatttatatatttaaatatatattataaatatataaaaattatatttatatataaatttatatatatatattatatataattctatatataatataatatataatatatattatatattatattatatataaattatatataatatatataaattttatatatataaatattatatattatatataaatttatatttatatatatgtatatatgtatatataaatatatacacatttatatatataaaatcaagatatcacagatatatataccatatacatcaaatataaatatacatataccatatatatggtagtaaaatataaaaagctgcatggatttttaaactataaaaaggacatcaacttaattatgagatctttcttctactcactactaaaaaaaacccaaaaattaaaattaattgtgagattacatcagtggctttagtctacaccacctaccctttgttgtgtgaacagtagggatcagagtggaaattcagagaagaaatctagagtttaggacaaagtatcagggctggctagttgaaatggagtgcgtgaagccagtagattttgacaaaaatttacaggtcactgaatctatcgagagacatacgaaacaggaacagaaaactgtagaatgtttactcctccctgttatatgagtgaagaacacaaatggagtttgactaaagggaagggagtccaattaacactaagtagtacacgactcatacatactcagttcccatacccatgtctagcatgtcgttctaatgatattataatgagaaaaccacatataaaaaagtaagaaatagacatagagcaacatgtggtctagctagctccatctcagtgcaacaggtcagagggagacattgggaaaagcttgtgctttagatgaagaggttgactcattgggaaagggctggcatgaggctatacactcctgagtctctgggcactgcttattgcatctcccattgagtcttgctgagtgaatgtatgcaataaattatgtagttgcatacccacattgtcttacctgttttgcaagttggtttcacttgctaaaaggaacctcaactcagatagaagctcacactgttttattgcctggcatcgaagccatctaggcaggctgcgactgagacttgtttctatccttaattttgttcatgaggttgggcccatacctggagttgggagcaagagcattgattaattttcttctctttggagggttagttcagttgaaaagcttgagaagtacagggggtatgttccttactaaaatggatgaattaaataataaagctagaagtaatatttttccttttgtctattttccaaattgactcgatattgatggctacttttgtaagtttttatttaagtttaaagggaatatttattgatcacctctatgtgctcagtactgcactaggcagagatggagtaagaaagaactggaggctacatttcttgtcttaaaggagttaacaatcttgttgaagcaatgagacaaaaaaaaaaaaagaaagaaactggagaagaggataaatgtgtttaaggataaataaattctgaatgtcttggattagagtcagatgataggggtattaagtgagctaaagattttgataaactgccctatgcaaagatttcattgcaaggatccctgaatctaatttagcctgaaagctgctagcaggtggtcatgtcccagtgctgtgatcccccccataaaacggctacagggataaaagtcagcttgatcttagtagatagcttccataagcttaagttttagcagtatttttagaaaacatggcctgtggctaacaaatgaaaataaggcagaacttgaaaaggcctttgtgattttttttccctcattttcagtggttgaggcccaacgtgagcctggtgacttctgtgtgaacacagaactgacttgaattgattcatttattaagcttgctttcagtcaagtgcctcattttcttttgagggtagaattaaagggaagattctacatgtacttgtttatccatttcctcctttattcaacaactatttgagaatatttatgagatacctaaaatgtatcaagcattgaagagggtgcctttctatctggcaaccagagattagtggttagactgaataattaatgtttctcttggttattttggtgtgttgaagccaaggtttatgagaaagcccacctcagagaatttctaacaagtcctcagattcaggaacacctcaccaggtctagctttccaagcagtacagagctcattaaatggaaagaaaggctatctaataaggccctggaatccgacatgagagcatgagtctgttaattgcacatttgggtcaatccactaagcatatttgccagatttgatgttctttataaaagttaaggtgaattggagcatgaagggggtccatgtgaacaaatgctctaataatttacaaaactgtcttagggtttgtgacatcatgctccattctattacaacttgctgcctggaaattcccagtgtactgttacttgcagttatatttgaagttaggggagattgtttcatccctggcatcaagaagccataatccaaagcctggttccaggtatgcacaacatacaaatatcagaagcatctcataggttgcgtcagtttctgctgatatttccaagagaaacaagatagatactcccctaaatctcccaggttggctatatgcccttattttcaagtgtaataattttggaaaatatttttgaaaactgtaaaaagctaaattaatattaattattacagtcccccatgaccttgtgagtttatcagaagcagggacagaaacatgctcatcttcttttctccttttatatggtctggcatataagtgttgagtagatgcttaaaaataataaatgaagagttatatctgtaacttcctttaattatttcttatggcattaccatttaaggataatctaaatgcgtgacctgtacatatttggagatgcatttagggggctaacatcttaggtgtgtttactggaagaatagacccttgggaaattatatcggtacttttttcttttttcatccattcaacacatttttattgcatgtttctctgtccccatcacacataaatgttctggccaagacagataaagttattactcatctgtggagcttatacatttctagggagggaggcaggtagcagaaggcagagattgagagaagtgccatgaacagccatcaagtaagatgaacaagataagtttatatggtggtaaacatgaagaagaaatgagagcaagatgctatgtgatggtgacaggtgtgggggagtgatgaagcagtttagattggatggtaaggaatggcctcgccaaggaggtgatacttctctttaaagaaatctgagaaatcttttaggacaggctttgcaagaatggtgtttcctaaaactttctgtttttttccaattgaatgtataaaactgccagttagttccactaactgcccaaagaaatgggcaggttaaggttatcctttttatctgtgggaaaagatgctcccaggtactaggaagcaaacaaaacctgttttgttcaacttgtgtttctatccacttttataagtacacaaaaattatagcaggacacttaaaatacttgtgataacagcctttcttgtgatagcagtctgtctgtctgcctgcctgtcttcctccctccctctctccatccatctatccatccatctccatccatccatctccttcttcctctttgccaggagcaattctgggagaaactaacctaacaaataaatttccattttaatttaagtatgcacacacacacagaataaaagctgtaatgcacaaatggacttaacctttctataaaggcaaaaccagtttaaagctctctgaggttttagagctcaatacaaggtatagtcacagaataaagcactttggcatgaatagaaggttgcttcagctacactgcagtctgcttttaagacacaaggaatggaatgcagggtggaagtttcagggcctgttatcagaccgcttgagacagtgctgctcagagggctaccagtaacatctgtggatgatcagtcaggcccaagattcaggcagaaatctttattcctaaagcaagggatgaaagagtagaggataaaacgagaacaagagaaaaaaaaaaccagaaatgcccatgatgagatatgccaaaacagtaaccttgaaaaatattctgggcacctaggccaaaggtggtcaacctcagaagcaacatgctgagaagcagtctatacagagtaagcacctaaaagatcagctaaattaataaatacattattacattaatgaaagactagagattcatttggtttttaatatttcaactgagtaaattctttgttgtgattatgttattttaaccttcagattgtcatgctgttcatgttgataaacatttgattgtgtgtctgccatgttttctcatcatttctgtggacttcccagattataaatgattttctcatgatagttcatactttacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaacttcataagttccagaaatttatgaaatcaggtaaaaacggaaaatccatcaggaaaggcagagaaattcctagccaacttaggagtttcggaaaaagaaagttatttggaataagttatagtaaaactccattctaactgactaataaaaatgagggtagattttcctcatgtttttaaagggttctcatcctttttttcctacctcatagctccacctgaagaagattgtacatcagtcacagacctgcccaatgcctttgatggaccaattaccataagtatgtctctcttctaatcttaattaaattttcctattttggggaaagggctcaggtgtgttctctgtggtatatttgaatagaatattaggccaggtgtggtggctcactcctgtaatcccagcactttgggaggctgaggtgggtggatcacttgaggtcagaagtttgagaccagcctgaacaatatggcgaaaccttatctctactaaaaatacaaaaaattagctgggcatagtggcaggtgcctgtaatcccagctgctcaggaggctgaggcaggagaattgcttgaacccaggaggcagaggttgtaatgagctgagatcgtgccactgcactccagcctgggcaacagagtgagactccatttccaaaaaaaaagaaaaaaaaatattagtcatttccctaagactaagtaaggacagttggctttaattcagtgtcccttcctttttttctgcaatgacttgaaactgctctctggtttacactcatgcatcgttcctcaaacttcagtcatttgaaaaccactttcacattttttttggcatctctatatgtacaatgctctcatttacttgatatttttatttaaatgatccactgttttctaattaaaatacacttatttttaaaaagaaattgcacatggaaaaccaacatcacatcgtaaatagaaggcaaccttaataataaacttaaatgtaagaaaaattaaataatgttcttaatttgcagctgctgaaagctctgggtctgagtcatgttctctcttataaagagggattaataagtgtcaggtgtaggggcattttggccctaattagcaattttctgtttgatataactgaagtattgaaagataatcatgaaggatataaacttcctgatacgtgttttgacattgtttataccacatccatcttaaatcatcctgatatatgattatccacagatgtatatattcgggcactttttaaaaatagacatgggggtctcactatgttgtccaggctggtcttgaactcctgggctcaagcaatcctccttcctcagcctcccaaagtgccaggattacaggcatgagccaccatgcctggcctattccagcactttagaaatcagaaaatctcaaccagaactttcaaataggctaactgctaaccctgatcttacggcctctgagcttcatttaatgggaaacagtacagtgttgagaggtctgatttctgcttcctcacagctggatactgacagtgtgcacaggcatgatgttggcagtggcagagggatgagaatcttcgtagaccatacaaacccagccccacattgttatgtaaggaattgtccctgacctgtgccttgcaataggaaggggaggcttcacaccatgatggctacgacatgagatgtgctgtctcagcaggcctggtatgaaatcctagttccctcaccatgtgtgagattttagaggagtgactgatcctcagttttctcattcatataatggaacaacctatgagaatattcaggaaatttgtaaaagacactatgtctaatgtatgtccagcccatagtagaggtttaataaatgccctgtttctttgatgcccacagttctcttttgaagtccagacatgtaagagtgtggtcaacaatatttccttgtcaaatcctcacctgcagagattaccagggtgactgagaccttgattttttttttcatttatgtattattaatagttccacttgaggcttgccacagtggctcactcctgtaatctcagcactttgggaggctgaggcaggcagatcacctgaggtcaggagttcaagaccagcctggccaacacggtaaaaccccgtgtcaactaaaaatacaaaaattagctgggtgtggtggcatgcacctgtagtcccagctgcttgggaggctgaggcaggagagttgcttgaacccaggaggcggaggctgctgcacactgagattgcaccactgcaccccagcctgggcaacagagtgagactccatctcgaaaaaaaaaaaaagtttcatttgagcaagctaaatatgtggccaaaaagaacctttagtcccatcaatgcaatacagcagaaaataatttcatctaaatgcacacctgcatagtgagtggcccagacttgagagcagcaaatacttctagggaggaataatgaatgaatgcattcaggctttttcttctccaattcattctagtcatttgttgaaaccacagatgttgatcttcatgtatatctgtgcttgttaatttccaggttgaatttcacagagaacggcaaatgctcttctgtatttagacctgctggtttcctagccagaagtgggtgtttgcacaagtggacaaaacttgccccttaaaaaagaaaatcaaaatcttcatcattttgcagatgtatcttccctgctgaggctattagtctgctacttcaaatccttttcggaggaatatatggaattaatagcaacacattttatatgtacttcagaagggagagtagggaaacaagtgggagaatgattatttattgagcatccactgtattttgaatactgtgctgagcactttacttacaatgtatcacataatccccattttacaaatgaggaaactgaagctcagagttgccttgtccagagctctatgaagctaggattcaaacacagggatgggactctccagtacttccttgtttcctgcctcatccccagggtgtgtgggggatgggagggtgcactttcttagtgcatctgccactctctcccaccactggatagataggtgtttctcattacaaaggaaaatagctttgaagtcactatgttaaacgctaatccacatactcaaaatatgagctgtgaagttctgtaagtaccttttctctctcccagctattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtaaggagaataaatcactgtgcttcccaatagcaattccctggcaaaatgtctctgaccttcctgagcattgcacactcacgtgctgattttctcgtctctagacagctggaagctggtgatgccattcagggaggtgggctcttgtggttgtcagtaaactgcctgcattgactactactgcctaccttttttcctcatctataactgtttttcttaccttagcataagaagtgccatattggaagttttattttggggagagccctccttattctcttatccccaggtatacagtaacaattcaagcctgatatgaaaactgttttcattttttcatgtttccttcttgttcttatccacctatggataagattgttttcataaagttgggatcatagagtttgcataccactccactagcaccttttaaaaaacccacttatgcctgaggttgcaattttttgaatttttgcaatcagaccttggtgatgacaatgagcagtaggatataaataactcccacatgcttagctttccaataatggaacagtaggcatacgtgggtcaactgtggctttttatgttttaacttgatttacattcatactattgatagtgtaatattcagtgattttcaccaacgataatttactcaacaattcctttgtttttagtccaaggaagcatatctggaagagttttctggtgaaattaaatcagcttaagagctctataatccagcctgttggggaatgttctcaatacttacttggtgtgtgggggtaattcattacttagggttgcaagagtggaagtatgtaaacattgcgttccattcctttggagtttgcccctcgcgcttcagctccactggaaagtgtttacatctctcttgtctcctgtttccctctttgcttttcttctatggtttgttttgaaatgggctcccagatgggccatgttcctcctgtggaggattaatcaaactcaaatagggcatctgcctctggagcggttttcctagtatggtgtggatgttctcttttcctggctatagctcctgaggggtgaaacttgggcctccaaagagtgtggcagaaatgcgctggcttgtgaatactcaagacagggcccttctctattccttgtcacccagaagccagggaaacccccacagtactgtgatttcatttaaggtcacttgcgcaatagtgttttaaatttctgtcagtctctggctgagggcatgatacaaataggcttggggttcccatcactccctgcacattctttgaagctttttaaaaagcagagttttcaagctgcccatactttcttgggttattggccctcttgagtttgcatcggcttattgttggtagtcccgtgggcaacccttcttgagagaggcttctgcaaaccaagcgggccgtgctgctagctactcactgcttcttgggttccctgtctttttaaagtaaccatgtcgaaggtgcttatcattatggtaggcaattttgtcggatgttagcgaacacaataattagtggtctcagcaggaaggagaataggtctaccctaaagtaccacttcccaccaaagaagaaaatcctgataaaacataacttgggactatatgtagttaacattcaaaccactaatagcctatataaaatagtatttcatgtgtgttttaaaaacacacatttcattaacccctatagaatatctcttaagaactgtatcttcccttcctaagttagtcagcaaacgtattttgagaacctactacgtaccaggcctattagaatgcttgggatcgaaggataaacatagttaggaagtaatattgaagagaggcaaggattactgagatatttattcattcaatcaatatctgaggtcttctgtatgccagacactgctctaggatgctaggaattcagagttggacttaccttcatggagactacatattattggtttagaaatcagggaaaaggagtgtttatgagatttaactaaaacatagttcaggatttgagctgagaaatgaattgtgcctttctcctcccagataaattagttaagtttccttcagcagctaaaaaagaaagagactaatgagtctaccaaatgagtccagggctaacctgagagtcactgaagtactataggacccaatgggaccagtagcagctccaagtggatcacttcatgcaaagaaacataccaaggcaaacaacctggtggaaacttgaacgtagcataatggcatgccaggaaaagtcagcactgttaggttcctgagtagaatcgtatttctaaagtccagtgaggagatttgcaaaaccttatcactgttggactgagagctgggacagagtgacagggagtgattgcaaagcctccctcatgcattgcaggagggcaggggtcaagaggagtgctggctgagagcacagaagaagcggtctttggctcggctggctcattccttcctgaagggcctgtagtgggtggcaatagggacagctagtaagaataaccatctgggtagctttaggcttccagcaggctgtttatcttgagtgtcatcagcctcttcctattggtgacctggaactctctgggatcaagaaacctaaactaattcaggaagcagactcctgccttggaacactgtatttccttgtcttctgggtgtcaaaggaattctttcttttttttttttttttttttcagatctggtatggcctatttgggtggggaaaattagaaattctgctggctaggcagtagctttttccatttttccccctcataccactcctttcaggaagacaaaaataacgcctatttctatcttgttcttgtaggtttgtttcctctggtactattttttcctgttgtactattgggtgagggtggtgggaattatgcatctttaataaagtttctgaggtgagaatgtggtgtctgtggattttcccggggatgctcaggtttgtctggaggcttcatgggtaaaattggctcctatttctctactctctgttctgaactaatgtgtcctttgcagcaggggtgtccagtcttttggcttccctgggccacattggaagaagaattgtcctgggccacacataaaatacactaacactagccatagctgatgggataacaacaacaaaaaaagcttataatgttttaagaaagtttatgaatttttgttgggccacattcaaagccatcctgcatcacaggtggcccacaggctacgggttggacaagcttgatttagaggacagaacatactgtgccagctgttggcattttatatagatagagtcaaagtttttaacctagggttcatggaccttcagtaggttcaatggtagaccataaggcattctagaactatctgaaataatatgcaaaattttgagtgtgtatatgtagcatcacttttttgaggaaggaggacataacgtagattttcaaagggatatataatttaaagtggctttttaaaatctcagctggcttaaattagatatttatcctgatggtttttgccattccatttcaataagaaaacatgctggactcaagtcaaacttgagagtcgaatgagagattttaaattgcaaaatgttactgatgatattttctctaatttgagaaaagtctggaatttctctaactttggcaactctagtttttggtagaaacacatattgaattagaataaaaagtgacagaaatgatagatggatacctgaggaagttttatctgatttcgacactttgaacacattttctttgcaaagttcctgctcaagtatgaagtttgacctgaggctgatgcgtgtgggcggagctttgaaatgccagttgtcatcacaaactacctgggtacaatgctagacagatgtgaaaaatacacactagcaacccaaagataatccaaagataaatgcatgaaagcagtcgtttgaaatgctgcttcgaaaacctccagctcatggctcagtcgcccaatcaagtaaatagaaaatctctttccttcacaggttattaaattgctgcttgattttgctttgatcatgaattcaggggattcagtttgaagaatgagtagcatgaaatttatacccatgaggaatttgcatttctgatgttgtcctaagattgtgggagacattaggagtctggaaagataaaaccaggcctagattttcttttctaattatcattcaataatagatacagacatcatatataggcagaactgaaagtaaagatttgtagagggaatatcactaagtgatactttcataattgatccagttacttcaactgtgcactcaaacagccacgcaacagctcaggagcaaaataactagatatggtcctggtttggtaattcacagcctaagactcaggatctcacaacaacagcaacgacaggtaaactgctttgtcttttgcttatcagctctcctggatgtcagaccttttagtgttaggggagaggacgtccattatcacgtcaaatctccttcatcattcttagtgagaatagggtcttgtaccacttcatatatcagaaaggcctgtggatctggggatatgattgatattcttaaatgtcctgtatgttttccttttggcaatgtgtatatagaatcagaatgatttttccatcagaggaaggaaaaactatgaatcaatagttttgaatgaatgaatgaaattatgaaaaactacaaatgaatgaattgactgtgtgattcaatgagaaaatgtcctttagaaagaagtctgccggaaagtgcaggcttctcctttctgctgatctgattctcacagccagtaataagagaaggaaatgcagatttctctcatcaaagtgtaggccctgaacccttctttggacacttaaaatctcaactgtaaagtgtaggaaatgacctgttgctccatatcagaatctaggcctctaaccagctccctgggtgtgtggctcttagctctatatccctgcaaagtgtattgttacaggagctttggggaaaaacgattcaaggcctgtaaatatgggagattacaaggacaccctcatttattaactttcattgatggagttaatggccatatttcaaaataactaggcattctttctgcagagggggataataaacatggaaaaattattctttacatttgtttgccttatatgacattggataaattatattctttacttctataaataatcgtgaggaaaatagtgctcatgttatgttatggttgccatatcacaatgtctaagatcatgcaggggtggggaggggggatacagagattgcagaataaagacaatgctatttttaaatgttgacaatgtttatcttcataggacaaagaatgtgaaggaaaaggtctttttggcagtgtttcatcttcttggttcatttttgggctttcttgatagctgaaaaaaaaatctaactcaccttactattttgtttggggatgatggtttcagcctctctgcttgaacttgttctcagttttttgtctactgttagctcatattcttccaatgcacatttttgggcattattggttatagaaatggcagtctttggagatttttaaatcaagactcttgcttctggtcttattagcaagatcattggggtcacttcatctctgtctgtctttcctgattgattatcctattttcaaagaatgagactcaaaatgtcctgttctgctttgcaaaatatagtttcacataagaaattaccttgggcaaggttgtgagaggatttggaatctaaatggagaaaagtgtagaggcatatttttcaatcttctacttctatgtcattttccctgtgtgttggattgctaagattatgtatctattgctggcagaaatatcatatcctaaattcttggagaatgatattggttgcccaagattgtatagaagattaaggagctaggactctgaagagctgggttttagaatcataaactctcaggtttggaaaggatgttaaatggtctggttcaatcaacacttctaataatttaatctcttacacaactttcttgccaagtgatcttcctgactatgggaaacataatactttatgaagaagttcattgttggatagttcagattattggttttttaaatccaacatttggaagaacattcctcttcctgaaattttcaccacagatcctaatttggcctcatggatccagaggcaaaaaagtttaatccctcttttacattatatagactttcaaaattcaaagacggctgtcatgcgttcctggagccctcactcttgctaattaggcttctgacttcagacaggtcagaagctctgtccagcaaaatttttaaatctttaatataaggagcatgaaccagatgacatttaagatccttccctctctgacattctataaacttcagtttgagtctctgaaaaaaatggaacttttttgctttttccctttcttttcaccatctatatcaaatatagatgattctcttgagtagtaaaagagtacaagcatattcaatgctatttcttaggaaccgttaattaatctttcaacaatcaattcaatcatgattacaacagctttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccagtaagaataatcaattacagtacagccatttatgcaaggcttattgattaatctgagtgataccaaattgtatctctcttgagaagtagttaatgtgaaaaatgggtgaacctatgatcataccttagttatatcttgatgagattatggaagaagaaatagaatgttttgagaagtggggaaaatatctcacaaaatttctcttgtctcatgttcttcctgttttatttatctatgggatctactgctacagattgtctttgaatgatcaggctttatcagagaatgacattaaaacagtacaaaaaatgtacattgtgtacttactgtgctaggtgctggaaacacgaagatgaaaagagccagagcctttgcttttcagaagctcatggtctgttggagcaatagacttgaagaatgtgatgaggagggtattaattaaaagttgtaggccaggcgtggtggctcacacctgtaatcccagcaccctgggaggccgaggcgggcagatgacgaggtcaggagatcgagaccatcctggctaacacagtgaaaccccatctctactaaaaaatacaaaaaattaaccaggcgtagtggcgggtgcctgtagtcctagctattcgggaggctgaggcaggagaatggtgtgaacccaggaggagatcgcgccactgcactccagcactctaacctgggtgacagagccagactccatctcaaaaaaaaaaaaaaaaagttgtggaagttcctaaattgaaggccctaaaggcttaaatgatgggagctagaactcaagaattatcttagttaatcaaagcccagctgaggtcaaaggaacaaatccagagttttaacaaatgagctggacaccaatatagcagaaagaccttgaagggaagggcaaatgtcaggttagctttagcaagacattgccacttattaaaagcaaataatgaaaccactattggtacataatagtatccaaatttttgacaattataaaactttttgagaacaaagagatggaaattgagctttaaagatatccttaaaaagttaaaaacatgcaaaggttggtctaatattctgccagattactgagttttccacacatacctgtaatgacttaagattttgctgaacagagctgagaatcctgaacctgactccatcacagttctgcttttccttagaaaaaaggcttttggggtgctgtgtgagctctcccaattcactgaagttctatccattccattaaaatctgagaatttcatcctcaaatggacagagaagaaagggtccagaaaaaaaaatagcttaggccttgaaggcatctgagtatataacattgatatgacaaatactcaaaaggaactagaattttctatctaaacttttaagtgattttttttttagacccgacacccctccagagcttaatctatggaataagaaaattccttttggtaacttcagaacaaaaaccaaataatcaaaaacactggagttttacattatactgtctcctgtgttcagcatgtggcccagctttgcagatgggcccatcagtaaatacgtggtcttgatactgaagaaattaaattcccttgggtggtaacccaaacagatctacctgtaaatgaattgtatggtcaggcttcagggaaaaatttcccatggtgttgtttttttttttttttttttttttttttaattttttaaatctctatggcatatttttccaatttctgcttttctttttttttcttttctgcttagcacctatggacataattcaacatgatgccctctttcttctggaggggtgtgataactgcttgataataagcactttttcaggcctattgagaatgtggttaatgattctaaacttgatttttcataacttgtaaaatagagctgacagtattatagttctgaaaacagttttgcgttatttgggtatcaaaataaagtttgaaacaattaggatggatttgcaaataacctttcacaaaacatgttgactcagattttgtcatgatccttctgttaggtgcatctcttattccagccctaacagattgggtgacaatatcagggtgctggtggatgtacgcctctttctttccagtgtgctgctatgatggtggctggttacctgtggtgtcttattttctttcactggctatgaatggcttgctcatgacatattttgtatttgatgagaataccatagtgtttgataaatattcagaaatgtatcgctaaaacatatggctattctaggtattctttttcagaatcatctataggaaagctctagctgctcaggcattcctttccccactgaaattactaacaacataaagtgattatcatggtataactttcagttatctgcctcttcacccggaggatctacaaacagcacacagtgactaagtccctgggctttcaagtgcagagggatactacagactgcatggatgggcaaaatggcgcctttggttatcctcggtggagggctggtgttttcaaagctgtccttcctactgctgcagcttctttgactgttttatctggaagatctcatgttctgaaccccaaggtattctatgacagaatgcaaaggacactgagatgcttaccaatatggctgaattaagctgaagtcaccctccgctttccctccatttccatgcagccatctatacaacctggtatagatgattcattgcatagcctacagaagcaagactatgtgcgggacaagtggcgaaggctcaagaaataacatttttctaattgcttcaatcatcgttatcacagtttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaatagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaagtaagcaagatggcggtcggcagttctgggttagatgaattagtaaagacattccagcaatagggaagattttgtttagaaattggccgcatcttctatttccactcggtaatttcttttattcttagagcctgaaaagctgctaaacccgcacacaaattttaaaaattggaaggaaaatgataactcatcaggttgcccaaaggccaaaatgttttaagaagtagatctagatacaatttttgtgttaaaggttcctagaggttccatttgggtaacttgtgtgtgttcattgaaatgtgtggcaaagagtgtgttcttttggtgcttagtagtggaatctggaaagaaagtttgtcaagtgaattgatctttggaatccttattttctatgaagatctttgatgaatacagtgtcttttttgcattctgtccctgactgttctatagaaagacatcccttgtactctttagagcaaagttggtagctcttatggtcttcatttgaattctaccactgcttctttttctgtttttaagcccatggtaacttggggaaggctttgatgctcttactgttatttctactattatgaaaactcaggttttccaaaacaatctcaagttgcggcagtggactgtgagaatagggggccccctcactccccaaacataagaagtatgtgcttttcttcttttatctatcccgctgagatatgtctatcttatttggaataaaagtatttattttggaaaacagctttttagcatttttaaaatgatgacccaactgtcattctcacagccctagatacacctaatggggaaatgtgagccacttaaaagccacttaaaaaccaaagggctttgggaatctatggcttgaggggtgccttcagataacaaaagaaaagtttcaggtatcagttaggatagaggttagacattgtactgaatatatccagcagatcttacatcccattacaaaccccagtaggtgtgttgtatacatacggcttaggggttaagttaacaaagaagtctgataagaaaaggaaatacagaggaagcataaatctctttggaataggattttgttccactcccttagagccctaacagtataccttagaaattattttagacagtttgtacttaaagaccagaaagctactttagagacttggaaataatgagcctattgtcaaaaggtggtgcttgcggggcattaggactagagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttctatacagtcacacacatacacttccttatttcttttatttaaactttgagtaacatagcagtctatgtttgggtcagttttcccttttttgtaattacattcagtggtttttgtaacttcattatttattgggaattagtgatttagtcagtgggagttttgtaaaacttaagattttggcttttttccccctcctcctggataaccagttaacccaataatggcttggccgatggaagggtaaaatgaggacagttatattttttaaatgtcattactgtcaccaaatcacacatatcattttctaagataaggaaatacaaccatttttacaagttgcaaaaaagtactctggcttggcaagtttatagactctcattttcttgataaactaaaaaaaaaaaagaaattgctacaagctgctatagacaaaaatgttggtgtctttctgacttttcctgaagacaccttgatggaattatattctcttgattttgtcctttttaaaatgatggttgaaattttaagcctgtcacacactattatttatataatgcctcaaactggcttggatagttttcgtcaactgaattaattttgttaaaaagtgattttagcaattttaggtgccatgtggacatcaccaaatactgtgttagtggaatagcatccaagccatcccaccatctttcctgctgggcaaatccactgctggtgcatttccagtgtgtgcgattatgggttacatgaccaccatttgagaaggtctcctaatgtgctgatcttgttattagctgttatacagtgttttcctttcgtcaaaatgactggagcaaagaggttattctttgaatggttttctcagacagggtatgtgaagccattcactacagtaaaataaaaataataataactcatagaactatgagaattcatcagctatggtctgcttagtcctatgattttgaacaaatcaaaacttctttggaccacaattttcctagctgaaaaattaaacatttggatcatttgatttctcatatcccttttagaatatcagtggcctgtttccttggtgcctttcttttctaccttccctccccatgtgtatctgcccttaaagtagaaagatatgttgacagctattggtgaggaaaatagacaattatgtctcccaactgatattcttctcacagtccaggcaactcctagtagtacaacggaagaaacagctacccagaaggaacagtggtttggcaacagatggcatgagggatatcgccaaacacccaaagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatgggtaatagcctctgagatttttatatattatgttttttgaaatccactgagtgactgctgactatttttctagaaatatgcccttggttttagaccaaactactttcctgaaggacctgaggttcttcaaaaattagttttcttggtaggagtgatactcatattcacctgaatatgaagttctgagctgaaagtaaggaatttagcaggagggttggcaaaagaaaaaacttattgtcaaaatatatctgtgtgaggcagtaagtaatagatatgaaatgaatgttgccaacaataaacgctaaagaaattctgagaacccctccctgcccaccacagcatcacagaaaggtgaattggacttggtttatgaaaaataaaaaaaccctggatagtcagagaaaggaagtgggtggtgggggttggtggggggggcagttttcctaagaaggagactcctgtaaggagaaacgtgaaggaagaaaagccaaggaatgaatatgtcagtgagtggatccatttttcacaagggaagatgtgtttgaatggctaggcaggggccattatgttgagtgactgaagtaccacaggcagacccagcacacatgagtttgcacatggcagctggagctctgaggacacccatgggggaaaaccaagccaggcaaagatcttcagaatcaatattaattctatgtactgatgaagagaaagagattccattaaattaatgaacatgtcaaggacaatacaattggcttcaactacacaatggtatgatgactcttgaaggactctacttataagagggaagatgaacaagagtctagagcccatcatcaagtgggactttttctgggagaatgtccatttgtggttttgattcaggttagcacttgctcttgtttgaaatctgggataacagggtcaccacatttttgtcctacaaagatctttaatattttagtgttgaatatttagtgttgaatcttgaatatttagtgttgaaaggctgcagtgcagacctgggtacccagtattctggtgcttcactgggactgattaaatctcccccagaggcagtgatgtggatagactttgactgaattgacagccagaaatatcgatggggtttatgaattgtttggcctctgtttcactcaagacttcttatttcagcagagtagatctgtgataactgttaaaaacaacatttacaagtatttcagtgaaatttctgcactactcaacattgtacatgttaaattttaaagaccgcttatacttgggtttttgggaagaataattcaatgacgtccactgcttcttatttcttgcccctgtatactttctgtaactccacctaggtggtcttggatgacgattctgtttatttgcatattcactttgtgaagaaaaaaagactaaaggggggaagagggctatttttaaaagtccctttggttggtaagggggaggggataaaatggtgcctgagccagcacactttgtcttttctccatgtgtcagattgcatgtttctataaaaaaggcaatgtttctgtctctctgcaagatttgggtgttccatcatgcactcatgtggagtccttccagactcagcaaaaacaaacacacagcatagctttcatataactcggcccttcaaggaaagccagttacttgttgtggtgctctttgatgaaacaataatctatctcagttcgggagatatagtcagtatgtgctttctttcctcttggccagatgtgaatatttaaaaaaatcagctgtagaccataagccaccttcaggtagtggtttgggaaatcaagcaataacactaatattgattccttcagatatggactccagtcatagtataacgcttcagcctactgcaaatccaaacacaggtttggtggaagatttggacaggacaggacctctttcaatgacaacgcgtaagaataacgatgctcagccactttattgacttgtattcctgcttcatctcttactcgctattggccaagatgcagagctttggtggtggaatggtgctatgtggcttacttcagcccagagtgtgaaactgtcttcattgtctgtatttcttgtggaggtctctcaacctgattttcccttcatttctttgtgccttccagatttaatgactttgtgttttaagaaaaagtaggactctattcaactccattttcattctctaagtagttatgtcagtgaaacacatgcccacttccaggatagtgatttctctatgttttaactgaccatttcctttcaatgtccatctttcctccagccagtgcagaagaggggtaggattgcttgcatggttgtaaaaagacatttttggggccagataatcctagagatcacatcagttctcagaggagaggcaaggcatgttattgacaatcaacaaaggtggcgggatccctggaacaacaacaacaacaaaacattgctagtatctctttctatcactaagaaatgttcaaattctagtagccttaatttctactctatgtgcagggatgtcctagagatcagcctaaagtcgttcataatttctttgaggaatacaaaagaaatctagaattaagaaggtcccattttactgcttgccacacataatgggcagagtccttcatatgagccctttaggcaaaggaaaaaaatcagcaagcatgtattgatggtcagcaatgtaaatagcacagcgttaagcatcaaaggagatgcaaataagcctatgaatggtccttgccaaagaaggacttatatttccgttttatgtcactgttggcttttgttctgacattgggtttgggatttagtgactgtctttctcctggttgtaatatttattcggtggtgggcatggcttatgggtgtgctttatgaagtttttgcacctgcaactcaggtcagtacctttcttaaaagaacacaaaagaaataaacttgaaacagtccaagtgattttagatatgggcaatgggtcaacctccagttgatatatgtcactgagggccctgtgtttgcccaggcaagcgtttccttggtgcagtgatgaaaatcccaatgcacaggtgaaattaagaaataacttaataatggagtaaaatggtaactttaatttaatgacctttacaaggtagctaagtatttccttgtataaatttgatctgtgttacttgagtaggctattctagataggcttctttttcttttgtggttacaactagactacaggctatcatagtgttcattttccctgccgtcacatttcttgacacacagttaggtgcttttggttactgataggagcattgggattcaaatattcttttttccatgtctctgtgttctctggttttctggagtgactgggagcaatgctgcaattgagcctggacaatccaggataggcaaagttttggctcagtcttcaccttgccactttacctttgatgattatactgagaaataaagggtcttcagaaccaaataggggcaaaatagaattcttctgtatatttctatcaatcagaggagaattgtgtgcacaaaccttggtcttcctatgcacctatccatctgactctactctagctagattttccttgctagcagataacaggatttgtaccgtagcttcaaattaacactggattcattcctcattgaaacagagcagagtaattctcagagcttctctacatcacatgaaggcttggaagaagataaagaccatccaacaacttctactctgacatcaagcagtaaggattataaaacctagttggcttcagctattgataagaatcaatcaattatgggtacttttgcagtgtctttggtggaggtgcatccattagctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttctggaaaagaaaagaataattaaattagtagcctcaggcctttgaaaccatgcatttgctattttaattgcaggcagcaaaattttatctttcaatccaatgatatgtttcctccactacatcaaagatgaatccaattgagaaagaactcaagattatctagtacctcagctgacttcaagatcacagttgtagtgacatagccttacctaataacccaagcagatgttgcaacaaatgccaattctgggtattaagatcaccaaaatctcttctgttgagtgatgtccaagtagtgtctattgcaaaatatttattctgttcaatagtatgacaaacttcactctatttctccctatttatggataacaagtggaaagcttttgcagcaattgtgtgttctggagacaagcacatggtgggtggtgatcttacaaatacgggttcatcactgattccacctccacacagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaagtagtcgaattttagcaattccgtttaattcgactaatatactctacttattttgtaaggttttatcctacaggtgaataatttctatatactagtatctttgctctgaaattattatcttgttttggtaatagattgatcagttttacttttggtgatggataaacctcttctagttctgatgcacacttaaaatgttcatgatttaatctagtattaatgaatagggaccacttctcttattgtaatagtgaagagaggaacgaagataatttattcaatgaagtttgacacggacctagaataagtctttttttttctcaaataagtagtcatctctgcttctgcttttctttgcttctccatttgtattaagaaattaacagtgaagaaaggggaaatggaaaacgcccactgtagtgaagaaataaaaaacagattctgtcttcctagtactagtttttcaattgctttgtaacacaatcactaggcatattcaagattagagactttagatacataattttggagcagagatcttctctcctccccccaaaaaagaaaaagaagaattcatatgtgtgcatatatatataatttttttttttgagacggagtttcactcttgttgcccaggctggagtccaatggtgcgatcttggctcacctcaacctccgcctcctgagttcaagcaattctcctgcctcagcctccatgagaatccaatatgtaaaacagatgacggttgtgatgcagggacagaaaattcagaatgccacatgcttggcctcatttctctgggtggcctacccaagagcttcaagaaaaacagtttaagaaaatgctaacttcagcaatattggcaagacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaatttaattttttttttttaaagagtcttgccctgtcacccacactgtagtacagtggcgcgatctcggctcactgcaacctctgcctcccgggttcaagcgattctcttgcctcagcctcctgagtagctgggattacagatgtgtgccaccacgcccggctaatttttttatttttagtagaaatggggtttcaccatgttggccaggctggtctcgaactcctgacctcaagtgatccaccagcctcagcctcccaaagtgctaggattacagacgtgagccaccacgcccagccatgaatttaaagtttaaatggcaattttaatagtcacagtaccctagaatgcttatagcctaatgttagtaaatcaaatgctttttacaagactgatattcacagacactgattctttctgatttccacagtggtacggacagattttccataattctccatggattagacaattaagtcacccaattctcatccttggttttcttcaaaaacactcacccacataaatctcatttatgtctatacatttttctcagtctttacgcttaatgttaagaactaaagcatttgttgaagcaagcggatcacttgaggtcaggagtctgagaccagcctggccaacatggcgaaacctcgtctctactaaaaatacaaaatattagccaggcatggtggcaggtgcctgtagtctcacctactcaggagactaaggcatgaaaatcacttgaacccaggaattggaggttgcagtgagccgagatcgtgccactgcactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgaggttgtcttaatctaaagctttctggtgatagatgtttgagaagctaggattatattaactagtcatgttgaaactacagatttaactttaaaaaattattttaaacttactataatacccatattccaatacacattattaatgttagctatcatctcaccatttccttttttacttattttcaattttttttgaaaataagtagttgacctttctctttgaatctttacatcattcaatcccaagattccttattgcatactaatttcctgccgccaagaaatctctgtttcatgccctaagccagagtatgcccatttgcagtgattatgtttctcataatccaattcatattgtccttatttaaaatgtacaatgtctagtctcaacctcatacctgcaaagatatcacaatatttttgttagcatgttccttaccacagttcttggatttctaccaaaacaaagtttctacaaaacttcctgtggtcatccttcttagcctttgctgccccagtttccttaattcttattaaagttctagctcatttatcagtggattaagcaatgaacggtaattaacattgtggacccattcaaggctgttttgccatcattttttggaataccttaaaaagactaaactttgtgataggctgtataagaatgcaaaggtaaagaaatgcagatgggagtgtaagtgaaaacatgcagtactgaccttcctgattgctcattacaggagaccaagacacattccaccccagtggggggtcccataccactcatggatctgaatcagatggtgagttcaaaactgctttagtcatttactgttataatcattgagcctaatgatgactaccaacgaagtatgagtcagtgtctccagagaagtggttctcaaaccttcttagcatacatcacaattgcagggagggcttattaaaccacaatgctggaccccacccttaaggttcctgattcagtaggtctggggtggagcccaagcatttgcatttctaatcagttccctggtaatactgacactgctgggacagggattgcactttgagagctactgctctggaggaaagccttgcatctgaaagcctcaggaagaattcaagcagtgtcccaatttaaccttgcactacaccagagtgattaagagcttgagctttgtagcaaaaatggcctgagttcgattccagccctccgcatattaactgagcaagatgctttaaagggtctgagacaacatttctcaactaataaacttggaataataacaattgtcacaggacattgtttcaaagactaaatgatagaatacatgtaaagcatttagcataatcctggcacatgatatcatcactggtatttgttgggaatttactgtgtgccagcagcatctttctaaacactttacatgtattaggttgggccaaatggaactgccattattgtaggtcaagaacaggtcaatatcggccaggcacggtggctcacacctgtaatcccagcactttaggaggccgaggcaggtggatcacgaggtcaggagttcgagaccagcctggccaaccctgtctctactaaaaatacaaaaattagccgggcgtggtcctgcgcacctgtaatcccagctactcaggaggctgaggcaggagaattgctcggacctggcaggcagagtttgcagtgagccaagattgcaccactgcactccagcctgggtgacagagcaagactctgtctcaaaaaaaaccaaaaaacaaaaaacaaaaaaacaggttaatatcagcaaattcatagagtttatctagtatgaactcattcagtcatcctataaactctgtgacataggtaagtactattattatccccatgttacagatgaggaaactaaggctcagagaaggtaagtaacttggcagagttgacaggaccagagagtgatggagccacctttcaagcctggagggccttgtattacttctcatagcacagtctggagaaggcattccataatgaccataattactcccaggcatgaattcttaaatagactcctgtttgttgtgattcagatcacacccctacaaaccttaccccagactgcaaaagtctgacatgaggtaggtttactaattacttctactgctgggctactgggaggttctgccagtgctgccttactgtggtctccctgaacatcataaatccaggtgaccccatgtaaatgatttaagccatatcaattattgtctcccctttttatgcccaagtttgagtgaggctcaccatcagatttaaatgtttacacattgaaaacaaatatgaagatggatatttacatggtggcttccacaataactctctatggaggagcactaggaggtagggattcattagaaatgcttctgaaatagagacagaagtcacaggttcactggggactttaggcagggcacttaacctttcccagactcagtttccttgttagtaaaaaggagatcaaatcatctgcctcagttgcttcctagagttattgtgaggaagacagggtaccagaagtgtgaaagtactctgaaaaagtagggagttattattaaggggcatgatctctaaaaccaagagaccccagccactctctaagtatgattctttaaccatcagagtggacatcacctaggaacttgttggaaatgcagaatccttggccaacccagacctactgaatcaggatctgcattttaactacactctcccacccaggtggtttatatgcacattaaaatttggaagcttagactgtgctagactgcttttctcaccattgaagccaattgaacaatctctgtgcatatgtctcagattacatgtcatctcccaacaggaatatcaagtgctcctctttgtggaacttgctactgtggccagtcctaccctggctggatttgtagacatctagggcacaaggcaagacctgctatctcacatccatcttctgtggcttttgcttgaagtgagaatcaagcagacaggagccagtctcttttgtttggcttctgagcaggtgtctattgttcaaacaggaggtttcatcttgctgcacgcacacccagatcttttcttgctgggagcacttcttctttttttttttttttaaatcaaaataaagtgattatgatccgttaatggcctctttttaaatatcaaaggcttctatgagtcagaaaagaaaaaaaaaaaaaagaacagtgagagtgactgtacctcctggggagttttcacggccaaagatcttcagtttaggtggccagtgtcccatgagttgggcaggtgaaaacctgccaaccaccaaggacactggaaggcatgtagggaaagggccttggactgttttggagatttgtaaagtcaaaggccactgtcaacataggataggggatgttgaaacacccagatgtctggtaggaactggttttgctcccttttaagttttaacaaaagcatcaaattgcataaacaagagccatcctgtccccatataaccattgtaatcaagatttcagtgtgcacagcctaaagtttggctccatgaggaaagctctcatttaagaccccaccattttcatccattgatcagccttcaggattctacagtgggcttccatttggtaggaaaaaaaaagttcattttggtggaacactttcaaattttgttttgaagcaatggaggaagaatttttaaaaattcatgaagctttcattttgatgaggctcttcacaagatgtcttagaagtttcttttttaaaaaaattgtttatttatttattatttttatttttaacagggacaggatctccctatgtttcccaggctggtctcaaagtcctggactcaagagatcctcctgtctcagcctcccaaagtgctgggattacaggtgtgagccaccatgcccggcttcttagaagtttcttttagaaccattgtgtctccctcatttcgataggcctccagttctgacttgaggattgtctgtcttgcgatacttcctcccagtttaaggcattttgttcatctccttattttgctttttagcagtagaaaatgttgattcttctaacaaggtgtgtttcagtaatatattagcagggactctaatagggtgatttttcatagtcagaaagggccactgccgctaaactccttatttatttattgtgaggtggagtctcgctctgttgccaagctgtaatgcagaggcacaatctcagctcactgcaacctctgcttcctgggttcaagcaattctcctgcctcagcctcccgagtagctgggactacaggcacatgccactatgcctggctaatttttgtatttttagtagagacggggtttcaccatgttgactaggttgatctcaatctcttgaccttgtgatccgcctgcttcagcctcccaaagtactgggattacaggcgtgagcaaactccttattttatagtgtttatgttggctcctatgatgctattggatgagattttcaggttccctttgggctttctggagcgtgtgagtcccctgggggtcttgttaaaatgaagattctgatttggtagctttgagatgaggcataagattctgcatttctagcgatctccccaggtatgcctgtcctgatggtctgagagccacactttgagtagcaaggtcctaaattaaaaatagaaaataacaaccacacacaactaccaataccgtgtatttcttcaaatctctgcaaaattatgatgaacagcattctgttatccccatcttacgagtgtgaaaagggagacttggagaaggtagattgacccagcacacatggctagttagcaagggacagcggtgagacttaaatccagggttgtccagctctagacaccaaagtcctgaacactgtgcaacactgctgctgagaattctcatgttccttgacacaaaataacattactaagccttagccttaatcaaatgaggtgggggggaaatcttttgtgtaatgctttataaacatctgcagcttgaatccataaatggcttctcagtgattcagaatgtggagagctgccctttatgcagctccacaaggaactcatggttacacatttcaaactttggttgagagatgttgtttttccccttaggacactcacatgggagtcaagaaggtggagcaaacacaacctctggtcctataaggacaccccaaattccaggtgagtttcaaactttgaggcagaaaaacacactgaaagcagctttctcagaatgtcccagcaaggacgaagagactcatttgaaagcacattctccacaatgcccaacatatgaatccaattgctcctctttacaagttaaaggatgaatgagaatactacaccctcttggtaggaaaagatggaatagtcttttcttcctgggttctgcaaactagctgagctcatactcagatctgtccctggcctgtcccagagaagtgccatgttagttactaaagcttccttcctaaatgaatgatcaccaagaggaccccatgtcatacctaggtcctttctatcccaatccaatttccacttatttctggggtccaaggtgaagcatgtaattttccttttacgattacagacagggaggagctacaagaggcatttatgttagatggagtgaaaactttcttttggttccccaactaatttttttttggtcgagggaccgcctgctgatgtggacagaataaacttttcagaaagtatgcatgtgcagtgaggaggctgggacacctggttctcctgagcatcaagacaaggcatttgttgcaaattctttatttgacttggaattaaaattgatttgtcatagagaattactaaagggaagggttctcctaaggttgtaaattacccttttaattctctcctcttcagaggtctccagactgagcctctcttggggaaagagaagaatgtggcatgcaccgttctcctttgccccagcttgcctaagcacacctgaagacagaccagacagagacaggggtgggctgtcccaagggagagcacaggggaagccttagctgtcatcaggcagcaagattcttcccagctccagtgacagtgcaggtgggatatctcagggctggaaaccagggccacagtgggcaggagtagaaaggaagaacagaaatcgggccctcctgtcagtctcccccacttctgactctacctccctctccaaactcatctaaaccaggaaaaggtgaggcaaaggtagtgctgagcaggaaatcagagataaaccaaaatttccaagaagaaaacagataatgagactttccatgcctcttctttctcaagccctggttcattgcacacatatacaacccactttgcaactgaatttagtggagttgtcaagtcatattttagtcctaaaagagcctgatttcaaaatgtgtagaatattaatccacaagtgatatataattattgaaaacatttgaaaaaatacaactaaataaaataatggaaatataaatcaattattatcaatctcaccatccagaaataccatggttaccattttaatatacgtctttttttttttttttttttttgagatggagttttgctttgttgcccaggctggagtgcagtggcgcgacctcggcccactgcaacctctgcttcctgagttcaagcgattctcctgcctcagcctcctgagtagctgagattacagcatgccaccatgcccagctaatttttgtagttttagagatggggtttcaccatgttggtcaggctggtctcaaactcctgacctcgtgattcacccacttcagcctcctaaagtgctgggattacaggcgtgagccaccgcacccggcctttcctgtcattttaaaatgtaaaatatataccaaaatgtgattacaccttacacggtgtttagcaaacattgcctactggttaaccatggcttccatgtcattgaatatttcctcctcatattgtagtgcgtaatgcaatagatgtaccctaatttatttaaccaatcctttattgcctccatttttgttttttaatacaatgtaaggtggataggtggatgctcttatacaggaaaaaaatgttcctttcaaaagaagcctacatttccttttatatgtttaataatattataccaaaggcatctacaagattcaacaagtcatcctgtccttttttagaaacatagttctcctgaagggacttgaaaatcctgactgatgataaaagattaaagcaagaaggctgttggacaaataccttcagcaaattgctcttccagaattacctgcctattggctggacctattggccagacccccctgcagcgctgactgtggtgcttgtttcaactaggtcaattataaagtgcatttttgtttttacaaagtgtgtctctgaagctcacgcatgtcatttaatttactcataccagaatggctgatcatcttggcatccctcttggccttggctttgattcttgcagtttgcattgcagtcaacagtcgaagaaggtaaggggctgtcctgggggctttcaacttggaaagggcatcatttaaacctgggctttatatccttgctgctcagagcgtagtccctggaaccagcagcctgggtaccctgggagtttgttggaaatgcacaatctcagacccaaccccagacctcctatggcagagtctgcatcttaacaagtttccagggattcatgtgcatggtgcagcttaagacatctttctctgccccggtttttagagacaggagacacctgtgattgtttggctcatcacttttaggtagtggttgaatcctttgtgattttacatgttttttagggttaaacctcatgcagactctgtctgatgaaagttatgaagtatctcaccaggaaggcacacaaaagtatatactcattcattgatttgttaaatatttattaaatacattcacaatgcacaaatatcgtataaagattcagtgattcatcatcccctgtagcctctctgaggcccagggaacctttaagaacttttaccagaaggaagtattggccttgtgcttttgtttgtcgtttgtttttttattggccttgtgcttttgtttgttgtttggtttttgtaatgatatcattttctattttctgggaactgtagttgaagagattcaggttatagcataagaagagcactgtttcatcgtcttcttgctgttaggaggtctatgaagcagagaagaactttcctttggaaaacaactaaatgaagacagtcacctcgctagaactgacacatgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagacctagagagaattatggactccttactggtttttggaaagcaaccaacagctaattccaacaccatgggcagcccatacagtctctaattatctgagaaaatcaaatgatgctgttacaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcctattgtgtgcaatcagccctttattgccaagccctagaatgcaccacttttgctcacatacacagtccataagctttgcacatgtcaccatagaaacgctggcatggatgctgtcgacatttagggagacctcggagaagcatctcagctgtccctaagagcagctggagtccatacattggggctgggtatctcccccatcgtctgtgtcttgtcagcagcagacagcagagaaggggcctcattgctgccctctccctcctcccaagaccagcagtcaccctggcaaccggcaaacagggacacacagggtccggcacagcgagtatctcaccaggaaagtagctgcttggatgccataaattactatgtcctgatttgataattgaaaacagatttgccacgcagctaaaaggtggtgaacagctgtacgggccccttaatgggctctgtgattctaaagctgtcaacccatttctaatccccttcaaaggctgaggcttttctgctttgagtgtcacatttaagagaaagagatacagaatcctattttcatcagagaaagtttggttgaaaatggggcctccaataggtgttcatttattcagcaaacatcttttgagtggctcctgtgactaccagccctggcaaggagaaagagaaggtaaaaaacaaaaagagtaccaccccttttctaaaagaatcttgaggtttagtggcagtattggcctcttgaatttgaattggctaatatttattgagaacattccctgtgccagacactgttatataaattatggttaaaagacaaaagtggaaaatcattagtctctgaagttgacatacaaggatgggtcatgggcttgcatgatgaagtgatctgtgagtcacgttgtcttaaagatgctgggttgggggttctattacttctttaggtttttccacccctgccatcatccaaaacagctttctttgctgttcctcatgtcacctgactccttgagttacagctctccaagagaaatcatattttattcccttttcatgagagcacataattattttaggagtcagttgggttgatagatactgcgtgaggctccagagaagattttcctttaaagaatctatctgggccaggtgcagtggctcactccatgtgcagtggctcactttgggaggccgaggcagtggattagttgagcctaggagttcaagaccagcctgggcaacatggcgaaaccccatctctacaaaaaacacaaaaattagccgggcatagtggcgcatgcctgtggtctcagctgctcgggaggttgaggtagaagaatcgcttgagccccgggaggtggaggcagcagtgagccatgatagtgccactacagcctgggcaacagagtgagaccctgtctcaaacaaacaagcaaacaaacaaacaaacaaaaacctatcttatttgtctaaagaggagaaaaaaacatgagaactttactatgttgcttgtacataaaagctgttcatcagccttcactttaatgggaataatcgtcttttctataaaccccagcaggcagtcacccacactccaatcagtaggtcttctctacgcatcgccataatttagaaatattttccttctcttatgctacagtctagctcctgcaatctgagctcacccaacctcgtcctgctgtctagaacagtgctatgcaatagaactttctgtgatgatggaaatattctatacctccactgtccaatatataactactagccacaactgagcacttgaactatggctagttcaactgaggaagtgaatttttaatttcatttcattgtaattagtttaaattcaaatagccaaatgtggctggtggctaccatattggatggcacagctctaaaacagtgcaaaataaatccctaaatatcgttaaggattgtcaggtagaagagtcatgagatcagttgccaagttacccacctaaatcttttaagataaattctgccatgccataaaagtatgttacctggcttctaaaccccagccagcctgccctctctttcctggtgaggtctcagtctgcctccttccacactgtgtgattgctgtgtgctcagctaatgcctgagatttaagggaagaggagataaaggtaagacacagatccatgaggatctctgatcttcagagtcagaagatccaagctgtggctgggcgcgggggctcacacctgtaatcccagcactttgggaggctgaggcaggcagatcatttgaggtcaggagtttgagaccagcgtggccaacatggagaaaccctacctctactaaaaacacaaaaattagccaggtgtggtggcgggtgcctgtaatcccagctacttgggtggctgaggcaggagaatttcttgaacccaggaggcagaggttgcagtgagccgagatagtgccattgcaccccagcctggttgatgaagtgagactttgtaaaaaacaaaacaaaacaaacaaacaaacaaacaaacaaaaacagaaaatccaagctgtgattcttgcagtgcagtgccataacaagctgtgaaactttggacaatacttcttggacttggtgtccagtttacataatgaagaagctgggctagatgatctctgaagccccttaaggtctagtgctccttcttaaattcttataactaggaataacttaaaaattagaatttgtctcttaaaagcacttattagacgcctagagcactgaatattggaatgagttatttatgagaatcatcctaccctcctgaaactactcagacagatagaaacacataaatccaaagggaaatgcaggccaaccaaaaaccaagcacaatattcctgtgtcctataggtcaaatgttatccactgtcaagatcagcttcgtttagattaacaacattaatccccacccactcccatgcacagacatattttttatgctcataaatcactttcccacaatatttcattccatccctcaaccacccattggttagggaaatgggaattactttaactagacaactttcctccaaagaacacaggggccagggaattggaagtaacacaagcagtattctaccttgagccttttaaatcctcttcatagtaaataataacgaggtaggtggaggcagccaggagaaacaagcaaaattcatttcatatggcttttgttatattaacaattatagatagcacttgaaagcttactgtgctccagatactgttctaagtgttaacccaaaccttagtttccttaccccgcataagagcaagaataacaattatttccttacccctcataagagcaagaataataacaatagactcatttatttagtgacagtctctgtttcaagggcttttcacaatcctatgatattgctactcttagtaacctggtattattgatgcaaaactgaggctcagagaggttaagtgagttgccccaggtcacatagcagtaagttctcaaaaccaggccttccgagccccttttcttctttcttttttccttttttttttttttttttttttgagacggagtcttactgtgtcacccaggctggagtgcggtgatgcaatctcagcttactgcaacctccacctcccaggttcaagcaattctcctgcttcagtctcctgagtagttgggattcagccacgcaccaccatgcccccatgaccggctaatttttgtatttttggtagagatggggtttcaccatgttggccagctggtctcgaactcctgacctcaagtgatccttctgcctcagcctcccaagtgttgggattacaggcatgagccattgtgcctggtctctttttcttttttgaaacagggtctcactctgtcacccaggctggaatgcagtggcacaaacacagctcactgcagcctcgacttcctgggctcaagtaattctcccacctcagcccccaaagtaactaagactacaggcacatgccaccacagccggcttatctttgtattttgaatacagactgggttttaccatgttgcccaggctggtcacaatctcctgggctcaagtgatccacccgccttggcctcccaaagtgctgggattacaggagtgaaccactgcacctggcctccaaggcccttttcttgaccatgcatcctgctggactccatctgtattcctggtccccatgaatctgtttcacagttcaagcatccttcccccaacccctcatcaagccttatgctagaggagacaggatctacctcctgttgaggaggtataatttttatttccccaaacaagagcttaaagtttatggccttggcagtcctacagggaatggtccatgatcatgaataatagaggctttgtcactattactccaaatatccagaggcaaagtgaacaattctgacttcatactgtttccaaatctccagagggctggcagcattgacagagccaggcagagcccaggctttggtcataaaggcctggatttgaatattggctctgtcattcttactttctgtgtgacctcgagcaagttattaaacctcttttggcctcagtttccattgctgtattatgggaacaatagctgctttgaaagagtgttgtaagaattacagaaaattacatgtaaaatgtctggtattcaggaggtaatctgcttccctgaatccccatcttgcttgtagttgtgaagctatgcaactttccttcctctaagcatagtctgactcgtatatgtgtagtagtgatatgttacaggaaagaggaagcattgcattaggctgggtggggtgaagcaatggacagtaaccagggaaaagatcaaggtcgtactcttccatagcaactttcttttgcgtttgggtcttaagtaatgtttgagaaaccttaaattaacgagaataatttgtcttatgttattaaacttcctatatcagggttgtatgagttagccaatgttaggaaaacatcactatggccttatacctctagaaaaatgttgttttattcttctcgatacattcagtaataatgctgacaaggccgacaaagtgttgactgggagaggaagttatgggactttctggaatatacaaatcagaatgatttacaatcatcatgttgatggtttatctaaatctgcagaaactgctaaaatgcttaaaagaggcaaacatttccattgtgaagtaagatagaaagagaatcagaacttgagagtcagacagaccagggtttgaatcctctttcttacttgctgagttacttgggggaagttactgaattttctgatccccaaggtttcttcacttggaatatagagaatataataataacaccggcttcctggagtcttagttgctggtttgcaaacttgactgtgcagagaagcccctgaggggttgcaaatttgactgtgcagagaagccacagatcctgggctccaactctagagttttctgattcagcaggtttggggtggggctgagaatttgtatttctaacaggttccaagatgatgcttttgctgctggtccagggacctcactttgaggagtgctggttgttatgagtctggttgttaagtgctggttgttagttgttaaagtagagaaaacccctagcacagtgcttggcacacactaaagccatcataaaccatagtgatcatcaatgatggtgctcagtaaggatgatgatctgatgcctgagtcactgcaatctttctgatatggtacattttttaaattattaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacag

SEQ ID NO: 37462 - DNA, 34438 bp, Homo sapiens
atggtggctgaggttgattcaatgccggctgcctcttctgtgaagaagccatttggtctcaggagcaagatgggcaagtggtgctgccactgctttccctgctgcagggggagcggcaagagcaacgtgggcacttctggagaccgcaacgactcctctgtgaagacgcttgggagcaagaggtgcaagtggtgctgccactgcttcccctgctgcagggggagcggcaagagcaacgtgggcgcttggggagactacgatgacagcgccttcatggatcccaggtaccacgtccatggagaagatctggacaagctccacagagctgcctggtggggtaaagtccccagaaaggatctcatcgtcatgctcagggacactgatgtgaacaagagggacaagcaaaagaggtaaccaggcctgggctgggaggaggtgggacttggggggatgatggggacataccgtcctgatgggggaggagggggacctggctttctcgcctccgcaggcctcacaccaccctggatgtggaaacctcagagaggttagggcacaggcccctttatgagcagcaacacaaaaacaaaactttagctgatttccgatcaagttataatttgcctcgtagaacactaatagactgttttaaagtgatttaacttgcaaaattatcgatgcagcagatttttttaatctacagattgtaaaacaatgttctataccttacagaaaactgtatattgagaactaagaacaaagccccataacacatcaacttcagggctaaatattcttcaaataaaatccagtatggattttatatcaatgtacactatgtaaatatgttctttactgaggaaccttagaaggaaactgaaatgggaagatggttcctgtgcttgaataggaagattgaattttcttaagatgtgagctttttggccgggcgcggtggctcatgcctgtaatcccagcactttgggagtcctagacgggcagatcacgaggacaggagatcgagaccatcctggctaatacggtgaaaccccatctctactaaaaaatataaaaacaattagccgggtgcggtggcaggtgcctgtagtcccagctactcaggaggctgaggcaggagaatggcatgaacctgggagatggagcttgcagtgagctgagatagcgccactgcactccagcctgggagacagagtgagactccatctcaaaaaaaaaaaaacaaaaaaacccaaaaagatgtgagctttttttatttagcacttttacctaagccaaataaaaatagcaaagttttagcgtttttaaattacacatgctgtcttttattattgtgataaactaattttttgtaacagaatggaaaaaggattgcttttccagatatcaaaatgtgcatgttatttatttccacaaattgtttactaacagctgaaaagacatcaatgaatagaacagaataggaaatttagaaatacccaaatatatgtaagaatttagcacttgataatggtgatgttttgtattatttaaaaaagatggattgttcataattcatttttggagaaaactagctagatttttatgtcacagaaataagagtatagattaaaaattttaaatatacagaaagagaaacataccagaagaaaacacaaatgcctatttatatatgcagatatatatatatatatacttttttttttttgatggagtctcattctgttgcccaggctggagtgcagtggtgtgatcttggctcactgcagcctctgcctcctaggttcaagcaattctctgcttcagcctactgaatagctgggattacaggtgtctgccaccacgcctggctaattgttttgtatttttagtagagatgtggtttcaccatcttggccaggctggtcttgaattcctgtcctcgtgatccacccaccttggtctcccaaagtgctggggttacaggcgtgagccactgtgcctggcctatatatgcagttataataaaataagctcattttaaaattgggcaaagtacttttttgcatatctaccagtgacctatgcacataggaaaagataacgttcctggtggaagaaggaatataagttagaagaggaatgaaatactgttttctatttaagttagaagaggaatgaaaggctgggtgcagtggcttacgcctgttatcccagcactttaggaggctgaggcaagtggatcatgaagtcaggagtttgagaccagcctggccagtgtggtgaaatcccatctctactaaaaatacaaaaaattagctgggcatggtggcacacacctgtaatcccagctactcaggaggctgaagcaagagaattgcttgaaccagggaggtggaggttgcagtgagccgagatcgtgccactacattccagcctgggtgatagagtgagactccatctcaaaacaaaacaaaacaaaaaggcatgaaatactgttttctatccacaaagtttgtgaggatgaagaacagtggtacttatatagttgtttaaagtttaaattgctacagcgcttcaaacagacactttagtggtaagaaccacattttaaaaatgttatgctttttactcatcaattccattatactgaaatatctttaccaaatagatgtctgtttttcttagtattgattaaaatagcagtgtatttagaagaacccatataaagatttcatgaacaaatttcagtgcatccataggatggaataatatgtaactattgagggtgtcagtagttacagagatatgtcgacgtgcaaagatgtactttgctataacaagtgagaaaaaagtcagtttgttacacatatacacgaacagaatctgcttgtgttagctgaaaacctgtagaaaatacaatcaaacttgtttctggggatttgtaagtgaagtttttccctttctcttatctgtgatttctgcagtgaacatctgaggttttagttaaggttcattagtaatgaaataatccttgggaagagaaggaatatgcttcttgcatagatgcgaataatttatcacattctattatttatttttctttctgtggttggctatcttctgtgaacttttaccctcttcagaagtagaggggtcgtgtttacctgttcctgtagattttattatatatacattttattacataattattttttcattatatatagattaacatgtaaaaagtatgaattatttcagttgagttatatatttatgaaaattaaaatagcaaatataaatgactgttactattggaaatgtattgccctactctacaggagttttctttaaaaatactgaactcccaagctgtgtttatccattctttcaatccatttagtcatcagacataagccagacacctgttatgtggcaggcatattctactgtctctcaggatccttccatctttgaaaacttcatgtttacctgctgggcttgagcaagctgagagatttaaaattggtgcattaggacttaatctcagttgaagcttttcctccctcctttcaaacagaagcatttctgaaggtagaaaatagtaaaagacaccccttaactgcccttttgaaaatttgcaagtcttggataaagactgttttagttgttttaagaactaaaatgtggtacataaacagcatggaatactatgcagccataaaagaaggaacgagagcatgtgctttgcagggacatggatggtgttgaaagccattatccttagcaaactaacataggaagagaaaaccaaatactgcatgttctcaattacaggtgggagctaaatgatgagaacacacagatacctagagggaagcaacacgcactggggcctatcagagggtggagggtgggaagagggaaggaagcaggaaatagaacgaacgggtactgggcttaacacctgggtaatgaaataatctgtacaaccaacccccttggtgcacgtttacctatgtaacaaacctgcacatccggcacacgtacccctgaatgtaaaagttgaaaaaagctccacaaatagtttcataaatccattttaaaaagagaacatttataacagtcttaaatcctaatatgaatgattggaaatacctgatgtagatatattgtataaatctaagtattgacaaaaatgagcccatgctattcatttgaattccaagttttctttggcttaaagtttattgaaaaccaaagtaagaattggtttattttagaaatttatttttgttttcgcctcagctttcttattccatggttcttttaagaactaaaatttatctaaatgctggtcatctgactggaaccgccccagacctgttataacatattctacttaatgtaagacaccagggattgtatgatgccccattattttatgtctcaataagagaattatttaaatgccgccaattatagtaaatcatgaattgtaagtggtatttcagtggagacaacatggagacaatgatcatctcagaatcactaaaatacaatgttagctgtaatatttaaaacacacctcagtgtaggtataattgtatcatctcaattcaaatgttgtctttagtggtatcagtaaaaattataatatctaacaattattgagctgttatttgtgttaggaactattctatatcttttgtgcagagtctcatttaagcattacggtggtttcctgtgagaaagctactattctcattcctattttattgatgaggaaactgagaccccaaaaggctaagcaacagctaggaagtgacagagcttcaagtaggattccagcccaagttgaatgtcatccaagggctatgctctttgtattcatataggctgctctttcattaatacagcgagcaatgagagaaaatagtgtgcttttttcatgggaaagttaaatgtttgttttgaaggcagagtaatagcaggctattcagtgtttgcaagtacatgaatcattaatgtggctgtagctagtgcactacaatttcctaaaaagtcttgtcactctcacaggactgctctacatctggcgtctgccaatgggaattcagaagtagtaaaactcgtgctggacagacgatgtcaacttaatgtccttgacaacaaaaagaggacagctctgacaaaggtatgcagtagccaactctatcagcgtgaggtgggtttgatttcaatacatagcataaaaatgagttttctgctttaaatataactagttggtgaaagctgtggaatgttattttgaattcctaagatttgtaatttgtttttggtctaatactgacaggccgtacaatgccaggaagatgaatgtgcgttaatgttgctggaacatggcactgatccaaatattccagatgagtatggaaataccactctacactatgctgtctacaatgaagataaattaatggccaaagcactgctcttatacggtgctgatatcgaatcaaaaaacaaggtatagatctaccaattttatcttcaaaatactgaaatgcattcattttaacattgacctgtgtaagggccagtcttccgtatttggaagctcaagcataacttgaatgaaaatattttgaaatgacctaattatctaagactttattttaaatattgttattttcaaagaagcattagagggtacagttttttttttttaaatgcacttctggtaaatacttttgttgaaaacactgaatttgtaaaaggtaatacttactatttttcaatttttccctcctaggatttttttcccctaatgaatgtaagatggcaaaatttgccctgaaataggttttacatgaaaactccaagaaaagttaaacatgtttcagtgaatagagatcctgctcctttggcaagttcctaaaaaacagtaatagatacgaggtgatgcgcctgtcagtggcaaggtttaagatatttctgattgctcatgaggcagaagtggaaagggaaaaagagagcaatcagaaatatcaaggccaatttggaaattaagtaatagagggaaaagaccacgaagaagttgtgtgtgtgtgtgttgttgttgttgttgattgatttgtttcctttgtatggtgagacaaggttctcttcaattttaaagaacgacacttttcagtttgggagagggagttagtgggttggaaactgaatagagatcaattttaggaggcctctgaggaaccagataggcagtgaacaggtggtaatgtaagaggaaacccttgagcagagggaatatcaagtaattaactgacttagtatcctattctggtagaaatggccaattagagtctcagctctgctttcaaatctagtgtgtctggatgggaaggtagaagataaataagtaacaaaatcaagttggattttgagttgactagaccctgttcttctcttactggggaaaatcatgtggtgttttcagcaaatgggtctctctcctactccttactctttttggccaaatcttcaaatgagaaagggaattggtcatgtgggtgagaaatgagactgaaataattgtctgttgcactagctttcagctagaattgtgcatcccagtaacctgaggaaaatgtttaaataatcaacaagtctaggctttttctgaatattttgatacagtaagtctaataaatcctggatatgtatatttgaaaatgtttccttgaagccaggcatggtggtgcatggctgtagtcccagctgctagggaggctgaggtgggaggattgcttgagctcaggaattcgagtctagcctggtcaacataatgagaccctgtctctaacaacaacagcaacaacaattttctcaaaatctggatacactcctgcttaagaaccactcaatacataaatgtaatatgtaaattcttatgtctcagaaacttaaggtatctctagaagagttggggttggatatgtgctgatttctttaaatctttcctttccaataacattaatctgactttttttttttttttcccccgagatggggtctcactctgtttcccaggctggagtgcagtggtgtgatcacagctcactgcagcctcgacctccccaagctcagatgttcctccaatctcagttttttttttttttttttttaagtggagatgaggttttgccatgtttctcaggctggtcttgaactcctgggctcaagcgattcacccacctcagcctccccaaatgctaggattacaggtgtgagccaccattcctggcctagtctgacttttatctctgtggttgagacattaaaatgaatattattggtagtatgtatcagcttacagaataatatcttttccttcctaccatcagttattcactgccattcagaaggtctttagaaatttgctgtgagtagtctttcaataagtagaggatggccctctcaggattttatgtctctttgttcagtcattcaagtgcttaggtcagtaagtcgttaagagcagagttttctcaattagaattgtagcaaattctaaaccattttttgtcaattgacgctgtattatggactatccagtgtgtctcttaagtatgtagagctttggcataatcagaatggcagttttaaacactaaaaaccatggagttattaagaatacagataggaattctgttaatttagtttcagtagtcctatgaactgatgatttagttaacaatctgggaaaattaaatacaaatagattttaaataaataaatgttggaaaattttttcaaatgggcagtatgagttttaatagcaatttttgttgcatgttggaggttgaacttttggtaaaacatgaaactaaagaaatactttacatgcagattcttgctttatacacaatttgtcttagggttgaggatatagagacaaaagatacagcccctgccctcaaggagctctttgtttagatgggaaaaatattatcatccaataacaccatgccaaatgctgagttagaagcaaagagccttggaagcagtaaatgtttaaagtgagtttttgagatgattagagttactgtggtgaggcagagaaggggtgtttccaagggaaggagcagcgtgtgggaaagcacagaagagtgagaaggaagcgactacattttatttacttcctatgcgtgtaagtccataagatcttatataaagtttccacttcagttgaggaatatgtacttttttgaattacataggtttttgctttatattgttttacagcatggcctcacaccactgctacttggtatacatgagcaaaaacagcaagtggtgaaatttttaatcaagaaaaaagcgaatttaaatgcactggatagatatggaaggtatagttctttcttttaatctgtgtgttctagatggatagcagtcactcaagtcataaatattaaattaataagattaatgtatacttactgggatatagtgatcagtatcaacacaaatcagttaggtagaaaaacaattacttggactgggcaacataaagatcagttttaataggattcatcttctcattatattgactgatgttatttgttatatgacatttttggttacatgatcttatgttagctaaagggatttcatattaatttaatgaagtttgaactttaacttttagtttactttatgactcagtattgaacttcttaaccctttctaatagtttttaacctccgtgtcttacatgcttttccactaaatatgctgtattaaacataaataggggttgaaaatccttttgtcttttcaatgactctgctttaagttgctttctttgaagaatattaatgttagcttatctctacatgacaattaattgctgttcccacatactgtgggttcaacagcttttttccttttttatttctagtgtattttttatttttatttttaattggtatggagagagggagtgaagatagttttaagtggatacacttttcctttaatgaaggcaagccgtaggtgggtgataaagagaaaagagctaggctttggattcacacaagactgggttaattcctaactttcttacttgctaggtgtgtgaccttggggacgttatttaccaccaaatatgttgtcatatatgaaaagtaggagaatatatccttcaaagttggctgtgcataagtaagaaagatacatgtggcatttaattcagtgcctagcacatggttattggcaccattaactgaaactcctacgactactattcttaccattattaatactgctttgagcatgcagagagctcttatttctcttaccccctagctgattttctattacagcatatcagtctagggaagctgtgacaaaatcttcacttaaatctttgtccacttcagataagtggccctaacattgtttcttgcccatcaaaggacgttaaattagtagcttctgctatgcaataccccactgagatgagaggcttttttttgtccctgtcttttaacctttgtggtattttagaaagatgaacacttgagccctcaagatgcttatgtcttttattgcatgtaaatgtttgattctgcacggacaggcaaggtcttacattggtaaagtatatcagattagctttaaaaataactttattacagttcctatctctgtcattttagaactgctctcatacttgctgtatgttgtggatcagcaaatatagtcagccctctacttgagcaaaatattgatgtatcttctcaagatctggacagacggccagagagtatgctgtttctagtcatcatcatgtgtaagtgtttacattaaaaggctagttaatgctaaattgaggtttaaaataattataacagttgcatcttacatatcaggtgagatgtcatagtttggttcaggtagttttcgcgtgtcagtgagttagtcccttgcatcagccagaaatcagacaaaaagcaagacaagttagaagtgccaatgggtgcaggattctttatctcaggacttttaagatctttatccttagagatcccagcattgttcatttgatccaagtgtaacacctatgcagggataaaaaagagtgtcacatctttaatttttctgattagttatttgggtcttgaaatgtccagtttagcagaaagtcttgtactgttttctggggactatgtcctacatactccttgaatttttcaagaaccgaaggggtttactaaatccaaggaagacagtcccttttatcaagtcagaaggaggaggaaaaaaaaggacattgcaatcattctgttgtttccattgattctgttgctgcattgttgccactcaaactggtcctgctgtcttaagatgaatcagtagattcagatccctcaagtcttcatggtgattcatacagtgactttcatgttttttagttcccatacctatgcttatatgctcagccattgttcccagaggaccagccccctgctctggccgctgggcatcctgactttatccgcacacaaagtgagcaaattgacccttccccacatattcagaacctaatgtggaacccacatcttagctaggaattagctgagaccttcatggtaagagatcctttgaggctgttgttggtcttttctctggcagatattagttgggcttgttctaaagggtgagaggggttcaaataatgtggcagaaagagatcagtgtttgtttcctttttgctaccagatctgtactgtgaggcacctttatatcctgtatagaaccttgggcagtagaaagtcccatatgaaccttgccctgagcagtggctcccagctgtggttggccccttgagtgatctgatttacatgataatgaaaatcgttgaagctacttccatctctagctcaagattttaaaatattttcaaactctagctcacaggaagccattgaagagaaatctcagaatctcaagtaggttagttggactcaacagagccaagccttgtccatgacgcatcactaatcatgtgtaaaagtagggctttgtgcttgcttcggcggcacatatcctaaaattggaacaatacggggaaagttagcgtggcttctgcataaggaggcagcacagatctttgaagcattccatattttgtgcagtcactggaaggtcatttgactatttgctgactagctctaaggaaatagtgtgaatcaaagcaaaatgggtgccacccaaatattgaaattgtgatttgcgcggcaaaaagagtcatataagatggtctatgagatgactttgagctgaataacgtgtttggtgcaaaatatattgttagtatgtatgtcgaaaatcacagaatgtcagcttgctacttctccgtggaaactaaaaaaaataaaagtagacttttggtctcccatgtcagctgtaactgaacatcaatataaagcattatcctaacaaacatctgctggctgagagtttgagtctgtagagaaggatcgttggtccaaaccaggtcttaacatccattggtttttctgcccttggcgtgattgatcaactccgtaatagtggacaatcacattatctactttaatgagatatttaggaataaatttagttacaaactatcacatagttgagatgcactgaattataagccataaggagtaggacaactaagaagcaaaattaggacttaataatatcttctgaaaactacaacgtttgcatattagaacctatgaacaaaatacgcattgggttttatttgggattccaagataatttcggtcataaagtttaggaacaaattattccattgctttactatttctctcagcttttaaaaaatgttatcttgttaaatctttgtaacaacctagtgaaataaggcagcaaagtcctcactttgttgaagaagacattgagcctaagagaagcaagttgtccaagaacaaatagttattcattatggagctaggacttatgcagagttgggacactttctattatatcaggttaatgtgagctaatttactgggtcacagtgcccttgatttatgagtatttcagcttacatttttttcttctttaattagaagcttaaagagaagtttgtagaatgtacttataagtggacgggataatactgttgggttctgatattctgatattgtttgaaatatgcttaagagttttacatttggtaagtattttttatatcagtattaaaatagtaatttggtttattacatttttacacatagaatttgccagttactttctgactacaaagaaaaacagatgttaaaaatctcttctgaaaacagcaatccaggtaagacttgtgttagtgaattactttaggttagttgtccccaacctttttggcaccagggaccagttttgtggaagacaatctttccatgggctgggggaaggtggggatggtttcaggattattcagtcacattatacttattgtgctactttatattattattacattgtaatatataatgaaataattgtacaacttaccataatgtggaatcagtggaagctctgagcttgtttccctgcaactagatggtcccttgtgggggcaaagggagacagtgacagatcatcaggcattagattctcatgtgaagcacacaacctagatccttcagatgggcagttcacaacaggtttcatgctccaatgagtatctaatgctatcactgatctgcctggaggcagagttcaggcggtaatatgagccatggtgtgtggctgtaagtacaggtaaagcttccctggcttgcctgctgctcacctcctcctgtgtggtgtggttcataatagtccatggactggtatgagtctgtggcctgggagttgaggacccctgctctgcgtggtcctaccatagataaaaaaagtaaaagtaaggaatttttgatcacaaaagaacactgaagcacaagtcatgttacatatgcttgtcccaataaggtctcactattattgacttcattcctcctcatttgaagttggaaagagatatatttactttgttggaacaagatgtgttcttctacctgctggcgctaattgtcatgataacagtaattttgttagaacaaggtgctctgctaccatttgccaaaagattgtcataataaatatacaaattgcccaactctaggctcagcagattataataagagcagaaaaatgtttcacactaacaaaaatgctagtatgctacctggttgtggacacctaatacattatataatccaaactttatgaggacacctttaatttagccatctatttgtcaaagagcttatgtaagttaggttttataagttacaggagacaaagatggaatagatgtggttttgatctttaaggtgctcataatagagctgtctccatttatgtgctttttcaatggaatttacaaagaaaacatttctatttatgttttcacttgtccacttaacaaataactatcaaatgtattttagatactaaccatttttctaatgctaaagaacacaactaaaaaggcatacaggagcttattatcattgtcattttcattattttactactttattcagtgcttactgtgtgctagatgcccactggaagcttataattatgatttattatatattgattatgtgccagacatatgtgatgaggaatgaaggttttggaaaaatgtaggtatgatttaaggtaagcatgcagagaagaatttttctaggtaaagaagcagaagaagaatgtttggcagaaggaacatgtagtgagattgtgtgtttgccagaaggaacatctaatgagattgcctgtttggcagaaagagcagcaagtgcaaaagacaagatgcttgagtggactttgcagggtttctgagcagttcacttttgctagtaccaaaagtgtgagataccagagattgggaaagaggtgaatagttagctaaggcaagtttatgatagactttttaatactatagaaatgagtaggtcttatcttgtgggccatgggaaatttaccaggtagaatgctttggactgcaaatactagatgagcagcggctaaaacagtaggaaccagaattgtttttttgttcattgatatcctaggatcccacctgtccctctttcagctgtggtgttgacagtgttttattcacatctcctttcatggttggctagtccccagcagctccaaacatcatgttctcacaacacaacatcacaagggctgcttttcttcacgtgtgtcttttaaacagggagaaaacttagaagcatgcaaggggcttcctgtaacatttcgttggctgggtcataccacatgctcattcctaaaccaggcactgggaaggcaaatacctgattagcttagaataaacatttctgtttctgaggctgaggagggggattgggataataaatatcccaatagacttgtgtttcttctgcaagaaagaatgaggaatggctattgatagggagccaacaatgtgtgctgcaggggctcattggagaaatttgtgcaggggagtcacaagattaaatttgagtattaaggcattctggttatggtgtaaaatgggttagcaagctttttctgtaaaggaccaggtgggaaatattttagactatgtggtctctgtcatgtctgcttaaccctgctgttgtctgctgttgtagtgtgaaagccaccatgattatatgtaagcaaacaggcatgactgagttcctataaaactttatttacaaagccataaggcagattggatttggcctgtggcctatagtttcctgggattgatggaagataaccatgtaaagaaaccaggagacaaaggaagcttttgcagtagtcagctatagtttccatgtcacacatccttggactagtatcaatgtattataaggttttcacctgtccatggtgaagtaaataacgttaggaatctcagttactcatttaaatatgttagccttcgttatgcctttttcatttgttttgcttaatttttttcatgtaagaaataacattaagagttggcagttttcttttaaataaaagccattttgtaaatgtttgtgttcccagtggcagtgggaatataaaacggaggcagaagagaggtatagtcaatatgatctagtgataattgaatgagaaaggcttgggggacagaagatttacaggtttccaggttgtacactagtatttaacctggacatgaggaaagagtaggaaatattctggtgaatacagaagaacaaagagcagcaggtcagcaggaatgactaatttttttctatgcaagtttaatagaatattcgtgtaggatattttgagtaggtaattggatgaccagcatttataactcgcatcctggtagtttgactctcagtaataagacttgtcaaagatccaagaatctgaaagttgatgataaatgtccatgtatatcaccatccgtgaccgaaagtcagcatccacagaacacagaattgggacagatgaacttaatagataaagatgaatatcagagttgttcctcttagggaatgatactctccatgacctgtgtgagtcacagctgccagaaaagaaagagcaaggagcgtatgaaggcagcacagcaaattcagtcctagagtgccctgcttggcttcatgtcatagttctgacttctaaaaaatcattttctgcaaaacgtgctttgtgtttttccctcttgccgcctgcagccaatcagaatctttttagcattgcatttttgtgttcttcctttaaagaaggcaacgtatgaataatgaaaagaagtaagagaaagaatgtttttttgtatgagatagtatttaatgtaaacttaagagtgagtgccaggattatacttagaatttatggactggatgggaagactggatacaaatctaaagattgctgactcaaacacaatgtggtttctttgatttattgtcacagctctgaagtcacaactcttagttgtattcatatgcactataactttacaaagcatcttcccaaaccaaatgtttactgatttattataatttgtatgacttcattatagaattgactttccaagtgttcatgagaattgtttagaatttgctacatagtatcatctcagctgtgtccacatgagctatctgtcaccttgtcttaatgaataatagttcactggtaatattggttttggcatttaaagtgatctatgtctaatgcagataggacccaggaccactcttgaacattaatgtccaagcatcttaaaattacacataaggctttcataatctgacttctgccccactctccatctttagcccttttccctgtgtgccctttctctggcattactgagctgctggtaatgccctactcactcatccttctattgtaggcaaatactttcactctttcaggccttgctcctgctcttgctgctgcgtggcatgccgtcaccctttcctgccctctaccccttttaatctggctagtctcaatatttaagtctctgcttgggcatgttttctagaaaagccatccctgacatgctttattttcattctttttagaccctaacgcctagcatatatgtagcaggactcaataaaaaatttttgagtaaaacaaagattgtttttacaaagatgatgtgcaagactctcccctgcagtcttggagcagaggggacagacatggaggaataatgtacagtttaggtggtaaagatgcagtagaaaaatcagtaacgtagtaaggcagcctcaagcaaggaggtacctgtttatttggggaaagacatgcagaatcaaggaagacttcacatagcattgtttcaaaagatgaaaataaggccaggtgtggtggctcacacctgtaatcccagcacttctggagaggatcacgaggtcaggagatcaagaccatcctgtccaatggtgaaaccccatatctactaaaaatacaaaaatcagctgggtgtggtggtggttgcctgtaatcacagctactcaggagactgaggcaggagaatcgcttgaaccagggagttggaggttgcagtgagctgatcgcaccactgcattccagtctggtgacagagcaagaccctgactcataaaaaaaaaaatgaaaataaatgtgtcagaatagtggagggaaacattttagatattaggaagatgttgtacactaataaaggtgtcagcagtgattttggaaatcatttataaggtactattaggaagtggagaacagtatactgtgtcactttatatgtttctgctgtattttgaagctgtgtttctggtgggtttgttcattgatgttgggtggatgaatttgtaagggaatttttgacatgtttgtatgtcttcaatctggtgacatctggtatctccccaagtggttttttgaagtttttgagaattttttcttaaatgacaatttcatgaaagattaaacgcccaatttatgaaatgaaatgtcttaaatctgtttttaaaaggcaatagtttttaactgttctaagtggttgattttaactgaatatatggatttttcaacagaacaagacttaaagctgacatcagaggaagagtcacaaaagcttaaaggaagtgaaaacagccagccagaggcatggaaacttttaaatttaaacttttggtttaatgtttttttttttgccttaataatattagatagtccaaatgaaattacctatgagactaggctttgagaatcaatagattctttttttaagaatcttttggctaggagcggtgtctcacgcctgtaattccagcaccttgagaggctgaggtgggcagatcacgagatcaggagatcgagaccatcctggctaacacggtgaaaccccatctctactaaaaatacaaaaacttagctgggtgtggtggcgggtgcctgtagtcccagctactcaggaggctgaggcaggagaatggcatgaacccgggaggtggaggttgcagtgagccgagatccgccactacactccagcctgggtgacagagcaagactctgtctcaaaaaaaaaaaaaaaaaaagaatattttaatagattcttaaaatttattgtaataaattcagtaaccttattaacagaagaatcagtagattctaatttaatatttgatatttaacttcaatataacccactataaaatttaaaatactcttattttaaaatattcttatctgccttcttgattagcttatagcttatctttccttttggaatagaggcaaaaacaaatttcagaactttgtttgttcttttatttttacaacaccgtaacatgataaagaaagtaacatcaattattgaatcatatgattaagtaatgggaattatgaacaatgtaacactgatggtccctgagctggattcatggttaaagagtaatcatggccagtgattgaaaatctgtggttttatattgccagtcactgataccaaggttaaagatatattctgccttgtctctcattgacctcagtgtttctgttcagggagggaaccaggtcataaaagcaacccaactgcctattacaaggatcatatcttgcagaatggaacctttggtgttagtgcacaaacacaataatattctaatttatttcagttacagaaaatcagtacagattaaaaatttttatctgctgtcattagtacacattagaatgtattagaactggacttaagcagataatctggatacataacactatcatattacagtatataattttaattaaaatttgagaatttgcatttctttctgtttggtgttgattttggctcctaatagtttaaagggtgcctacaatccagttagggatcttttaaaaaagcacttcagtgcactgtaggggctcactagttagggtttcgtgaggtaaactctttgcaagtgaggaagattttgcaacactacaaatcatctgctgattcatttttggtagattaacacataacaaattaaatttagtccaaacaaatagtgacaaagttaagtttgctggttcatgtttttttctcccgttgtctaaggtgaattatttttcacatgttagaagccagtgatgtggcagtagctaaacatagattaaaaagttaattcttaattttaattattatttatttattttaacagtttaattttattttctaatttttattgtccatacttgattacttaagaataaaattaatttaaaaacatgcactccaaaagaggagacgtcacagaaatacaacaaggaaattaaccttttgtttttgcatctgcagaaaatgtctcaagaaccagaaataaataaggatggtgatagagaggtatacctgtatattcaaatgtttgtgttgaattagatttttacactatgttgtttaacaaagtgtagtaaatgtaggcatacatgatcctatcatgtaagtagcataaatcatcagtgaaaaatttaatacttaactcagaattctgtacattgaattttaaagagatgcaaaccccagagatattctttcattattatggaataatcccgaatggtgccgtaaaatgctaggtaatgccactttaggagctttggaccaattattttatctttcttggttttagtctgattatcaatagataatgtggctaaagtagataatttcttactctgtgtactttccagctagaagattttatggctattgaagaagaaatgaagaagcacggaagtactcatgtgggattcccagaaaacctgactaatggtgccgctgctggcaatggtgatgatggattaattcctccaaggaagagcagaacacctgaaagccagcaatttcctgacactgagaatgaagagtatcacaggtgagcctagtggcaacattgaacaggaggtaactatgtgctgtcaaaccaatcctaatttgggctaatagtcatgatgaacaaattttatacttttactaggatattcagccttgcctgttaatcagaaaaatgaaaatcagcaaacaatgagttaacatttttttccagtcattaatttatttgaaaaataaccagtattggcaaatgtgagggaaaaggcattttcttctcttttcagtgaagttttattttagcttcggggtacatgtgcaggtttattatataggtaaactgtatcatgtaggtttggggtacagattatttcatcagccacatagtaagcacaatactcgaaaggtagttttttggtcgtctccctcctgccacgctcctccctcaagtagaccctggtgcctgttattctcctctttgtgtccatgagttctcatgtttagttcccactaatgagtaagaatatgtggcatttgattttctgttcctgcattagtttgcttaggataatggcctccagctccatccgtgttgctgcaaaggaaatggtttcattgaaaaagacatttcatacacggttggtaaatacattttgaacattaattgagtagcatattcacacaacacacatatataacagagtaagcatatataatacatataaaggatatttgtatagatatgttacatgtatacttacatataaggacatttattatagcattattatataaaaaatttggagctattctaattccttatcaataggaaatagctcaatttccatacccccaaaataatgtattatgcaaccatttttaaaaaatgaggttagatctagagtatactgatcatttcacaattaaaatgtatttaaagcgtttagtttgatgacacatcttaagagttcttgttagaattcttgtagtatctgctgtgttgcaaatggaagctacatgctacattgacactgtaccttgttagcaacaagattgctagttactaaatttttgttgtcagtgctgaaatatgggaccctcaatctgaatattgccaagggattgtacatggggatctgtatttaatataaacatttcagtatattgggtaaaacttttattaaaatacatcaaataatctttgatctactaaaccaggagttggccagctttttctgcaaagagctagtcggtaaatattttaggctttgtggactacatatatgtattttcttgagacagggtctcactctgtttcccaggctggagtgcagttgtgtgatcatggctgactgcagcctcgactttctgggctctagtgatcctcccacctcagcctctctactagctgggaccacacgtgtgcaacatcacacccaggtaattgacactatggactgtaaagtgaataagcatggctgtgttccaagatacttgacttaaaaaaacaggcagtgggctggatttggcccacaggtgcttatttgttgaccctagtgctaaaaggaaggtgctgctaatgcagtgactcctacttgtaaaagtgccctgcgtgcgtgacattatccttcctttgagaaaaggatatatttcagtattcacctcaccatatttttccggtgacttcatatgattttgaaaacttcatgtataaaataagattatttcctgcatttctcccactttattcctgttaatagaactcagtattttactgtgatcagttactttgtatatttgatgagtgtcaactgtcctagaattagctgatttttatcaagcaagaaatattctccttgagacttttagtatttcttggtctttatgtataagcacgaacaaaatgataatcagcttatgtaatctagaaatgttcaaggggcctttaaaaccttggtctggcatttttaaatgccatatgtgtataatttttataacctttaaaatatataattgttacataaaatttgaaaactccacctgttatgtaaaatttggaaactactatttcttgtctatcacttttccatgactgtggacgaaaattacatcattctcagtcatgagtgttgagtatgttgtccttaaagaactgtctacactcatgaactcaaattttctttccattcactcttgatctcaatgccggtaagtcttcaatttcagcactcctccagagttgtttttcctccagattatcactaatttttttaaattatactttaagttttagggtacatgtgcacaatgtgcaggttagttacgtatgtatacatgtgccatgctggtgtgctgcacccagcaactcgtcatttagcattaggtatatctcctaatgctatccctccccgctccccgcaccccacaacagtgcccagagtgtgatgttcccccttcctgtgtccatgtgttctcattgttcaattcccacctatgagtgagaacatggggtgtttggttttttgtccttgcgatagtttactgagaatgatgatttccaatttcatccatgtccttacaaaggacatgaactcatcattttttatggctgcatagtattccatggtgtatatgtgccacattttcttaatccagtctatcattgttggacatttgggttggttccaagtctttgctattgtgaacagtgccgcaataaacatacatgtgcatgtgtctttatagcagcatgatttatagtcctttgggtatatacccagtaatgggatggctgggtcaaatgatatttctagttctagatccctgaggaatcgccacactgacttccacaatggttgaactagtttacagtcccaccaacagtgtaaaagtattcgtatttctccacatcctctccagcacctgttgtttcctgactttttaatgattgccattctaactggtgcgagatggtatctcattgtggttttgatttgcatttctctgatggccagtgatggtgagcattttttcatgtgtgttttggcttcataaatgtcttcttttgagaagtgtctgttcatgtccttcgcccactttttgatggggttgtttgtttttttcttgtaaatttgtttgacttcattgtagattctggatattagccctttgtcagatgagtaggttgtgaaaattttctcccattgtataggttgcctgttcactctgatggtagtttcttttgctgtgcagaagctctttagtttaattagatcccatttgtcaattttggcttttgttgccattgcttttggtattttagacatgaagtccttgcccatgcctatgtcctgaatggtaatgcctaggttttcttctagggtttttatggttttaggtctaacgtttaagtgtttaatccatcttgaattaatttttgtataaggtgtaaggaagggatccagtttcagctttctacatatggccagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctcttttggttactgtagccttgtagtatagtttgaaggtcaggtagcatgatgcctccagctttgttcttttggcttaggattgacttggtgatgtgggctcttttttggttccatatgaactttaaagtagttttttccaattctgtgaagaaagtcattggtagcttgatcgagatggcattgaatctataaattaccttgggccagtatgaccattttcacaatattgattcttcctacccatgagcatggaatgttcttccatttgtttgtatcctcttttatttccttgagcagtggtttgtaattctccttgaagaggtccttcacgtcccttgtaagttggattcctaggtattttattctctttgaatcaattgtgaatgggagttcactgctgatttaactctgtttgtctgtttttggtgtataagaatgcttgtgatttttgtacattgatgttgtatcctgagactttgctgaagttgcttatcagcttaaggagattttgggctgagacagtggggttttctagatatacaatcatgtcatctgcaaacagggacaatttgacttcctcttttcctaattgaataccctttatttccttcccctgcctaattgccctggccagaacttccaacactatgttgaataggagtggtgagagagggcatccctgtcttgtgccagttttcaaagggaatgcttccagtttttgcccattcagtatgatcttggctgtgggtttgtcatagatagctcttattattttgaaatatgtcccatcaatacctaatttattgagagtttttagcatgaagcttttttgaattttgtcaaaggccttttctgcatctattgagataatcatgtggtttttgtctttggttctgtttatatgctggattacatttattgatttgcatatattgaaccagctttgcatcccagggatgaagcccacttgatcatggtggataaggtttttgatgtgctgctggattctgtttgccagtgttttatcaaggattttttcatcaatgttcatcaaggatattggtctaaaattctgttttttggttgtgtctctgcctggctttagtatcaggatgatgctggcctcataaaatgagttagggaggagtccctctttttctattgattggaatagtttcagaaggaatggtaccagttcctccttgtacctctggtagaattcagctgtgaatccatctggtcctggactctttttggttggtaagctattgattattgccacaatttcagagcctgttattggtctattcagagattcaacttcttcctggtttagtcttgggagggtgtatgtgtccaggaatttatccatttcttctagattttttagtttatttgcatagaggtgtttgtagtattctctgatggtagattgtatttctgtgggatcggtggtgatatcccctttatcattttttattgcgtccatttgattcttctctcttttcttctttattagtcttgctagcggtctatcaattttgttgatcctttcaaaaaaccagctcctggattcattaattttttgaagggttttttgtgtctctatttccttcagttctgttctgattttagttatttcttgccttctgctagcgtttgaatgtgtttgctcttccttttctagttcttttaattgtgatgttaaggtgtcaattttggatctttcctgctttctcttgtgggcatttagtgctataaatttccttctacacactgctttagtgctataaatgcccacatttatagcactaaatgtgggcatttagtgctataaatttccctctacacacccagagattctggtatgttgtgtctttgttctctttggtttcaaagaacatctttatttctgccttcattttattatgtacccagtagtcattcaggagcaggttgttcagtttccatgtagttgagcggttttgagtgagtttcttaatcctgagttctagtttgattgcactgtggtctgagagacagtttgttataatatctgttcttttacatttgctgaggagagctttacttccaactgtgtggtcaattttggaataggtgtggtgtggtgctgaaaaaaatgtatattctgttgatttggggtagagagttctgtagatgtctattaggtctgcttggtgcagagctgagttcaattcctgggtatccttgttaactttctgtcttgttgatttgtctaatgttgacagtggggtgttaaaagattatcactaattcttttctgtaataaatctaggcatttttctttacacctcatttaatctgtcagcaatatttcagccaatggagggcatctcttccctaatggcgtcttcacttggctttcaggacctcactccctcaggcttttcctcctgactttctagtccgttcatcatggtctgttttgcttgctgctcctaatctttctccttttggacattgttgtttgtcatggctgagtcctcaatcttctttctcataactttttttttttttaagacggagtctcagtttgtcacccaggctggagttcagtggcatgatgttggctcattgcaacctctgcctcatgggttccagcgcttctcctgcctcagcctccttagtagctgggattacaggtgcgcgacaccgtgcctggctaatttttgtatttttagtagagacagggtttccccatgttggccaggctggtctcaaactcctgacgtcaggtaatctgcccgccttggcctcacgacgtgttgggattacaggcgtgagccactgtgcctggctcctcgtgaccttttctactgtgtatatgctagtgatttccaaatgtatgtctccagctcagatctctctccttaatttcagatctctatattagctcccctacttgacatctctatttgattagctgttgggtatcacacacttgtcagatcaaaaattgggctactgatgtccttcctgaaatctacacctcatgtagtctttcctactttggttaacggcagctcttccagttgctctgccaaaaacctcagtgtcattcttgactcatctttctctctgtcttgacacttcacatctaatctctcagtaaatctcgtcaggtctacctgaagaatatatccagaagccagtctatcttgtacatctgagccaccgtcatctgtagtctagatgagtgtcatagacttggaattgatagtcctggtttttaaaaacttccccttttgtcaattcttaactcagtggatgtatttaaaacataagtcaaattgtgtcattcctctgccccagcccttctgattgcctcccatttcactctgagtatgtgccagagttcctcctaataactgaaaggcagtaaaccatctggcatgttacctctcctgcttaaacttctgtttcttatgtcttttgctctgtttcagccacactgaacttgttgctattccttacctaccctactgcttaaagattccaggcacacctctgcacttagcagttccatgtgtctgggatgctttttccccagatattcttctagcttactctttccattacttcagttctttacttaaaatcccctttccaagaagaagaaaaagggtaaaaagaaacacattaaggaattaccactttttgaggaagaaccatgtaccagcacaattcctagtccagagaaaatgaagaaaacgaaaaaaaagagaatgattactaacagaaaggaattaggattgtatcaccaggatgcgtcaggcttgagattcaattgggagcataccagggatgctctctaacgtaattgagggaaggttcaatgaaacaaagtgatttatcatctctaacttcaaacctatttgtgtcttgacatcaactctgttaacatcatcattttttagagtctttgatgtacaaataaaagtttcttcatattaaagaaaaatctctttctcagcagggacttttctggccatcctaactttcccactactcttcccatcaaagacatgaacatttcattttcctgctttagtttttctcctctaacgtactgtatattttgccttatcggtctgttgttcttgtgtgtttatctcactctcatgaataggggttttattgttcattaccatatcctcacttcctagaaaaaggcctagcatatcagacgtagctacctaataaataggtattaaatgaatgaatggagtttatcctgggtatattgtttgattgattctcacttaaaaaatgttcgataaggtgcattttaacaattttgcctggtaattgtatgtatttttaaacttcttttggctttttataattggctacgttctttatattaatattttttcacttagggagaaaagtccaatattgtggttattcactattcttttactggtaatcatgataattgcaattatggtaaaatgagtcagaggaattgcaaactttactggtattttatgtatttagagacagagtcttgctctgtcacccaggctgcagtgcagtggcatgtcctcatctcactccaacctccgcctcctgggttcaatcgatcatcctgcctcagccacctgaggagataggattacaggtgcatgccatgacgcccggctaattttcgtgtttttagtagagatgggattcatcctgtttgtcaggctggtctcgaactcctgaccacaggcaatccacctgccttggcctcacaaagtgctgggtggattacaggcataagccaccacgtctggccactagtattttatttaaaaaaaattagggtggtaaatgtaatggactgacaaattctttccaagggattgtggacctttggtatttgacataaaaagacagagttggaattttttgcttcctatagtaactgtatttgtcaggcaatgtctattctgatggagcagctgttgctgcttggctgtctttcagaagcaagctgctcacattgatattggttggtgagcaaggccagtggtcattgatcgattgactagattttgaactggctctgggtggcgtcttgtgaccatggctacaggtcaattcttccctaagtttcagtcaactttaactagaaattttctgttcaaaagttgccttccattagatatgttcaaaatgaaactttttaatattccagaattgtggatttaaagttttgattatgatgacttggttaataatagctctcacgaagattttttttttcatacattgtcttaaccagaagaattctctgtatagtttatttcttaaaaataattgttttgcttttgtttttggtatttttagaagcttttgctataatctccagtaggagattttagtctctttgtcagttcatgtatgtatatgatagtcatattctgtctttttaaattccttttcatgttcacttttttctctgtacaataatagtgatattgttatacatttttatctcattaaaaagttgttacaattttctgctggcaaatctagctttttctatattttgactgaataggttaaaagtgaagaaaatttaccagatcattttattttcaaacaaaatcataactaacaaaaattgctattttgaattataaataatgacatttagatattttaaaaataaggataaccacccccccccaatagtttggctttgtgtttctatgcaaatctcatgccaaattgtaattcccaggtgttgaggaaagaccagctgggaggtgattgggtcatggggtcggtttcctccatgctgttcttgtgatagtgagtgagtcctcacaagagctgacggtttcataaggggctctttgcgcttcacttctctcttctctctctcctgccgccttatgaagaaggtgcctgcttccccttccccttctaccatggttgttaagtttcctgaggcctccccagccatgcgtaattgtgaatcaattaatcctctttcctttatgaattacccagtctcaggtatgtacgtgtatgaattacccagtctcaggtatgtacgtatgtatatgtgtgagtgtatatacacacatacatatatatgatacatatatgtgatgtgagatatatatatgtatatacatccagtttttttattccactcatcagttgatggacactggttgattccatatctttgcatattgtgaattgtgctgcagtaaacatatgtgtgcgggtgtccttttgagagtacgatttcttttattttgtgtagatatctggaaatgagaatgctggataaaatggtaggatctacttttagttctttgagaactctccatactgttttccatagatttgtatgaagttgcattcccaccagcagtgtatcactgttgtcttttcaccgcatccacccaacatctgttgttttttgatttctaatagtggccattctggctgcagtgaggtgatatctcactgtggttttattgtacatttccctgatgattagagatatttagcgtgtttttatatgcttgtttaccgtttgtacatcttcctttgagaaatgtctattcatgtaatttggccactttctaatggaattatttgtgtttttcctgttgatttgtttgaatttcttgtaggttatagatattattagtcctttgttagtgtcataattttcaaatttttcccattgtataggttgttgttttactctgatgattatttcttttgctgtgctgaagctttttagtttaattaggtcttatttatttattttcatttttgttggatttgcttttagggtcttcctcataaatcctttgcctaggccaatgttttcaggccttaggtttaggcctttcatccatcttgaattaagttttgtatatggtgagagatagagatccagtttcattcttccacatgtggctatctttttttcccagcaccatttattgaataacctgtactttctccagtgtatgtttttgtatccttgctcagagatcacttggttgtagtggctttatttctgagttgtctgttctgttccgttgatctatgtatctgtttttatacgagtaccacgctgcttctgttactgtggtcttagagtatcatttgaagtcaggtaatgtgatgccaacatatttgttccttttgcttggtatgtctgttgctgttcaggctcttttgtggtcctacatgaatgtcagcattttaaaataattctgtgaagaatgacattggtactttggtaggaagtgtatcgaatgtgtagactgctttgggcactattgtcattttcactatatcacttctttcagtacatgaacataggatgtattttcatttgtttgtgtcatctattatttttttcggtggtgttttccagttatctttatatagatcactcacttttttcgttaagtatattcttaggtatttcacagtgttttgcagccactgtaaaagggattggattgttgatatgaactctcagcttggtcgtagttggtgtatagtggtgctactgattggtattcatttattttgtaacctctgagactttactgaattcatgtatcaaatctaggagtgttttgtaggagtctttagggttttctaggtataagatcatatcattggtgaagagatagtttgacttcctcttttctaatctggatgccctttattcctcttgcccaattgctctgcctaggacttcccagttttattcttaatatgcatgaaataaaagtaaaatggaaggtgcttaacaattagtttatttcacatctctctcatacaccgataaaattaattcaaagtcatatgttaaaaacataatattagaccctgtgttgttctaaaaggaatttctaagttgtttataaaatacataggaatcaagaatataagtggaaagtgtttccaaaaaataaacataaaagtatgtgttacaggccacggaccagtagcagtccctggcctgttaggacctgggccacacagcaggaggttagaggcaggtgagtaagtgaagcttcatctgtttacagccactctctgtcactcgcattaccgcccgagctcctcctcctgtcatatcagtagtggcattagattgtcctaagagtgtgacctgaaccctgttgtaagttgctcatgcagggggatataggttgttcactccttagaattgaattccttatgatctgtcaccatctcccgtcacccccagataggaccatctagttgcaggaaaacaagctcagggctcccactgattctacattttggtgagttatataattatttcattatatattaataataatagaaataaagtgcacaatgaatgtaatgttcttgaatcctggaaccatcccccacctcaggttcctggaaaaattatcttccacaaaaccagtccctggtgccagcatggttggggacacctggttaacagatgtgagacccctttgccttgcttggaataatgtgcagatatacattgtgtgaatgacatctgatggcgccatcttgccctgtagatcattttagggacacctccagtatttcatgaaaattaaaatttcttctaatgatgaacaaaatgatactcagaagcaactttctgaagaacagaacactggaatattacaagatgagattctgttcatgaagaaaagcagatagaagtggctgaaaagaaaatgaattctgggccgggcacggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcgtctgtggtcccagctacttgggaggctgaggcaggagaatggtgtgaacccgggaggcagagcttgcagtgagccaagatcgtgccactacactccagcctgggtgacagagcaagactccatctcaaaaaaaaaaaaaaaaaaaaaaaaaaaaaaaaaaaaaaaaaaaaaaaaaaaattctgaggtgttttctttagttattttcaaatgtttttatatgtgtatatatttttaaaaaactagatattttggaaatataaaggatttttaagtcatatatatgtgtgtatatattctatatatcctttgtcatgtacctatatatgtacatataggataaagccatgttcttaattcacctccatttgcctgcaacagtcgagtagtgaccttcacaatggcctcagtccagaggagaagcatttgatacttttcataagaattgatgatctttccatataaaaagttttgctgctgaaaacagattttcttgtttttggacattagtttttaaaaaagtgttaatagagaagtcaattgattgttttcactgataggaaagtaggaaatgtatagctgggtcagaggccacattgtggatgtcattatccttacttttgtggagaggaacagtttgctccaagtagtttctcatttcaatgtaaagaggttagaaaacaatgacatgccatgatacacatttagtgatcatttattgataagtattttgttcctagagaaatagttcagtatatttcccctatttcacagttactactgtttcaaatattataaagaggaaataagttatcacaatgggaaataatctcatgatttctaagaaaatctctataagttgtatcttatttaccattcatattttgaaacaaaaggcttcttttgtatttatatatttacaccacagaagtaactgtggttttgtggaggatcactagaagtagcatcagcagacctggggaaaatcctgcatctgtgtatattttttgacctctccttttaagaatcgcgatcttaaatgagttcagtattgtatgtagaagtgcaatgcctagatacagatgtgtacagtgtggaagggtacagtgcttagatttgacagttataaataaatgtaattcttataactgagtatagaaatattagaaatgtagaatatcagtaaaacgttcttcagtaaaagaaacttaaagaactttgagaaattgcttctgtccaaatatatgcatagcaaggctcttaggatggtgtggttgataggttagatatcagagagtaaacctaatcttaaaaatatagtcaaatgtattaatcttatattttatgcctctgggttttttgtaactcacagaaagtcttttttaattctgagattcttaaaaatcctctagtgatttatttttcatagtctttaaataaatatttaaacttttaggaattcaggagaagattcctaaaagtttaaatatttatttaaagactatgaaaaataaatcactagaggaatttacactctattaggtttgaagttttgtccaatttttttccagttaaatatccactatgtggattctttcattatacaaatacacgttattttttaatttcagaagaaatcatgatatgtcaatctattgagtgctaactaaaagttccctttgtttacttagctttctcttagttataagaaagaaaaagacttcttgcatgaaaatagtacgttgcaggaagaagttgccatgctaagactggagctagacataatgaaacatcagagccagctaagagaaaagaaatatttggaggaaattgaaagtgtggaaaaaaagaatgataatcttttaaaggctctacaattgaatgag

SEQ ID NO: 37463 - DNA, 83016 bp, Homo sapiens; identical to SEQ ID NO: 35589

SEQ ID NO: 37464 - DNA, 42610 bp, Homo sapiens; identical to SEQ ID NO: 35607

SEQ ID NO: 37465 - DNA, 389846 bp, Homo sapiens
atggccatgctcctgggggcatcagtgctgattctgtggcttcagccagactgtgagttgtgcatgggaggtttgaatatagtaagaaaagctacaaggaacactacaaggctgggagataattggagaagttttgttttgttttccggatcttgatggtttcctgtggggacattaaaaataaaactgaaaatctgttattctctttccaaacaggggtaaacagtcaacagaagaatgatgaccagcaagttaagcaaaattcaccatccctgagcgtccaggaaggaagaatttctattctgaactgtgactatactaacagcatgtttgattatttcctatggtacaaaaaataccctgctgaaggtcctacattcctgatatctataagttccattaaggataaaaatgaagatggaagattcactgtcttcttaaacaaaagtgccaagcacctctctctgcacattgtgccctcccagcctggagactctgcagtgtacttctgtgcagcaagcgcacagtgctctccaggcacctgcagcccgtactcaaacctgctttggggactcagactgggagacacatagactcgcttccatttacacatgccaatatgagagattatgctttgaagtaggtgaggcaagttgagcctaaagaaagactgatacatgacaaaaccttacaaataagttaagaaagttccctgagttttagagtgtttaagagtctaaccactctccttttctactttcagaaagaggttgctgatttagctaaagcataaatctctagtgatgctttgtttctgctagcttctggaatgcgggtgccctgtctcccttgtatactagggggcaaggatgtgtgtttggaatgggaaaaccaaggtcctactgcaggttcttccagtgatgaacatttcctgagatgtcttttcttttagtttttctcagtgtacaggcatttctgagcaaagaattgcatgtgtgaatactaacttatgtatatctgcatatctataaatatttctatatgtagcataaccatctgtatctatattaagttaaacattcgttcttagcaatgtctccaatgctaaatcattaccacgtggatcacactagcctcctccccttacttatccataaattcccactacaggggtgcacagcctggctctcactgttaacaaaaagttattcagtaatacttgttaaaacacggtgaggcagaatttatttaggaccatcatgataggtacagagaccactgcaacaggattttgcagtgagggagaagaattggattcaactccgaatacagcatagacaagtggagatttctagccaaggggcagattaggggtcagtggataggaaattactaagaggaaacattagaaccaagggatagtctggctagaccagccaaacaggatccttgcagaagacaggtcagggtgatcagacatcaatcccctgggggatgatagaggatgaggagcccagttggatatggagtgtaatcagatatcaagcggaggatgacgagggcagcaggggagggtgtggttcttgctaaactgacttagaaggattcttgttaaaactacattttacaagaaaatgtacagatgagcttaggagaaacttcaaaagcctgactaaagtttggtcaagcaaagaatttttgtcattaccacccactattcatttacatcatagtccaattccattaaacatgtatagtggtatcagaattgttacttgtagctccatgagaaagaattttatcacttagagcacactgttgtgtaatggtaataatgtctagattatgttgaacttctattattccacctgttttgcatgtattacattaattcttctaataattatttaagacaactattagaataatccatattttagtagagaaaacaggctgtgggagttcagggatttgttcagtatcactaactttgtgagaaaagagagttcatggtcactcatgccccaaaccaccaagtatgggcccttcctacagaagctattaacaagtcatgcttttgaacagctagcaatctttaaaattcttatcatacatgtcttcatcattgacctatagaagagtgagattatcactcatagagaattaaaagctgaaattatggttttatatgtatattgtatttgtagataaatgattagagcttgttcctcacaggctgattttctgaagctgaagatctttacagagagaagatacagaaattcaggatacttcccaagaagcatgcggaagcctctgtaaatcccattacttatggcataatctgaacagtgacttcaggaacagtgatttcaggaatgctgaagacatttttgatcagaataggggtgatatataggttggcttagctttgttcatctagggatccttgtggggttggtttaactataaggtaaaatctgtaggttgatcaattctctcatatttaattctatattcctgaacatggatgtaaagctaactcagtgtgaattagatttattatccctccatatccaggagcaccaatatcacatgcagtattttttctgttctttttatggcttacattggtataggcaggaaaaattccaagatccttttcgtaatgcacgtaaatgagaatgaaaagcaggaaggaatattaagcatcactcttcatacttagggtattccatgcacatctcgggctcctactctagagcctcagctactctgagcggagagtctgctgtgcatactctttgctcacaggcatccagagcctgttcccaaattcaaagctgtagccacagatcccagcaaaagggcagacacgcgagagttgttgctgtcttctagcagggtgtagagaaatgtagctatgatgaatcatttcatttcagtttcaaaaaatatggaaattcagctgaataatcagtccagttactatatatccctgctcttaacaaaactatttcaaataccttaagacaataaatcagcttttcttcttttcagatatatttaacatgatttataaattactgaaacccattataaagttctgttacaatggacatttttcactctaactgctgttacatttaccccatttcatgtcttgcataatggggagggaatatattaatgctgtctttatccttctaaagcaacgtagaatcataccagaaaaaggaatactacatccaatctcatccctgtctttttgttcaagctcttcagactgcttcaactttcacatttcattcattcccacagttatctatttacgttcttttcttatctaatatatttgggaaacagcattgggaaaacatactttctagcattgttctagccataagtgtgttgtatcttcttgagcaagtgaatcaacttcttaacattgtatatcaggaccttcatctgtaatgcaagggcaatgatttccagctaacatcggtctcaagttttattcattttatcaattagcaattgttaactggttgcctgctgagttccgcataaatgttacatgctgggaaaaaaagagctatggaaaaatacatatcttctttgactaaattgtagtctagttagttatgtaggcagctaatcagacagagtaaagtgaaatgaggccaaccttgggaaagcaaacggaggtatgaaggcatatggaaagtcccacccccatcttagccttagaggtgagtcaggggcagcctgtagtatgtcttgcctatgctgagacctaaagatttagtaggagtcaatcaagttgaaagacagagaaggtagtaaaagtgatcttaaagatagaaacagcatgtacaaggtgacacagaacacaatgaacctgaggactaaaagccagaattatgctataattaaaattatgtatgttataaaatgttcaaaccaccactgcaaagcagttgtaccttaattctcagttttataaatgagtaaccataatatttgtgaggttaccaaatatgttttctatttacttgagatttcacttaataaggttattcatttgatacctaatatgtgtcttagactcgaaaacaatagatgcaaatgagaagaataaggcattgtttctgccttcagggagcatgtaatattgcagagtgtattacaatatagtataataaaagctatcataggagaagcgtagaatataaccacctaacagtggcatttaatttggaaacttaaatgtaagggaaagctgcctacgggaagtagtatctaggttaagatctgtaaaacagttagccaaaaatggagtcagagacagggtattacagaaaaagataaatagaatgtacaaagacatgaagtcaatatttagtttaagagaatgacattaaactaattcaggatggccagagcatacaactcaaaatgtatgtcagtaaatataaaactaaagcaataagcagaaaccactttgtgaaaataattaaaagccattataagatgtttgtacattacattatcttgaagacaatgatgagcagtgaaagaaatctgcacaagtaaataatataatgaaatgtcactgtttgaaagattactatgagttcacatacttatatattatatccatgtgtgggcatgtatataaaatatatatatgtagtaaaatacatataatacattttcccttgatacttcttttttctcttaattctggagtaattctttctgtaacacagtatattgataggaccttcttatagcaagaaaaaaacctatcctgtatgaaaacttactcaagaaaagccaaaatccacagtttaatcaacattcctcagtctggccacaggggagagctgtttaaaaagtattctaggtagatgcatttagttctctgcagttaaactgttgtgatgtgtctctgattggttgcccccaaagttgcaatatcctggaagcaattgcaacaggcctcattctgagttcaaagcaactcctgttaaggaagcccattcagaagctgactggatattctggcaggccaaggatggagactctcctgaaagtgctttcaggcaccttgttgtggcagttgacctgtgagtacacgattcagtctgggagaggttgtgatatgacagcatcttaatgacaatagctttctgtcttgggaagggcccttttaagaaccagacctaagaagtgaggaaaatgtaccgtaattatgtggtgatgcttaatgttttaaataaggaaggaagagagaaaatcacccttcccttcacgagattgagcatctcattcgattgtctttctgatcaggggtgagaagccaacaaccagtgcagagtcctcaagccgtgatcctccgagaaggggaagatgctgtcatcaactgcagttcctccaaggctttatattctgtacactggtacaggcagaagcatggtgaagcacccgtcttcctgatgatattactgaagggtggagaacagaagggtcatgaaaaaatatctgcttcatttaatgaaaaaaagcagcaaagctccctgtaccttacggcctcccagctcagttactcaggaacctacttctgcggcacagagacacagtgatacccaggcctccaagacctgtactcaaacctaaagctgagccgcagatgctcccctagcacagatgcccaccacaggagtatggggaacttaccagaaggttcatccatgataaaagagaaacctgaaggaaattcatttgcttcaacacataacacaaaaagcaagccatggccttaagaccatatctaatttggcattgttttcttgataattatttaattgctttgttggtattatatgatagataacttagattcagagaaaattacatagatttcagtttcaaaaactggagtgaattcctatttgactgaagctatacatataaactccttttggatctctgcattcctatctgaaagtgaaaagtaacctctctttcttctcctaggtacccacagcttgacaataggacagcaaaaaaaaaaaaaaaaaaaaattgtctggttctttcttggacgtgaggattgtacacggtaggtatttagattgttaatcttgttacctatctggaaaggtcactagcattattttttccaaggttttaaatatctgttttggggaaatggcatttagaagtacttcaattttatatttgccttgccttctcttctcattgaggtttattctgattgatttccagctttgcccaagggaccctgagttatcttaccagtttgcccaatggtcaagatccttcctcaattgttcctttcatatcaacccagcacaacactgcatgtaggaaacactcaacaagttttaattgagtcatatgttgataagaattgagaatggccaggtgtggtggctcacgtctataatcccagcactttggaaggctgaggcgggtggatcacttgaggccaggagttcaagaccagcttggccaacatggcgaaagcctaactctactaaaaatataaaaattagccaggtgtggtgacacacacctgtaatcccagctacttgagagattgaggcatgagactcacttgaacctgggtggtggagtttgcagtgagccgagatcacgccactgcactccagcctgggtgacagagtgagaccctgtcccaaaaaaaaaaaaaaaagaaaaaaagaaaaagaaaaagaaagaaaaaacaaacaaaataatcacacacagaattccttccacaagatcagtcttccacaaacattctacaacttgcttaaatctttagtcttgtcctatcagtctaccctagaacaaaaatttaatttttcaactttctatattcattgagttttatccatcattttttttactcagaaaactttaaaattaactttttaaaaacttaattttaaaaaattaatttaaaaagatctccatgctgggaaaaattactttctctttaacagaaaccagattcccatgccttcttagaagctttttatcaaaaacacaaaacaactttatacactttgcatatataactgtttctcttatagctagtagtttgttgttttgttttgtcttgttttgtttttgagatggagtttcgttcttgtcgcccaggctggaatgcagtgatgcaatctcagctcactgcaacccccgcctcctgggttcaagcaattctcgtgcctcagcctcccaagcagctgggattacaggcacacactaccaaacttggctaattttttgtatttttagtagagatggggtttcaccatgttggccaggctggtcttgaactcctgacctaaggtgatccggccgcctcagcctcccaaagtaatgggattacaggtgtgagccactgtgcccggccatagctagtataattatatacataaactgtaatgttacttcttagtaactcttattcttagtgaaaaactgaggaagtaagtaattctaattaagcaccagatacagagtccaagacaaaggacaatccctggagctaggcttcacaatctcctaaaggcccaaatccaaaaacatagtttatagacaagttaagtgtcaaaaattgtcataaaaacacattttatgatcttaaaacatctagcagagataatatctgaacaataggccaatagacagacaaagtgtctaaattaaatttggaagaggtttctattttattttatttcaccaataatttttaaattgtctttatttgttaaagattactaaagtcacatgaacttaaaggtgtttgagttaaggtttctatttttctcataaaatatttaagtgtttactttttaagccaattaattagaactctttcacatattttggttgtgaaacatcacatacacataacacatataaatatatagacactagacacacagacacacagacagaagcagatcttgtagaactatatgattttttatttaccaaatttaagtagttgtttttattcacagtttcaattacctattttattgctctaggcaactgttaggcgaccctaaatttgcatttctgaagtgataactctcaggtgaaacaagataaaggatttgcatctcaaaatacagacagagacagggaatttaagctctttaaatttggttgtgttagaggaagattgaaaacatggatgccaagtaacacaaaattatataaatttatcacgggcttttataaggtgaccaatttcatttagataggtgcttttaatttagtctcttttttatctggaccattgaattcaaagcataactcacactaaatcttgggtcccccaaaagaggtaaacaccatggggattaggacacgccatgttttcactgtacatttcactgcaaatacatttcccctgaggctggtgggcaacccattgccaatcagcccactctgcgatcagcccattccttagccattatacacaccaaaggcaagcttttcacaataaaaagaaatttctagtaactccagaagcaaaaatttctggtagtgcaatgcaaaggagagaagagttttagatctgagaagacactgtccattttcaactcttgggattccctgaggaaaaaaatagcagtttctcccataaatgggtctgtggcacattttctgttttttcttaaggaatcccaggctgttagaattttttgttgttgttgtttgtttgtttgtttttgtcttcttatgtggtactgagggtggcaagaggaaggaaagggcgatagaaagagagagacagagggagtgcacattcctagcagcggtttaagaagaaattcagttgcctgagaaatgtttacagagagagagagaacagaggccttaaagcagtaagtaaatacatacatagcctaaatatcagttttaattaagtcaacttttgactatggagccctttaaataaatcctgtcaaatctcttattatcagattttagctgagacaaacagttgatatttctgacttttgaacttctttaccaaaagatatacccccaggtgccttaatcaaggttattatataaccgtgggtacacaagctgtctccaaagagttggcaagcattttttaacaagatccagaatcaccccaaagatcgctcagcgaaggaaagtttcattaccaataaatggggtataacccatatttctgtcaggccatgtgtttagagtcttaccttctcagctgaccatatgcacacaaaggccccaaagcctcatgtgcccccaacagatgaaaaaagacaggaaacaaaaagctatggaagtgggaaagatcaatcataaagatcaataataaattgatacccaacaaaaaagtcacacaaatattaaaccgagaggggctggatccctgaccagtaatcagactcaccctgtggatgtgaaagtgcagaattttaactattaggccacaggtggagtggcctttgtttttccttgaccagaaagcaaacccaagcctctgcaggaattttacctaccagaactggtttaggtcagatttttcactcttaatttagtcaagagaatttttaaggctggccatgacactattatatgtcctttttaaatgtgatctctttgttaatagtttagaataagagatccctaaaatctttaaattaattgcaccgaaagaaaggatgggaaaagggtctcgttgtgtaaatgaaacttctcaggtagtcaaattgttgacctttcttacccagccagggtttttagaagtgaaaattgactttctccagctgcagagtttcattcaacattagagggggccaggagttggtaaagtctaacagaaggtggaccaaaactgaaaagaaaaaccagaaaaagtgatcacagaattcacatataattgcgatctctcagcataagggtaagttatagccaactgacaataaaccttgcccttcagctaccaaatcccaatatgaaaccagctccttacctggagatggacccaagctgaagactgctgtctgccatcatggaagcagaaactaccagaaaaggagttttacagcagaataaacctcagatcccaattgaaaatttgggggagatcagggatctctggagggagaagttcccagaacttacatagcaaatcatccaatctgtaagagtaataaagagctccagccggtaccagggccccaataggagacctgctggaggccaagagccagactccactcagagtcccttcgtggtcaccaacatgtaaaccaaaaagtgactgaggcagatctctattgattagaggtttattttgccagtcgaggatatgcctgggaaatagaaacataagtcacagtaggatccttgacctgtgtttttccaaagagggttttggaaacttaactatttaaggtgtaagagcaagcaggagggaaaggggaaaaaaggagggacagtaggcaatgagacaagtggttacattcttataaggctttgattaacactcaatgaatccacattttgtgtgtgaaaaaaagagagtagaggaaaaaatcaattaagcattcatctcatcctcagtaaatctacattttacatacgatagagtaagcatgtgaaattagagttacctgtttgggaacagaaggaaggcagtgttttgtgtgactccgtttccaaccttaattttccccttggcataataactttgtggttttcagattttatttttctttccagattgagattcccatgaccccccatttgagttcaattaataattaatttgctagaacatctcatagaactcagagaaacacttacttacatttactagtttattataaaggcatacatatattacaaagcataaggatgaagagatgcaaagggcaaggtatgggggaaaggggtgcagagcgtcctcactgtcttggggcacaccgctctcaaggaacctccatgtgttcagctatctggaagctctctgaacctagtccttttaggtttttatggaagattcattaaacaggcataattgattaaatcattggccattggtagtcaaccttcagactctctccccttcccagatattggggatggagctgaaagtcccaactctctaatcatgcctttgtctctcccatcccccatcctgaagttacccaggggctgccagccatccgttcagtcaatcattaacaaagataagacatcgcttcagagtttctaagtattttaggagtcgtatgtcaggaaaaggggtcaaagattgaatatatacttcataatatcacaagtcataaaactgaatagtacttagcaaccaaaagaaataaagtactgattctttcaccaatatggataaattttaaagcattattctgaaagaaataagctagacacaaaagaatacctaccatataattgtatacatacgaaattttagaaaaaagcaaatctgatcgatggtgacaaaaatcagatcagtagtttccaggtattgggaatggaagaaggacattgacaacagtaagtcacataggaacttaaaaggtgataaaatattctatatgttgattaggatagtggttacacagatgtaaatgagggaagagagagaccctctcgtactgttttatattgttttatactcagtacctgttttaagaaaaaacaacaaggaagtaaaaccaaagacaggcagcctgacgccaggcccgaaaccaggtctgggcctgcctggcctaaacccagtagttaaaaatcaactcataacttagaaactgatgttattcatagattccagacattgtatagaagaacactgtgaaactccctgccctgttctgtttctctctgaccactggtgcatgcagcccctgtcacatacctcctgcttgctcaaatcaatcacaaccctttcatgtgaaatctttagtgttgtgagcccttaaaagggacagaaattgtgcacttggggagcttggattttaaggcagtagtgtgccgatgctcccagctgaataaagcccttccttctacaacttggtgtctgagaggttttgtctgtggctcatcctgctacatatacatttttcaaaaacagcttgactgttatgcttaaaatgtgatatattatttcatgtaatttatattcaataaaattaatctaaaaaagattaataaaaggatttagattctagatctcatgataatctgtaacacttcttttaactcaatagaagtaattcctctgttttaattttgggcaaaaaataaaagaaagagataagataacaagaagtaggaaaaggaaggtaacaagaggtagtatgcaggaattaaaattcattctcttaaattagaggacgattacatcccaggttcttcatttactgtatacgtgatcttgagcatgtgtctgagcctctgtctcctctctgtaataatttctcacaagattcaactgtctcacaaggggaggattaagtaataatatgtacataatgttcctagagcatgataaatgttcagtgaattttatctagtatttttattattaaccaaaggtggtcattttaagtgagcctaggttctctaaatcaaattatgggtggtaatcaacatggtatggcagctccagaatatttttttaatctgggcaacttgaggggctaggggtaaaagtagagaaaaaagataattgtattattatctcagaaactgtccagtagcctggaatcccaagtgctatagtttgaatgtttgtccccttcaaatctcatgttgaaatgtgatccccagtgtcagaattagggttgaatgggaggtgcttgggtcatggaggcagatccctctgaatagattaatgctctggagtggagagaatgaataagttctcactctgttagttcccaagagaactggttgttgaaaagagcctcgtatgtccccctctctattgcttcctctctcactttgtgatctctgcaaacaacagctcccctttgccttccaccatgagtggaaggagccggaggccctcaccagaagcagatgctggtgccattcttcttgtatactctacaaaatcatgagccaaataaatttattttctttataaattacccagtctcagtattcctttatagtaacataaaatggactacgatgatgggaaataatattttatcaatggaagtgatcttctattataactgagccaagagaaataaaattgaatagaatggaagttttcttttgtcttaacaaagttaccaaaatcacacattgggaggataagcagaagtctaagataatcagaaaacagagtagactgcaaaagaattgtttgaaatcatcaattaagatggaaaggaggcagggaaaacatcatagtttctagtatcaccctgaaattttgtgtgtaacaatatatgtatgtctatctacatccaaggatacaaaaccacatctgtattttaaagtaaaatatattttcttcactcaaaaaaatatataggtatctttttaatctcagtctaaatctgggaataaaattttgtggccccaaaatgtctggagaataactaagcaaactttgctagggaaagagctgtcttaaacacatctagtggctcaatttagtctgtgcaagtatgagcaggatatgatttaacaacttgtccctgcccctgccttccccactgtaccactttctttcctattctgagacagatgcattgctcacctccaataattctaggtggagctttatacaaaactgaataaagtaggtctcaggctctgagcaggcagttttttttcctagaaatagaggtgccaacatgactgttggcagcatattacgggcactcatggcctctgccttccttggtaaggacagtagctgataggctgaggacagtctaggactgggagaagacagtggggagggaagaggggatgaacaactggtcatatgtgacaaacactcaggtgtaataagaaggaagaggaaaggaaccagattctgactcctgcctttactgaagatttaacccctgccccaaaagttcttggaagctctcttacaggtcagctcaggggaccaatcttgttatttcttctcatttacgggatccagcatgtcacagagggtcattcaatcccaaccagcaatatctacgcaggagggtgagaccgtgaaactggactgtgcatacaaaactaatattgtatattacatattgtattggtacaaaaggtctcccaatgggaagattattttcctcatttatcagcaaacagatgcagaaaccaatgcgacacagggtcaatattctgtgagcttccagaaaacaactaaaactattcagcttatcatatcatcatcacagccagaagacctgcaacatatttctgttgtctcaaagagcccactgtgaagaacatgttagaagagccttacaaaaagatcggaactcaacctgaggcaattgcctattcccacattctcaggaaaaactcacaaaccttacccaggcatttgttagcagctggtggttagggtgcataagataagacccagaaaggaagtcattgagttcattccaggaagcacaccctcacaactgccttagaaaccacacaggaccacatgtaaaagccatactgctcggatgacatcacatctctatttcttcccatggagtatgccgtttaaaaaagcaacatgtgaaacatggaattttaaagcttaattgattgtacaggactttatatctgctcaaccaaatctcttgaggaaaatagtatggaagacactagggaaaaaaaacacgcatacaaaataaagatttttatggcaggatccctaaacactggccagagagatgcaatcttggtgagactatagactggagtacttttggaccatgtagaacagcagcctattctggaccagatgcatttttctatctccttggctacatttcactctaatcctgccaactccagcttggcttaccatgctttctgattctcatgttccttgcagctgggtctgctagttgggtcctccctgcagtcacatgcctatcacaagatttggttaaccacaacagagaaaggagatatgtggggagacactgctacagatgctaggatctgtagttaatcttgtagccacctaactaattcatggaaactccagaaatgagactgcagtttctaaatcccgtatttctttattcagtccccaaacccaattgtttcggtcaagcacataagactagtcttctgactctgatgagtcatttttcttccctacagattctcctaaaaatccctcctatgaatcctctgctaaggatgctaagtgaaccctatcacatgtggctgcaggcctgacacagtgcctaagccttaaccttcctcttctcttaattctgtgctctcagctaaggttttgacaacttgccaacaccaaaactggaatacacaaagtatctgccctttcttggttgttacctatttcagagcaaactggacattcctcctctaaaattttatctatctgaattcaaaataagattgccatacttggattcttactctcattggttcagtcaatcacttgttcattcaggaaatgaaaatatgtcctacgcaaagctcttcagttgcttctaattgtttcaagagaaatatccaagttctcttgtatggattaaaaattgtttctctccatattttttttattaagcccaaggtagataaaaatgtggagactgctctgtagatattcataatatccataatcgcatcttcaaaatctatgaagagcccagagaaaacccatccgaaccaaagtaaattgtaattatctaattcctcagccttgctatgtttcttgggatttctccttattgagtccaaatttactaccatgactcacaacctaactgaagccacagaataaataactcagacacttgccaattcttccatcaagcggcccaataaagactctagtctctgtgagacttttaacaattaaatataaaattctctcaacattttttgagaaaagaccttagtcttcttttaaaagaaaatggaagggaaaatggtgcagcagaagggaaaacaatgccctccttctcagactgaataggagagaggtatttcaattatgatctgtgatgtacagtgataatatgatttgcaatgcttcttatggttcagagagaatactgacaaaggtcttgcgtttctgataccaatatttcaattttagatgcaatggaagatggctagagttcccattcctgctagaaaagagtgttgcttctgcctcaataagtaaagctggataaatagaaaaattgtaactttgctttaacccatcagagacctgagattacagggcaaataagtaggctggactccaatgaggaaaacactcctccaagggagacaggcagcttatggactggcacaactgcagcagagcatagaaaaagaaatgttatctgccatacaagcaagaaaaagaaactgggtaaaagattgagtgagagctatcatcagaatatagaactgctgggagttgcagacatagaaggagtttatattcactggtagggccatttcacagatgttggaagaagtaattaggggcagggtgagacacagagagagccccagcaaaagtgtaggcttacaagacataattggcagtcactgcaggaaagcacaaatcccagcattcttgcctaaatcagcctcttgcaggaggaaaagctttaagctgttggggatggggctaaagacctgacagcgcattctgtcaccccctagagcacaggttaagatccacaacagcaaagaaaagagtcaagggaaaaaaatctctacctttgggtagagacaggaaaccattctgagctgaagaccctgtaacaataccattctaattttgctacctgtaagaaagaagcagaaaactctctcacatcacacccacagagaaacacggcagtgtttggctgccacagggaggaaaggtatgaatgctgagaaaaccctaaatccaagatccaagcacatggggccagtctaagattgaagctggaccaagacaacagagaagtccacctacccacacagtgagcctcgtaagcactaaataacaagcaacggcaaactattgctagaggagtgaggggtgaggaacagaaagagagatcctctttgtgctgaaggaattcagggacagctaaaagctgaggtagagtactctaaaaaatagagattcataaatcaatagtaattcaagaagccagcttttaagtggctcacaaagcagtaagatggttttaggaaaacttatgtatttaaggatagtattctagaccttctattttcagatccttctacttcctactttctattcctggagacaacatggttggataccactatcagagccatattaggctgactgaaccaccattgtgacttgcattatattatcttctctcaattctttatctccgtggagttttaccttaaaagatgttcattcatatacttttattcactaggtataactatgaggaagctgataaaaagggatgtttctcattagtcttttgtttatctaagatttgttgtaggttctgatacattagcagaataatataatcaatactttgatttgtttatcagatctatctaggttcatatgctacctctttgtgttcttgaacttcttcgagtctttgaggattaaatgaaagaattgatatcaaattaaaagcacagtggttggcatgtggtaggcaccaataagccactaataacagctcttgaaatacgtcatatcctttcattgctcctttacaacattgagtttataacagggaaaaaaaataaatattattgcacagactccaagagactatggactgggactcgagtgcataacattttttacttgcaatgtacattgctgaaatctagacaccccaaacttcctgcatctgcttaggcttttcaatcacggaagaccactgcactctggcaggaaaaatatccagatgcctaacttggaaaataaactaaattaggccatcttgggaaatggcatatagctctttggagggcaactttatatttaccctgtcttctgatatgttgaataaaagaagtttaaatgagacatctgctttagtatttggcatattgatataggtgagctcttacactatgaaagtatattggaaaggatatgacaaagaatatgctgctaaaatccctgaaactcgttaacacttaaaagtggttgatttcaataataaatttcaggcatctcaggaactgatttcctcaaaagtatgatttatagccatctgattgtgaaggcatgaacatcctcattctttgacattaaaggagaaacttggcaattagagggatatgcatgggcttgattctagtcagtaaatggttcaggcagagacaatgacattaatctggggctttttatattggaaaacacaagccaagaaagaaggtgcaaatatctttgccataataatgctggtgttatgatttcacaagaagtaggtgtgaatatgttttactaatgaaaaaaatgcattcattcctcagatagactacaatgattggactatcaaaggaaaattagctttttaaatactaagttgtgtgttttcatgtacacgtatacacaagtcctggctgtagctttactgatacagagaaaacaaactgaaattgaagcactgacaattttcacctaccctctacctttttcatggcagcagagctcaccgtgtcttgcaaagttgttaatagctcaagcaaacaaagaccccattgatatccaatatatgtgcaagatcccattgatatccaatatattaaaaagggactttgatctgagctttattatcctgtagaatggagtgctaatgtcttgaagtacaatggagctagtataccaaatatcatgagcttaagaaccaatagagagggaaaaaatgagacaaggaaacaaaaattttgatgtgtgatggattctattggtctatccattgaagccttgctatatcaagataccttttaaatttatactgttcagaacgcatattgaaactgtcagtaaaaaagatctctctactcttccaacagagtccattgtatatttggtacaaaaataaaacatctaaggttgtattccattcttttgaatggaagctcagattaaagtcccttttaatgtcttgcacatatattagatatcaatgggatctttctgccagccagcagataattccccaatgcagatgaaacctgttttaaatagtacttctacttcagaaactagttactaaaaatctctttgggaaaaagtcaggcacataattgtgatgtgtgatggatttccttgtctcccaattttttctctccttggttcttaaaccgatgacatttagtataccagctccatggtacttcaggaccatgtacatcaatcctctctacaggataataaagctcagattaaagtctttttaaatgtcttgcacatatatcagatatcagtgggatctttctgccagttagcagataattcctcaatgtggatgaaacctgttttaaatagcacttctacttgagcctgagaggcggaggttgcagtgagctgagatcacaccactacactccagtctgggtgacggagtgagactcagtctcaaaaaaataaaaaatatatagcactcctacttcagaaagtagttattaaaatctctttgggacaaaactaggcacactgctctgaatacttcatgaaataataatttttccaacgcctttctgagccaggtgttcctggtgttactagaatgttggtcagttctgcacaaatttacctaatttacatcctaagatgctctaccttttctttgcaatagccatcaattatgccccaattttttaaaataaatctattgataatatcatggaactggatgaggaattctaatattaagtctgcatgccaattcgtccaattactcagtagaggaaagccttccaattgaacttcattgtgtgcctgcttttgtgcttcttttatttaagcattttgaatatatgagactactttagcccttctattccattctcatttccttttcatccagttaaacttattgagagcctaaaatagaaaattcaacacaggcagtcctaaatttccaaaagaagatttgcaactaatggtagaacaaagaagcaacaaatttttttttggacagttttacattattgcctgggctggagtgcaatggcacaatcttggctcactgcaacctccacctcccgggttcaagcgattctcctgcctcagcctcccaagtagctgggattacaggcacccgccaccactcctggcttattttttgtattttttagcagagatggggtttcactatgttggccaggctggtctcaaactcctgaccttgtgatctgcccaccttggcctcccaaagtgctgggattacaggcgtgagccactgcgcgcagctggaagaaacaatctttataatgtttcttaggaacaccatctgggctgggcatggtggctcacctgtaatcccagccctttaggaggctgaggtgggtggatcacttgaggtcaggagttcgaaaccagcctggccaatatggcgaaaccccatctctactaaaaagaaaataaaaaaattagccaggtgcagtggtgcatgcctgtaatcccagctacttggcaggctgaggcaggagaatcgattgaacccgggaagtggaggttgcggtgagccaagatcatgctacttcactccatccaccctgggcaacagaccaaaactccattaaaaaaaaaacaaaacaaaacaccaccatctgtaagacatggttgaccagaaacagaataatgcaaggttggccaacatagccaaactcttctaagccatgagctctgcctctgtctcattgattggtgcctagctgctagagttcagtgataaaagtgaaatcaaaggctgtacattatttattttctttgactatgagtttatctttcctgccagatccaaaatgactaataaaatgagagatacagtcagtctagactcgaaccaggaagagtctctaaaatctaaatgagtaactctaatggtctctctgaagactctgcactgttgcttctttaaagataaacattaaaatagaaacccgcatctctaataaaatatttgtctttcccagactttcttgagagtgagtctggagtgaccattttgtggtaacagatcatcatttggggttattatttaagcaccagttccctcatatttgtgctgtcagtcacttcctcaaagcttcccattcagtatgttttaacttaagactcagaaggacacattgatgataagaagtttctcagtgggtctgaagcttagctccaacactgcttgtcttagaatagagactttatcttactaggacaccaaagaagactgttactacatggcatgaatatctgcttcttctttatttaaaaaaaaaaagtgcagaaggcatcaatggataacattctctatgttttcatttgagtctagtagttttctgttcttactttgtactgtcaggctttttttccccttatatctaccttaaaccctataaagaactactacagatcagaaactttaaatgcaagatctgtaacttaatcaccagaaatataaaccagaaatatgactttctactaatttcctacttgtgaagtaagatgttctaagggataggcagacatgccagctctccttctaaagacagaatgtgtgttatacacgtggccttggcaattagaggtctgtacacaggatggcagcacttcattttcacatgcagagaaatggaatgttcaactctgttgggcagagcatagcttgtctcctattggcttatagccaggttaagaaagagcaagaatacactgagaatagaatatgttctccttcccagatagtatagatcattgatgattctaatggcaagaagaatggaaaagtccctgggagctttattcaaattcagctgaagcgtaagtccagggcttctggaggggtccatcacaagtctggggaaggagggggattcattttagttctcccctggttttctgctgatactctgcaaagaaaacgtacattcggaaaatgacccagtaacccattttccttgtttcaacggtgatgagtggccaagaaaaggatgtgatacagagttattcaaatctaaatgtctaggagagagaaatggccgttattaatgacagttatacagatggagctttgaattatttctgttggtacaagaagaaaacggggaaggccctaatatcttaatggagattcattcaaatgtggatagaaaacaggacagaaggctcactgtactgttgaataaaaatgctaaacatgtctccctgcatattacagccacccaaccaggagactcattcctgtacttctgtgcagtgagaacacagaactcttcaggcacctgcaacctgtactcaaacctgcaactgggagtccagtcacattctttgtctttgaacgggttttgggttagaatggtttaccataatgtgcttgtttctaaattgaaatgaatgcagaaatctaataattgtgattacaaaatcattacgtttaaagtaactcaaaatgagctggtatactttgtactaactccaatgtattcgagaggagaagtagtgttgttttaaatagatatgtaaataataaagataacctcattggaatatctgaggttgtttcattgagatcctacacttccataataaaacaaggacacctaaaactcttctgggtggcaatctgctggccttcagaaaaaaaaagaagattcatttttgaaaaaattttaaaatttttaaatcatcatattttaaaatcatcacacactcattatttattataagtattttcattccaggtgtgtctgcatatgccctaattcatagcaacttaacatatcaagtatatttatcatataacatttatgtccattctcctctggacatccaccttcatagtacgggtattcagtcataaaagttacaattcaaatagccaccagaagaattcctgcaaagatttttgtcttgcaactgttctacattcagaaaatatttaccaactgcctactctgtgccagacattgttcttggtgttgaggattgagcaggatgaacagaaagacatgacaaaatttaattgtattctgcttctctcctccaatggatgtctgctcaccagaaattaactggggaaacattttgatgacagtgtatatccagggatcaatgacaccacctaggagttttaggattttgcccaaattcaccaattccttcatacctcataggtctgtatgtacagtagcaacagtgtgatctttctcttttttccaatgttccttcaagaaaggaagataatagttattttagtcaaactgttcaaaatagagaaaaaaacctaccaactccctcatgaggcaaaaaacataaacaaaatctgtagagttaagagtagtgaggctgggcactgtggctcatgcctttaatcctaccactttgggaggccgaggcgggtagatcacttgaggtcaggagttcgagaccaaacttcccaacatggtgcaaccccatctctactgaaaatataaaaattagctgggcgtagtggtgtggacctgtaatctcagctactcaggaggctgaggcaggagaatcgcttgactctggaaggcagaggttgcagtgagccgagatcctgcctctgcactccagactgggtgacagtgcaagattccatctcaaaaaaaaaaaagagaaagtatttttcatataaattattctcggatttttgaataagtaataagtatacatggtataaaataaaaattatacaaaaagatatatagtgaaaagtaacttttctctttacctctatccccactatccccaacagcctagtataaccactgttacactgaaattttctttgaacattatacatatatacatatatatgatgtgtatatatatatatgtatatataaaaatgatgtatgtatatatgcttgtgggtatatatataacatatatattaatgtagcataccatccacactgttctgttaccatgctttcttacttaaactatatcatgggaaaccatcattgtcagtacatgaagacagctaccttattatttttaatctaaattttcaaacacacacaaactaggaagaattgtataatgaactcctttgtatctttcattcagctttaacaaccatcaactggctatctccttctctttaaagtttcaaattttgccattgtgtgactataccacattttatttagtcaatctcttgttgatggacacagattgtgttcaaattattagttttgtttgtattgtagcatagtttagtaaggtacacagatctcaagagtacagttcaatgagttctgacaaatgtatatgccatacaaccatcactgaaactaaaatatagaacatttcccataatcctgaaaactctctcatgtttcccccccagacaacacttccactaaagtaagaattgttcttatttacataaaaccatagaatagttctgtttattctattttgataaattgagatataattcacatagcataaaatccatgcttttgaagtataccattcagttatttttaatatcatcacaaatctgtgcaaccatcacaactaattcctaaactttatcatcactcgccaaaaaaaaaaaaatcatacctattataagtcactctcatcccctcctcagaacatctgcccctaacaacgcctaaatctgctttctgtctctatggcctatcctagatatttcatacatatggaattgtacaatatgtgacctatcatgtcacgtattgtatgattcacatattcacatattttactggctttttcacttaccataataatttcaaggctgaacatttgtgaccaagtttttgtgtggacatacgtttttagtatttggggtattatgcataaaaatggaattgtgggtcatatggtaattttatgtttaactttctgaggaactgccaaactatttttcaatgtggcttcactactttacattactgtcagcagtaagggaggattccaatttttccacattctcatttgttattgtccgtctttttaattagacccatcttagtaggcataaagtagtatccctctgtggttttcacttgcaattccctaatgactaataaggctaagcctatcttcatgtgcttaatggccatttgtgtacctgctttagaaaatgtctgctcaagtatttgggctgtttttaattgggttgtcttcttattgttgagttgtaagaattctttatatgttctggatactagacttttatgagacatatgattggcaaatagatgctcccattctatagattatgtttttttttttgctttcttaatagtgttttttgaagcagaagtgttctaaattttaatgaagtctaatttatctattttttctttagttgctggtgctttatatgtcatatttttaaaaacattgcctaatccaaggtcacagatagttatatctatgttttctaagagtttcatagtttcagtttgtacattgaggttattgctccacttcaagttaatttttgaatatggtgagaagtagggatgaaagttcattcttttgcatgtgaataataagacatttggagtccccaaccaaaagaaagctgggtagctatactaatatcagataaaattgacattaaaccaggaattattactagagacacagagcaacacatcaaaatgattgagtacgatctacccagaacaaattctatttttatatatacctaatggcgtagcttcaaaatatatcaaacataaatcagtagagttcaccagtagaattaaattggtagaatttattgattaaaagatcaataaataattatacaaccatcatgtcaggcattaacacacatctctcagtagaaaagtattgaaattatgaccaacacaactaatatcctttacctcacatacatagattgaatactttacctcaaaagaacagattacacaaggaatatttagcaaaattgactatattctgaaacataaagtaagccttaatcaatttcaaagaacttaaatcattcagaatagtcatagtctctgaccatatggtattaagcaaaaattcaataacaaaatgattattaaactttattcctgtaccttgctagatataaggttaatttttcaaatgtattgccacagaaaacaccaagacaaaacagagatttggggtagggtagatttttcagtctctgaatagagcaatgtaacatactacttgcacactttatttcctgtttgggggcagaaacactgaacttctccagggactttgcactcaggcactcagagaagcattttgtttccaggcttgagtgaggaagcaaatttcaaccgtaagaagaaattctaccatgctctgccctggcctgctgtgggcattcgtggtcccctttggcttcagtacctatgggcggccccaaacatgggactgcagcttcctcgagagctgggctgcacaaattggaactggtggagtatcaagtaagaggtaagggaagtggggaaatgaaacactatttaattattttctttgtccttttgccataaattaatctagtcctcatgacccatctgagacatttaagggaaccaactctgttttctcctttttcccataggatccagcatggctcagaaagtaacccaagttcagaccacagtaactaggcagaaaggagtagctgtgaccttggactgcatgtttgaaaccagatagaattcgtacactttatactggtacaagcaacaagcaacctcccagtgaagagatggttttccttattcatcagggttattctaagtcaaatgcaaagcctgtgaactttgaaaaaaagaaaaagttcatcaacctcaccatcaattccttaaaactgactcagccaagtacttctgtgctctcaggaatcccacagaagtagaaatgacagtggaagataaacaaaaaccttagcactccataaaggaagccacctgctcaggagcttagggaaaatacatgaagcacagacaggaagaaggcacattagtggcacagttgagaccttataatgtaaacattcctctgtaaaaaaaaagtttccttattgagtttatatataaagcagcattctttcttgcgatttccaactattacgtttctatcttgggttaaagtaaatcacaaagtgtattagtcagggttctctagagagacagaactaataggagagttgtatgtatgaaggggagtttattaaggagtattgactcacacaatcgaaaggtgaagtctcacattaggccgtctgcaagctgaggagcaacgaagatagtcggagtcccaaaacctcaaaagtagggaagccgacagtgcagccttccatttgcggtcaaaggtccgagagctcctggcaaaccactgctgtaagcccaagagtccaaaagctgaagaacttggagcctgatgtttgagggcaagaagcatctggcatgggagaaagatgaaggatggaagacttaacccgtcaagtccttccacattcctctgcctgcttttatcctagttgagttggcaactgattagatggtgcccacccagattaagggtgggtcagcctctcccagtgcagactcaactattaatttcctttggcaacaccctcacagacacacccaggaacaatactttgcatccttcaatccaatcaagttgacactcactattaaccatcatacaaagtgctttttaaaatcgttgctgaacaataagattaaatgaacctatgtatttcatgaaattcagaagcagtttgctgattctcatcttaaactgttgaatttccagatttgaagtagcactataaaccattttatcttccaatctcatgttgattttagcagtttttataaatattatcattttatttatttatatattttatatataaacaaatttcataaatacataaatttacttttatgtattttaatatataaatacatggtttttattgtattcagatagataagaaggcaattaatgttttgaaagaaatggatgaccaaaagaagctttgactaaaacaaactatgattgttagagatagaaaataattcttgggtgcttcataagcccagcagaaggtgggctgagaaaccaatttatccaccaaggcaggcatattccttaatatgtggtcaaaggagataagagaaaaagaatattccagaggactgagccagagaatgtaaaaaacaatgggcaaaataactccctgcatagagtgcagtcagaatctcatcaaagcagggtaggggtcttcataataatccaaaatgaactaggtatgtgcagaaaataattaacagtttttgtaacacactgagattttggagttgattattgtagcaggataacctagttactcaacttatctaaatacagagaaaaaatgagaaaatgttttcccaatttattttacaaggccagcatgattttgatactaaacctgaataaagaaatatttttgaaaaaattattatgggataatctcactaaatgaacataaattcaaaaattctaaacaaactattagtaaaaagaattagcagttataaaaaagaataacatatcacaaccaagttgggttttatataatctttatataacatcttaaatgaattaaagtaataattctcattaataaaaacatgatttaataatctcaacagttacacaaaagtttttaatacaaagtaaatattcattcataataaagagataaatttatggcaaattaggaatagaaaaaaaagtcctcattctgctaaattatatgtattacaacaaaacagacataaaacttaatgaaaaatgttgaatgctttatttcaagaaagccaaaaaaacgctatccctattaaaaaagtatactgaaggtcctaaccaatatttaagaaaaataaagaaataaaagttttaataattagaaacaagactataaatattagccacagatggcatgactgtgatatatacaattccaaatcatttgcaaatatatattacattactgagtttagctatgtagtattaaaaattacattttatatgaaagcaatcagaaattttaaatgaacctttaaaaagtgtccttaaaataggtggggtgaactgggggtggagggttacgcctgtaatcccagcactttgggaggccgaggtgggtggatcacgtgaggtcaggaattcaagaccagcctggccaacatggtgaaatcccatctctactaaaattacaaaaattagccaggcatgatggcccatgactgtaattctagccactcaggaggctgaagcaggagaatctcttgaagctgggaggcggaggccacagtgagccgagattatgccactgcactccagcctgggcgacagatcgagactcgtctcaaaaaataaaaataaaaaaataggtggggatgactaatgggtacaaaaaaactgcaaagaactaataggacctatcatttgatagcacaacagcgtgtctatagttaataataatttaattgtacattttaaaatcactaaaagagtacagttagattatttgtaacacaaaagataaatgcttgaggggatggatacctcgttctccatgatgtaaacttttttttttttaagaaagtctcactgcgtcacccaggctggagtgcagtggtgcgaccttggctcactgcaacctccgcctcccagattcaagtgattctggtgcctgtctcctgagtagctgagattacaggcaagtgccaccatgcccgggtaatttttgcatttttagtagagacagggtttcgtcatgttggctagactggtcttgaactctgacctcaagtgaacctcccgcctcagcctcccaaagtgctaggattacaggcgtgagccacatgcctggcctctatgatgtaattatgcattgcatgcctgtatcaagacatctcatgtgcctcataaatatatacacctacaatctacccacaaaaattaaaaattaaaaaatgtaacatgtatatatccttaaaatagcataaaaatacaaaatacttaaaaataaattttaaaagatatttgcaaggcctcaagacaaaaggctataaaacattaaaaaacgaaattaaagatctaaagaaatgggagaattcatcatgttcatgaattagaagatttacaatgcaaaggcatcaattctcgcatatttggtaaatacattcaatgaaatccccatcagtatcaagagtgtgtgtatatacaagtagattctaaaatatatagtttttaaaagtcagtaatactcaaagcactccgagagaagaagagcaataggaggacttcctgtccctgacaataagcctatgaaatttaaaatatggtatggaggaacaggaacacactcagttacagatctcgtcagctgtgtgtgttcctttttcctctcatatccactctccacctttctcttccttgctgtttgtctcacgaggctgacctgaatgaaccgcatcaacaaggctcccgtgccctctgggttctagtggatttttgccagtgaggtgccctttgccaaaatctgaaaaaggtagcagagtaaggtcagggtgtttgttccttggttctcctcctgaggaatctcttctagtggcaaacatcatttgttcaaagatcacagctcctttcaacttggctctctccacacacccatctccattcaggttttgatattcctctctgccctctggacatagggatagtaaaactccactggcctaaagataataaaattaaaatgcagatatttctcaaaaatctcatagagaaagaagtctgaggattcaggtaaatgggaatgtggtaatggaattatctgatgcaatttaatcagatgcctgctaaccatactccctgggaatcccagaggacccttctttcaccaaggaatcaggaaattcatcattgagtgggtcaccagaattcttaaaatatttcttggaggccatccaacctctatacagtgaaggcaatggggacggggtgggcacattgccatgtaatttgctttcctggatttcagtgggtgtgactggatcctgttgcgataggtagtggagtttaacagatagagacaaagatagagtttaacagatagagaaagagtattaatcagagtcttttaacattcagagatttttggagaaagctaattaatcatagaatacctaggaaggaaagacagaatcagcttcctgaggctctactttatattatctagattttttgaggaaaaaaatatagttttagtagctataatggagattaataggcccttaatcaatcccaattgagaggcctaaaacatctgaactgagggaatggttgcatccatttgagaaagattatgccagacaatatcaagcattggcaaggatatggaacaactgaagctcttatatatttattatgttggcgctaggaatgtaaaattgtgccaccactttgaaaaatggtttagcaatttttataaagttaagcatgcatatactgtatgatctaataatttgcacccatagattgttaaccagaagaaattaaaaatatatattcacagaagtatttatgcagaatgtatttgtgaatagaaaatattcacataatattgtttatttcttttggataaatattcagaggtgctttattcattataggtcataactggaaaaaaataaataggaatgagcaatttatatatacaataacatggatgcattttaaaaacattacatggagaaaaatgtcagatgaaaagagtttatactgtttgtatccattaatttgaaactcgaggaacagcaaatttaatccatattgagagaaaacagatcagtggttgtctggattctgcagttggggaacccagacaaccactgattgacaggtagagaacacagaggaacaatttagggtgaaataattgttctgtgtcttgatttatacaacagttacatgttctataaatatttcaaaactcaccatatttcaaagcacttaaaatgggttcattttactgcatgtaattcatacctcaataatgttgatttttttaaaagaaataataaatattgctacatgccaaccaaaatgtctaaaattaaaaaagaaagacagagctaagtaatgaagagaatttgaatctactcaaacaagtaagagtgtaaattgataccaatacttaggaaaattgtttaacactaatttctcaatttgaatcataactaatgaaaattattttttaaaaagccaaagtctgggaaatcgtcctaagggcataccaaaaatggagaagcatttattcaagaaaatctactgaatctactaaatgtcagcaaacaaaaataaataagatgtgatatatatgtatacacacacacatataatagaatattattcagcctaaaaaggctgtttttatggatacaggttcctttttgggatgaggaaaatgttctaaaattgattgtggtgatggctgcacaactctgtgaatatactgaaaaacattgagttgtacactttaaatgggtgaattacatggtatgtaaattgtatcttaatgaagctgttacataaaaataaaaaagcaaagcaaaaggtaccacaatatttattgttcttttctagactcagtctggattctccataccatttgaatattgcagtaatgaacactatatgtttgacttttgtataatataactagataacatagagacatctacatttcatatttcttttcacaatcccaattttttaaacctatatatttataccagtactgaattattagtgtcatttttaatctgacacatatataacatgacacagtgaatagctgtcaaattaagtgtcactatatggctattgtgtcatatatggtcatattctaataaccagtctttatgtattatagatttgtgaatttttcttttttggaggatggagaataaggtttggtgtgctatttgaattttgctcacagatctaatctggcattttcacttttacttttagatagttttgttcaatttgttttcaaaaaaattagaagctttttgggggaacaattgcaagagtcattccatataattcctcccaataatgttatgagtaaataaaaattaatatattcacccaacaaattaagttctcaatctgtgccaaatcctatgctatacaatgagtaacatgagctttgggaactgccttcaaacatgtgaagaaccagataccacagaaaacaaaaggaatacattaattgagaaaacatcacataaataattttggggggggcttcctttattttattttattaaaaaaattttaaataggtttttggggaacaggtgctgtttggttacatgaataagttctttagtggtgatttctgagattttggtgcacccatcacccaagcagtgttcactgtacccaatgtgttgtcttttatccttcaccactcccacaccttcccccgagtcctcaaagtccaatgtaccattctcatgcctttgtgtcttagagtttagctcccacatatgagtgagaatgtacgatgcttggttttccattcctgagctacttcatgatatggtttggctgtgtccccatcaaattctcattttgaatttccatgtcttgtgggagagacctggtgggaggtaattgaatgatgcgggcagggctttcccatgctgttctcatgatagtaaataagtctcataagatctgatggttttaaaaggtgttcccctgcacaagctgtctcattttttgcctgccaccatccatgcaagatgtgacttgctcttccttgccttctgccatgattgtgagacttccccagccaggtgaaactgtaagtccaattaaacctctttcttttgtaaattgcccagtctctggtatgtctttatcagcagcatgaaaatgggctaacatagcatattggtaccagcagagtggagcattgaagaaaagatgcttgaaaatgtggaagtgaccttggaactgggtaacaggtgcaggctggaacagtttggagggctcagaagaagacaggaaaatgtgggaaagtttggagcttcctagagacttgttaaatggctttgacaaacatgctgatagtgatgtgaacaatatcatcttccaggataaggtggtctcaggtggagataaggaacttgcttggaactagagcaaaggtgactttgtcatgttttagcaaagagactgttggcattttgcccctgccctggagatttgtggaacattgaacttgagagagatgatttacagtatctggcagaagaaattcctaagcaccaaagcattcaagaggtgacctgggtgctgttaaaagcattcagttttataagggaagcagagcataaaagtttggaaaatttgcagcctgacaatgcaatagaaaaggaaatcccattttctgaggagaaattcaagccataatgaagatccaaatgttaatcctcaagacaaatggggaaaacgtctccaggttatgccagaggtcttcacagcagcccctcccatcacaggcctgaaggcctcagaggaaaacgtggtttcatgggctgggcccagggtcctcatgctgtgtgcagcttaggaacttggtgctctgcattctggctgctccagccatggctgaaaggggccaacatagagctcaggccatggcttcagagggtgcaagcctcaagccttggcagcttccacttggtggtgagcctgcaagtgcacagaagtcaagaattgaggtttgggaacctccacctagatttcagaagatgtatggaaacgcctggatgtccaggcagaagtttgctgcaggggcagggctctcgtggagaacttctgctagggcagtgttgaagggaaatgtgggattggacccccacacagagcttctactggagcactgcctagtggagcagttagaagagggccaacatcctccagaccccagaatggtacatccactgacagtttacaccacacacttagaaaagctacagatactcaatgccagcctatgaaagcagccagtagggaggctgtaccctgcaaagccacaggggtggagctgcctaagaccatgggagcccacctcttacatcagtgtgacttggatgtgagacatggagtcaagcgagatcattttggagctttatgatttgactgcaccgctggattttggactcgcatggggtctatagcccctttgttttggccaatttctcccatttggaatggctgtatttacccaatgtctgtaccctcactgtatctaggaagtaacaaacctgcttttgattttacaggctcataggtggaagggacttgccttgtctcggatgagactttagactgtggacttttgagttaatgctgaaataagttaagactttgggggactgttgggaaggtatgattagttttgaaatgcaaggaagtgatatttgggaagggtcggggtggaagtatatggtttggctgtgtccccacccaaatctcatcttgaattcctatgtgttgtgggagggacccagtgggaggtaattgaataatgcgggcaagtctttcccatgctgttctcatgatagtgaataagtctcacaagatctgatggttttaaaaagaggcattcccctgcacaagctctctctcattttttgcttgccactatccatgtaagacatgacttgctctttcttgccttacgccatgattgagaggctttcccagccatatggaactataagtccaattaaacctctttctttgtaaattgcccagtctcgggtgtgtctttatcagcaccgtgaaaacagatgaatacacttcacttagaataataatctccatttccatctacgttgctgcaaatgccattattttgttcttttttatggctgggttgtattccatggtatatatataccacattttctttattctgtcattgattgatgggcatttgggctggttccatatttttgcaattgcaagttgtgctgctgtaaacatgcatgtgcaagtatcttttttgtacaatgacttcttttcctctgggtaaatacctagtagtgggattgctggatcaaacagtagatctacttttagttctttaaggaatctccacactgtttttcatagtggttgtactagattacattcccatcaacagtgtaaaagtgttcccttttcactgcatccaaaccaatgggtatttttttaaatttttttattatgaccattattgcaggagtgaggtggtatcacattgtggttttgatttgcatttccctgataaataatgaggttgagcatttccagatgcttgtgggccattggtatatcttttctgagaattgtctagtcatgtccttagctcactttttgatgggattgtttgttttttcttgctgatttgagtcattgagttagattctcgatattagtcctttgtcagatgtatagattgtgaagattttctcccactctgtgggttgtctgtcaactctgctgattgtttcttttgctgtgcagaagctttttagtttaattaggtcccatctatatatctttgttcttgttacatttgcgtttgggttcttggtcatgaagtctttgcctaagccagtgtctagaagggtttttctgatggtatcttctagaatttttatggttttaggtcttagatttaagtccttgattcatcttgagttgatttttgcataaggtgagagatgaggatccagtttaattcttctacatgtggctagccaattatcccacaaccatttattgaatagggtgtcccttccccacattatgtttttgtttggtttgtcaaagatcagttggctgtaagaatttggcttcatttctggcttctctattctgttccattggtctaggtgcctatttttatactagtaccatgctgttttggtgactatggcattagagcatagcctgaagttgggtaatgtgatgcttccagatttgttcttttttggttagtcttgctttggcaatgtgggctcttttttgtttccttatgaattttaggaaataattctaaaaccccaaagtgactgaaaataatttgacctttcttagagaattatggtaggaagctctttgctgagccttgtcactagagggaggtagcacatccaaaataatctatctttagacctgaaacacaaaccctgaaagattgctaactgacttggttcctagttctatgtaaaggagttcacatatacagtcacaagagggagctgttacagctgcaaatccaagctccttccagggtgagcgaggttgtcattgagttgtataaggaatttatgttcattctttttgccaccttgtgctttattatctctttttgagtgtgtgcacagtttcaaagacatgggtaagccccttcccaaatgcagagcagaagtgaccctgaatgggaaaaacagagaagtgattaatacatagctcaattttaaatggtgaaatatttgttgctataatggactgacaagcttagttattgtagcagagataatgagtaattttaattttattccttcccatttctttaataaccacttttgaaaataactagaaaaaccccttcatagttacttctacctctcttatcaaatggcatcatttgatttccctctccaaacctcttcccatttcttcctttctccttcaatgtatgccactcctaggcatcatgaagatgagaaagcatatgttaaagaggagttcaagtggcatagaaataggggtcattcaagccattggctcctgtctcaaaaccagaggcacaggcaatgtctatctagaagacacttaggacattattccaggagccagtgtgggagacctgagtaccaggaaacttggcttctaacctgagttctaaatttgttctttcctttcacacttagcacagcaatattatacaattatgaaattacttttgttatatatgttgcaaataccttctttcattgtgtcatttgattttcaattttgcttatggtaattttttttaccaaaaagaagtttctaactgttgaaattaaattatatgctactgcttcttctaagacttactcgccctgaagatgtggatagaaattcccttctttcccttacagcacagggctcacatagacttcttggaataaagggctgttcttaccagctcaatgggttgtcaaactaccaattaatggtgggttttgtccttaccataataagggatgggtaatcccatttacttctttagatgtagcctacttgagtttcagccttgaaaatgatcttaatggaaactttctgaattaaagctagatttaaagaaaatattcttcccctctttttaaagttttatttttttaattaacaaataataatcgtattttatcttcttttaaaatgtatgtttaaacctgggggtgggctagacctaaccaggaagctgctctatctttagctgacgatttctggggagcactcaaattgaaacctgcctgatgtgggatgtgctgtggctgctgctttgttgcttgggacctcctctgacctaggatcagacacagagtctgagttctggggcctggaacctcaatgtgcacttgaacaatgaagttggtgacaagcattactgtactcctatctttgggtaagtgttctgggcctaagaaagcatagttttgtggctaatgacaaaagagagttatctgctgtctccatgttttctaccatgatttaccaattgcgggaaaaaatttgtttctatgtgtttcttgagggtgtctgagcgtcagtgtgaggggttggtcatatccactactcagagaagattctccaggtctcacagctctcaagctgtaaggagttttaggttcattgagctcaagggtcatggaagatgggaaatttatttttggccttgtggctctgcatagctcaggaacaaataaataccagtaatatttatcttgtcctgtgcaacacacataaaaacactcaaatatggagtagggcagggaggacagttctggagcagtggtgaacctgaccttcagatgcaccaagagctgatgatccagagctaatctgctgtttttcaaccccataggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagaccacagtgggacagatggggctgcagctgtgcaatatctccctggtgatgaaagggaaggcatctaacgaggccactgcacaagaaggagcagaagtttaatagaggaagaagaaaatttaaagaagaaaagggaaaagaagtaaagaggaggtggtaaggaaatcaatgagaggatgagaggattaaaggaatgaagaaactgagaaagaatagctaagaagtcctgaagaaaggactgagaagcttggcgaagagatgaagaatcacaattggaattctgcagtcaggaagaaaggaaataagaattttcccggacgctttcttttaatcaactcttgctttccatgtagacctcactataaaagatgagaaccatcatctggtagtcccaaagcatttcttcatctagccccaggcaagtgcctgggctttgaatattatatcacattagtccttccaacctctcaataattgaaatgaatttcagaaattgattcatttgcccttacgaaaaatttgaaattttatttgttactcatccatagcacatactcttgggatatagatgatttctggaagggagcaagaaagtggtggatatgtgaatattgatttcattttttaaatctatgttgaaatatctctattattaaacaaaaatacacaaatcttttttcattgtaaaagattcaaactattaagtatgcgaagtaaaaccttagaggcccaaactgactgtctccatctccatcccattttctcttcaattcctacaataacccattttgacagtttggagagtgccctgatgatcatactccttttcatttatgtggatactcacataaatatctacccaattttattacataagttggaacataccatgtgtatctgtctgcaacttgcttttatttttatttaaaaatagttttttgaggtgtgttcataccgagatacatgtgtatgcatgtgtgtataaactggccttattcttttcaatatctacaaatgttcacagtatggttgtataataattttacttacctcacctatatcatctctacatatataaatatatatgacatatgtgtatgtgtgtgtgtatgtgtgtgtgtgtacatattccttatagattccgaagtggaattactggatcaaaagatatgcctattttatatttttatagatattgaaaagttgcattccaaaatggctttaacagtctaacccaagatcaggaacatggcaaaaatgtctactctcaccgtttctattcaacattatcctagagaatctaaccaatgcaatgagacaaaaagaaaaaggaaaccaggctttacctattacagatttgtgaatttttcttttttggaggatggagaatgagggttggtgtgctatttgaatttttcccacagatctaatctggcatttgcctttactttggatacttctgttcaatttgttttcaaaaaattggaagcttttttggaataatttcaagagtcgttccacataacttctcctaataatgttatgagtaaatagtaattaatatattcacccaacaaattaaatctttaatctgtgccaaatcctatgctgtacaatgaatgacatgggctttgggaactgccttcaaacatgggaagaacaagataccacggaaaacaaaaggaatataataattgagaaaacaacacagaaataattataaaagctccgaagtgactgaaaataattctgtctttcttagggaattgtggtagcaagctctttgctaagccttgttcctagagggaggtagcacatccaaaataatctatctttagacctgaaacacaaaaccctgaaagatcgctaacttgactttatggtaaaggaaaccatatttaactttttaaaacgtaactatcattttgcaaacaatagaattgtctgtgtagcaaatcctatagacaaaaaaactactgtaaccaataaatgagttagataaaattgcaagatacaagctcaatatacaaaataatgctgcttccatacagtaacactaaacaagcagaattgaaatttatatagatatgcatatgtatatttatgcatttatatatttatgcatacatatgcataaaaaacttttaacaaaattttagcagactgaatctaacaatatataaaaaggataatacataataatgaagtggggttcgtctcaagaatgcaatttatatgtatatgaatttcaattctgggccaggcacaggggctcatgcctgtaatcttggcactttgggaggctgaggcaggcagatagcttgaggccaggaattcaagactagcatggccaacatggcaaaaccctgtctcgactaaaaatgaaaaattagccaggtgtggtggcacacacctgtaatcccagctactcaggaggctgaggcacgagaatcactggaacctggggggcagaggttgcagtaagccaagattacaccactgcattccagcctgggcaacagagtgagactctgtctcaaataaataaataaataaatttcaattctggcgtgtgtgtgtgtgtgtgtgtatgaatacacttgacagaagttgtctaaggcctgtacactaaaagatataaaaaaattctgagatacatttaagatctaaataaatggaaagagttattgtgtttgcagattagaagactcattaaaattctctccaaattgacctacagattcaatgtcattcaaatcaaaatcccaacagaaattttcatagaaattgacaagtgggtctaagatttatatgaaaatgccaagggactacaacaaaaaaattctttttaaaaaacacaaattgaggaacttacactactgatatgaatacttttatagttacaataatcaagagactatgatattgatataaagatagacaagtagaacattggaacacaataaaggatccaataataggccagcatgtacatagttgattttcaacaaaaataccacaacaatttgttatgaactgaatatttgtgatctcccctgcaaattcatgtgttgaaatcctaacccccagtgtgatggtattaggaagtaggtctttgaggaagtgattaggtcataaaagtgtagccatcttgaatgggattagttccattcagtgaaaccctagagaactttcttgttctttctgtcatgtgaggacaccacaagaagactgccatctatgaaccaggaagcaggccctcaccagacatgagatcttccagcccctcgatcttagacttcccagccttcagaaccatgagaaataaatttccattgttttagtcacacagtctatggtattttgttatggcagcccaagctaacaaacacaatctcaaaataaatatgctgaaagaaaccggacgacagaaagcagatacggtatgattctgtttacataaaactctagaaaatctatagtaagagaaggcagactagagattgcctggggttgaataggcattgggatgatatattggaaaggtatacagaaaggattaacaaggaacacaaggaatagagacacaaggaaactttggggagtggtgcatatgttctttatcttgattgtgatgatgatttcacatttgtatgaccatgtcaaaaattatcatattggaccttgtaaacatatgtaatttgttatatgcaaagtgtacctcagaaaagtagtttttaagaaggctcaaaacaaaagtagacagagataaatattgaaaaataatcactctgtactatagagaacagaattttttactttctcttaattatggagggtaaactttctcaagcatgcaagggtaacatatgttatgagattatattttctttatctcataagtggcatattttaatgcaataaatagatctatgtcatatataaattaactccagaaaacctgtccattattcagcatttctcagtctggccaaagagtggcagtgttaaaaaagtatttgagtaagattgtacagtgctgaacaaacaggaatccaggtatggcttctgattggtgcaatctcctgcaccaatgagcaaagtaacttctgctggggaagctcattcagtaaaatctgatttaactgtgttttctaaatagctaagggatggagactgttctgcaagtactcctagggatattggggttccaagcagcctgtgagtatgtggttagtctgggagaattgcgagatggtgacagcatcctgagggcaagagtcgagtcatcttctgttctgggaaggcccgtttgagagccagatatgtgttgggaaaaaaaatgacaatactttgttttaatgtgacaattctgctgcctaggggaagtggggagggggagaaaaacatcatccctaccatgaccatgaaaatcttatgagggtcttctgtattttctttacattgtctttttgaacaggggtcagtagccaagaactggagcagagtcctcagtccttgatcgtccaagagggaaagaatctcaccataaactgcacgtcatcaaagacgttatatggcttatactggtataagcaaaagtatggtgaaggtcttatcttcttgatgatgctacagaaaggtggggaagagaaaagtcatgaaaagataactgccaagttggatgagaaaaagcagcaaagttccctgcatatcacagcctcccagcccagccatgcaggcatctacctctgtggagcagacacacagcgatcttcaggcctctatcagctgtctccaaacctgcagctgggccacatatgctcttctgacatggggctcctgagatgtggctgggacctttgccaagacatgaagtctcagaacgttgcaattgtcttattggaaaaatggggaggagagtaggaatgatacaagggggagctatatcactaatcccaaatttaatttgactttattgtctggtagttatgttactttttagtagatggaacatcaaattcgaatgagaatagcatgaatttcagtgatttatgcaagaactatgcacgaatattatgtccctgttgtgccaaggaacttctttccctttgctatttacccaccttgttaataaaaagaaattgtgcattgtttgtcagattctttgtcacagattaacattgtaccaagagtgttagaatatccatactgaggagtcatgggcaatagttttttctaagtttgtagtatagatatagaaaaagacaaatgtttagacagataaataggtgatagatagattataggaagctagattattagatagatgataggtagatagatagataataggtagattagatagagtgagctagagagaggggaatatattaataaatatctaatgcagtcttagactggcctccacttctcttctcattgtgctttcattcatattctagtctcagtattcttctggccactccaaattatcagcttaaagaattgtttcccagttgtctcagtatgaagtggagaagatgttaccttcatcctccactccacatcagaatagtgctggcctacagtgggtgtttacaagtattaaactgatactgaataactgataagatcataggttagagagaaataattcacatgtttcttaaaagctatgtgatgttgaccaacaactttaactttacaagtctttattttccctctgtaaagatgatacaatcatattattttattcatatgttcttgttaggatgaagtaaggttatagattacatacattaagtatctggtgtattgcaagccctcaatatttgagatagtatttttactattaatcaaacaatgacaatttcaagcaagtcaaaattctcacataaaagtagggaagttgatcaacatgatatggcttcaacctaactaggagatgttctattctttaaatttagaaaagaaaggaggaatataatggtctcctgtcatcagaaactgcctagtgacctggtttcaaaagaaattgcatgtaaaatgggaatgatcatttatgttggccaaagtcagggaagatttttaaaaatcaagtcgaattagattattttctgttttaaagaaatgttacctataccacccactgggagaaaagtttgctaaaataaacaggaaagagagaaaagagagaagcccatgaaagaaaatgtttggcaacgtgataagaggaaaagcaagcaggaaataagaacataagtttctgattttcatgaaatgttccgagtaaagtgacacttacctatgtgtgtaaatatgcatatacatatacaaatctcaaactaaagagtgtacatatttgcattttaacctaaaatcaaatttttctaattggaaaataatataaagatattgtctccagtagaatgctgggaatattaagggttgaaagtatgaagataagtagtcataaggatgtttagagattaacctgccatgtcccacaaggctggtaaatcaatgttatcaggagaaagaaactgttaaattcacatcagcgtcttaggtcagcctaagcaaataggttatatgacatgcaacttacccttctcctctttttttctcccccatcaaaagccaatttcctattctgagaaaataattcaccttctccagtgattctgcctcagaatgtccagcaaactgaacaaggctgagctccagacattggttttgattctgggcagcagaaatttccctatgggagaagatgccagcatgacttttcctagtgtgcaatgagcagcgaccagctctgtctacctccttagggatagcccctgataggaatgctggggttgagcaagaggaagagtgagtgattagaagaaagaaggcaggaaccaagtttcttttcctcctgccttgagtgcaaggtttagttccttttctaacagctcttggcaattccattataaatcaggtgaaagaattagtctgatttttgtttgtttgtagggcctagcatgtcatagaaagccactaaattctaatcagcaatatctggacagtaagggagattgtgaacttagttttcttacaggacataggtattataattattattgtggtaaaaatttcctcctagcaggaagataatttttttgtgtgctttgggaatcacccaaaagttttccactgcaaaaatcaatggaataaggaactgatattttctaaaccttcagtaagtggctaaatctatcaggcttatctattcatccccatagtgagaattccttgcaatatgtgtttgtggcattcttatagataccacagtcagaaaaaaaggggatggattaaaataagcagaaaaatttgctacattctgtgctaactttaaccccatataaatgctgtcttataagtagatctattaaatagggccatccatagccacagcctttcatattttaagtaaatatcacaacataatattttcatcagaaaacttgtctccaatttctagagccttttgttactcctggcactatcttagtaggactttagtgtgccagatatgagcctgctagatttaagtcaaataatgatttattcttatgccctcttctcaactgtgttgatcaaattcataaaacaaatgttagccttaaattccttacttcacttccttgtcttcacttcctctgggacatagtcttgtcttgtctagtctagtcttatgctgcagccttgacaacttgccaagataaaaagttgagagttacgatagtagaaagaagagctacagagaataaacagaatgagaaagtataaaatatgattaaatggagttccagaaagaggagagaggtgaatgaggcagaaacaatatatgaagagataatggatgaacagtttttaaaaaatggatgaaagacatcaattcacaattcaagaagacaaaaacattcctgggcaatttatataaaaagaagtgtagtgtgtgtgcatgcatgcgtgcatgtgtgtgtgtgtgtgttcagagtaaaacagcagaaaatcttaaatcaagaagaaaatcttaaaaatcaaaggggagggtgaaaaagactgttttcaaagaagtaaactgacagctgacttctcaaaaataacaatggaaaccaactgagatttgaattatttttcaatgttcagagagaaaataactaacatcaaattttgtataaagcagagcaattcttaaaataagaaataaaagcatttaaagaaaatctgcagaatttaacggtatattttctctaaaggaaactccacaagtagatggaaaggatgagggcctggattatactgcacctgccacctgtgtggttgtgctcaaagaacagaacctctttgggatggtttctaaatttcaaaataaagatgaggtattctcagctagtctcactgtattttattaattgaaacaccatatgtgaaacagaagactctaatgcaaacgtaaagagatttgttactaaaaccttaggccaagctttggatgttcttaaaagggcaatggcaggaatgagaatggggaaaatgatctatcctcagtgagttgtaggacttagagaaagcctcaagggctgtcatgtgttttatcatgtcctgagaaacaggtttacaaatattagcacctccttactgtgctggataattctattcggtttcctccagcagtttgtgataccccctatgtgtagagtgggtatgtagggggcaaacaaaggactcatctgttcttgctgccggcaagctgtagccacatccagttggctctcacctcccaaatagcttcaaagagaagcaaatcatattcaacagtttttgtggcagaactcatcctgcagaatttttaaaaaacttgttttatcttatggcctttgataaaagttctgaacccagggccagttgtagcagaatatggacatatgaaaaatctgcctttagtctcttgccattccttcaccattgcctcccacctattctactgctcctgctttttacccagcccctagtagtattctatgatgttttaatactgttagcctgcccaaagcctgatatttctagtcactgaattgctcttcagaatcttctcctacactattgagtagatatatatctctctccactcaatctctaaaataaagtggtttatagcctaacttactctcaatgtaatgttctaggttaggtctccctggactgtttgtatttgaaaaagagatgtagaggagattccaagaaagtctcctcaaagatacattctcagttacggtggcagttggatagaaaagatgtttttattgtaaaatactctttcccacacttctcagccatagtgtaggctgccagtgtttggtcagttcccatcagcaggaacacaggcaacatactgttagcaattttttttttttttttttttttttttgagaaggagtctcgctctgtcgccaggctggagtgcagtggtgccatctcagctcactgcaatctctgcctcctgggttcaagccattctcctgcatcagcctcctgagtagctgagattacaggcatgtgccaccacacccagctaatttttgtatttttagtagagacagggtttcaccatattggccaggatggtctcgatctctttgtcagcagtttttaaaacatatgtttttattccaattattttagaaagataacataattcagaggaaaaaattaaagattctattgcttgaaaatacatagaacaatattctatttaactacaccttgtctatgtttagatacacaaagactcaccattgttacaattacctagagtattcagtacaataacatcctgtgcaggtttgtagcccatagcctatcgtgtagcaggctataccatctagaccagtacgctcttataatgtttgcacaatggcaaaattgcctaatgatggatttctcagaacgcctgtagttgagcaaggcatgactatatcagtaaaacttctacatgaaagaataggcaggggaactagtttgtctaagaaaacatatgaaaatttaactgtttcagaggcagcacagtcaaaaaagtaaaggtttgtaatcttagatatcactcaaatactagtcctcctacttccaaaccagataaccttgggcatgtgactgaatctttctgaacttagattcatctgaaaaatgaataccatctatttcctagagtggtaaagagtcccatatgctacgggacttaggattgcttaggattgctaaggatagctttggctattcaagctcttttttggtcccatgttaattttagaattgttttttcaaattctgtaaaaatgaagttggagatatatgagataaacaatacacattacctgccacatattaactaatatatataacaaacattatgtaaatgacaaagagtactaggtactcccaggaccttttatgatcctcagaatatttttttgaggtaggtattattatcttgcttttattgatgagtaaactgattttcagagaagttaagtaacttgttcaaagtcatgcaattaagaagtggcagagatgtggtagtttttgtgatagaattcttttcctttccctgcctgttgaacggtctgcatttagacatttctttaaattattttcagtttctttcccttcgtccccacaaagagcactaaaggtcatggtaaggtaggatcatttgaatcatgttatgatcttcctaacatgaatgactcctggcttttccagttaacaggtagtggtccattatgctgtggttatattttctgcatgtatgatgatataacgtaactggccaggcacagtggctcatgcctataatcccagcacttttggaggctgaggcaggcagatcacctgaggtctggagttcaagaccagcctgaacaacatggagaaatgccatctctcctaaaaatacaaaattagctgggtgtggtggcacatgcctgtaatcccagctacttaggaggctgaggcaggagaattacttgaacccagcaggtggaggttgtgctgagccaagatcataccatttcactccagcctgggcaacaagagcaaaactctgtctcaaaaaaaaaaaaaagaaagaaagtaaccaaaagactgtcacttacttgccccatgacccctgttacatagcctttgaacctcagtttgtcatagaaaaatgaagaaaatagtctctcccatcctattgctttttactgtattaaatgtaaatgtatatggttctttaaatgttatgtattattcagatttattacaataattgttatgtaaatgacatctatctgataatagaatgaggtctggagttcaagaccagcttgaccaacacggagaaatgccatctctactaaaaatacaaaattagctgggtgtggtggtgcatgcctgtaatcccagctacttgggaggctgaggaaggagaatcacttgaacccaggaggtggaggttgtagtgagccgagattgcaccatttcactcctgcctgggcaacaagagcaaaactctgtctcaaaaaaaaaaaaaaagaaagtaaccaaaagactgtcacttatttgccccatgacccctgttacatagcctttgaacctcagtttctcatagaaaaatgaagaatatagtatcttccatcctattgctttttactgtattaaatgttaatgtatatggttctttaaatgttatatattgtttacatttattacaataattgttatgtaaatgacatctatctgataatagacacagcatattactctattaactgcatatacagtaaaaacacagtatagaagattttaagataatctgtgtctatttttgtatcagtgacatgctgtttgggttactatagccttgtagtatagtttggagtcaggtaatgtgatggctttgttctttttgcttatgattgctttggctatttgtgctttttttgtcccatattaattttagaattgtttttttcaaattctgtaaaaatgatgctggtaatttgataggaattacattgtatctgtatattgctttgggtagtaattttaattatattgattgttccaatcagtgagcatgaaacatttttttatttgttgtatcatctatgattcctttcatcagttctttgtagttctccttgtagacatctttcatctctttggttaaaatgtattttctaagtattttattatttgtatgtgtgtatatcataaatggaattgagttcttgatttttttccttagcttggttgttattggtgtatagaaatgctactaatttttgtatgttgattttgtatcctgaaagtttactgaagtcatttatcaagtctaggcatctttcagaagactgtttagggtttcctagatataagatcatgtcatcagtgaatagagataattttagtttctcttttttaatttggatgccttttacttctttctcttgcttgattgctctgcctaggacttctggcactatgttgaatagaagtggtgagagtgggacatccttgtcttgttcctgttcttagagggaatgctttcaaattttcctcattgggtatgttgtcatggatgacccttatttgtcatagttttttttattattttgaggtatgttcctttgatgcctagtttgttgagggtttctatcataaaaggatgttgggttttattgaatgctttttctgtatctattgagatgatcacatggtctttgtttttaattctgtttacatggtgaatcacatttattgatttgcatattttgaacgtagaccaatggaacaaaatagagaacccagaaataaaaccatatacctacaaccaactgatctttgacaaagtcaacaaaaatacacaatgaggaaaggacatccaattcaataaatggtgctggaaaaactggatagccatacacagaagaataaaactgaatgcatatctctcaccatattcaaaaattaagtccagataaaataaagacttacatggaagacctgaaactacaaaaatcctggaagaaaaactaggaaaaactcttctagacattgaactaggcaaaaaaatttatgacaagatctcaaaagcaaatgcaacagaagcaaaaatagacaagcagtacttaattaaactaaatagcttctatactgcaaaagaaataatcaacagcgtaaatagacaacctacaggatgagagaaaatgttttcaaactatcaaccaacaaaggactaatatcctgaatctataaaaaaactcagacaactcaacaagaaaaaaacaaccccattaaaaaatgggcaagggacatgaacagatatttctcataagaagacatacaagcaaccagcaaacatgtgagaaaatgctcaacatcactaatcatcagagaaatgtacatcaaaaccacaatgagataccttctcacaccagtaaaaatggctattattaaaaagtcaaaacacaaacagatgttggcaagaatataggaaaaaaaagaatgcttatacactcttggtgggaatgtaaattagtacatctatggaaaacaatatggagatttctcaagggattacaaatagaactactattcgacccagcaacaccactgctacccaaaggactacaaatagagctaccattcaacccagcaacagcactactacccaaaggaaacaaaattgttatgtcagaaagacacctgctcttgtgtatttatcacagcactatttacaatagtaaagtcatgaaatcaacctaagtgtccatcaatgtattattgtataaagaaaatgtggtatatatacactgtggactactacacagccataaaaaagaataaaaccatatcttttgcagcaacatggatttagcttgaggccattatcctaagtggaatcactcagaaacagaaaataacgtactgcatggtctcacttataactgggagctaaacaatgggcactcatgggcatatagagggaaataatagacagtggagattccaaaagggggaatgatgggagggttgaaaaattacctattcagtacaatgttcaccattcgggtgatgggtacactagaagcccagacctcaccattatgcaatatatccatataacaaacctgcacacaaatgacctgcatcgtagtaacagtaataataaatatcaaaattatatgcttgtctagggcacttacaatgaatggggcttgcaggactggaaggtgctctgtgtaattcagcaagtgagtaagaggtcagtgaatgtaaaagcctaggacaatattatacactgctgtagactttataaacactatatacttaggctacagtaaatttgtttaacaataatttcattttctcaagaataagttaaccttaccttactgtagctttttttactttataaacttttaatttttttaactttttgtctctttcataatagcttgaaacacaaacacattgtatagctatacaaaacaattttcttttttatatccttatttatatccttttttatatccttattcttttttaatttttttttctattatttaaacttctgtactaaaaactaagacacaaacacacatattagcctaggcctacacagagtcaggatcatcagtattgatgtcttccacctgcacatcttgtcccactggaaggtcttcaggggcaataacatgcatcagctgtcatcttctatgatagcaatgtctttttctggaatacctcctgaaggacctacctgaggctgttttacagttcagttctttataagtagaaggaatatactctaaaataactattaaaagtatagtatggtaaacacacaaacaggtattaccgtttattactatcatcaagtactatgaactgcacataattgtatgtactatacttttatatgattagcagtgcagtaggtttgtttacaccaacaacaccacaaacatgtgagtaatgcatttgtgctacgattttacaatggctataatgtcactaggtgatagcaatttttcagctccattataatattatgggagcactgtcataaattgttgatggaaataccattatatggtgcgtgactgtataataaaacctgttccagtttgaaccattggccagagacaccaacagacacaatgtaatcaagatgtagaccccaatgtcagccttctagacacaaatgaaacaacacccaacttagctcaagaacactttctaaaagcaggaggctccagttccccaatctgtgggaacaaggagaaccacagtaagtgaagaggaaaatcattatctctgaacttgtcagaagaaaaatcccatcaaggaatgcttttgagaacttgaattctagggaagcccactggaggccacagccactacagaaatatagaggccacagcttcctgacatgcggtgaggccacatctccactcacttcctgtcagtaggtgtcacttgaacaaattttctcatgtcctggccagtcacctggagcctggaggcatgtcttactttgcatacacctctgtcaaaatgcgtatcagacaattatgttataaattgaatgtcttaggtgttacagagtaggtgttgtggaatgaatatttgtgtatcctccaaagcgcactctctctttctctcacacacacacacatacataccccaaggaaaggccatgtgatatcttgattttaaacttccagcctccagaactgtgagataacaaatttctcttcgttaagccactcagtgagtggtatattgttatggcagcccaagtagactaatacattaggttattctgctactgacccaccttactgagctagacctactttggtccccacatgtctccccagggacactgtacgaagcctggagctatgtcagtttttctgtactcaaaagtagtgccctcctatatttacctcttgtttgttttattggagttcctggcaggtatctcccttctctttgaactgtaaatagaaataatccttctttttgaagtaggattttctttctgaacaagcttataatttcctaccattgatcttcttgcatggcaatttcaattaaaaaatcatttgaataattatgttagaatacacagcaactatatttcttaggttagtgtagtttgcaaacaaaaggcatatatgttttcctagtaaccgcaatgtgtgtgtgtgtgtgtgtgtgtgtgtgtgtgttttaatttccctacaaatcactgctaacagccaaggaaagcgaggctatattctggaaggcctgggagatatagtcccctgtatgtgtatgaaatctgtttggaatctcatgtactatatttaaaattcatttgttactttctattatgtaatatattctcatttgtttcaacatacaaaaaatactttaaatcgattatttaaatgtatgtcatgttcatcccagagcttaatgtcacccttcatacattcatacactactacttggcttattcttcttgaggagagagaaatgtattgccagtattctcaataggtacactttcaaggctgagacagcagggctcatgaagaactggaacaatataaaccattgccgagactgcaacagcaaccatgatgatctcaaggaggcgacagatctaatggtaatgggaaaacacacccttgaggaatcagtgagcccctgcagctccctgtcatctctgtgcctcccacattccattaagagaatatagaaggaatgcatttttcatctgaattaaggtgttttgctttctgtttattgtttctttattttccaaaaatatgtttttcaataaaatctggcagtgattaaaaagaaaaaaagcaacataagattgtatttttatttggtggaaagcagcaattcattttaggtaacatgccaccacataacaggaatagagaaggtaagaaaggtaaatatacatacagaagtaagtcatgggcaaacctaaacaactaagaaaaaattagcaatgaaattaaaaggagaaaaatgcccagggaggcagaaatagattttcctgctctcctacgtctaaagagcacaatgagatacaaaacacaaatgccagtagatggcagaagctatttacctaaatcaggattgaggctatgaggcatagcttagacactcagtccagatcctaggcatttgaaactccaagttgcagaatcaattttgatcttaaaaaccaaacttcttcaaaattcccttctgtaaaagtgaggtttgctactattcaaagttttatttgcttcttaaagaatagccagaatgttcctaccactgtgttgataagcaaaggtaacattgcctctatcaggggctttttctcttttatttaagtctctgccttttatgtcaagggattcttttaatgtctaatgatcctgggatgctcattcatacttagtaggatacaaatctgagattcaagcaaagaaaaatggctccagttcctgtttttaaatacttcttcacttcactctcaactaagcctgatagcccagaatttcatgttatttattcaatatcttcagaaaaatagtcttttttccacaaaagtggttggaaaggagtggacacctgactattccaggtcaaatgggaaatctgagagtataactgcaatttattcaattttactttgcattttctctataaagtctcctacccctaccctctctctgattttctgaggtaccaggtatcctactcactaagacttctggtgcacctgaatttttgttggcatttgcttctgtgggaccttagaatttgcctttcttcagttcatttaagtcagttaccacttgttcattcacctgcattttccaaaacatctcacatgctgttatcctttgcctgttctatgtgtcctttggggttcataacttttaaaaacatttttactctcatttcaccaggtactcagaaaggaatagagaagtatgtttccaattcaccatacttaattatcagtctagccttcactgatatttcagagcaattataaggtgcccaggggcagagtttccatctgtcttgttcatgtctccatatttctctaatatatagtgaatactcattaagtgtgttcatcaagtgaaacggagaaatagaagaaactgaaaaagtggcatgaaaggacaaaaatttagcatttcaccatatgggggcagtgtctctattcatagctaaccttcaaggttagctcaaaaccctgggaaaacatctggtaagagatccgattggctgatatctggaacagagatttaaatttcgtggtagtgtttttagtgtcactctaagcccaagagagtttcttgaagcaaaaaaaaaaaaaaaaaaacccattcaggaaataattctttgctgataaggatgctccttgaacatttattaataatcttgtggatgcagctgacatgtgagtcttgagagtttctgactcttccatagcgaattctaaagggaaggaaattctgtgagggcaggaggtgaggctttatcagagactatgaaaagaggaaaacagaaggaaaaaagctagagaaggagggaggaaaggaaagacacagatgcaaggctgggaagtttggtgatatagtgtccaacacagctctgaaaaaggtgatctaaagataaccttaaccaccttcttttctctttctaaacaggggtcagtggtcaacagctgaatcagagtcctcaatctatgtttatccaggaaggagaagatgtctccatgaactgcacttcttcaagcatatttaacacctggctatggtacaagcaggaacctggggaaggtcctgtcctcttgatagccttatataaggctggtgaattgacctcaaatggaagactgactgctcagtttggtataaccagaaaggacagcttcctgaatatctcagcatccatacctagtgatgtaggcatctacttctgtgctgggcagcacagtgctccccaaacacctgcagcctgtactcaaacttgcagctggaactctagtctctatgctgccttcagctcttagtcctcttggcatgaaatgtgattatgcatgccacctttgccactgccattctgtcaccacaaactctcctttatccaaggatttgtcctccaaagattgtgctctttgcttgatgaacttgcccctctcaattcatttttagtcgtatgtaatagattttcttagttatttctgccacgatatgaggagaattgatcaacacacagttacagtagaagattttaataagtatctcttttaaaatggatgatatcaataaagtaaaaatgagagtccagaaataaatccataaatctatagccaatttattccaacaagatcattcaatgggaaaagaatagtcttttcgacaagtggtgctgggaccactggatagccacagttggatctctacttcacatatgtacaaaagttaactcaaatggattaaagacctaaatgtaagatctagaagtacaaacacttagatgaaaacatagttgtaaatcttggccaccttggactatgcaacaatctcttatatacaacatcaaaaaaagcaactgaagggaaaatagataaattgggcattatcagaatttaaatctttgtgcatcaaaattcgcaaaatattccacaaaggaaaatgaaaagataacccacataatagaagaatatatttgcaagtcatgtttatctgataaggatctaatatcaagaatatatattttaaactcttacaatttaacactaagacaaatgccaattttaaaacggtcaaatgatttaaaccatcattgctccaaagaagacacacaaatggccaaaaagcatgaaaaaaaagatgctcaacattattattcattgggaaaatgcaaattaaaccacaatgagctgccacatcacacccactaggatgttcataatttttcaaaaaggaagaataagaaagagaaatgtaaaattctaagtgttggtaaggacgtggggaaattggaatcctcatccaccactggtaggaatgtaaaatagtacagacacattagaaaatagtttggcaatttctcaaatgactaaacacagagttaccatttgacccagcaataatagtcctaaatatctacttaagaggtcgaacatgtgatttatttcattggccagaaccacatcatatggccagtactaattgcaagggaggtagagaaagggagcatttaatttgtctagcctctaaaaaagacatgagcatgaaagatgtcaattgcagataaaagtgttggtttaactatccaaaaacatctgccacatcatactaggtcctcattccccagaagagactctgatgatacatcttgatattcttattactgttattaccctaacagcatgtgccaaaggaagctgaagtctgttaagagctctacagagctcttcaaatgtagtattgtttttgctccaaaaaatatactgtaggttttcttccttgcaactgtcctgtgggaaatcaatatctctcaagaggcatcagctgatgtttcagaggaatgatggtccactgcccctgatactgatatgcgcagttccaggcagttcttaaagctagtcgctttaacgcctcacagagatcatcatgttcttaaacatcgatacggaattcacttccgtctccctgagaagcagtcccttgaagacccagcacaatatttccgtgggtcccacatgtgcatatgacataaccctcaaaatcctagggatgttttaattgaggtaatacttttacagctatttataggatctctagcacaattcttttctcaggaacttaaaaaatgggtattagctaaccatgagtaaccatgtttccttctcccttccccattcccattcagctgtatgtaggcaaatctaccatcccaactttctcgatgttgaagctatgatttattttatagcaggctttctattttattttatttttaaacttttattttaggttcaggagtacatatgcaagtttgttatgtaggtaacctgcatgccacgggggtttggtgtacggattatttcatcacccaggtaataagcatattacctgacatgtttttcaatactcaccttcctcccacccttcatcctcaagaaagcctgggtgtctgttgttcccttcttcgtgtccatgtgtactcaatgtttagctcccacatagaagtgagaacatgtgatatttggttttctttcccgtgttaatttgtttagaataatggccttcagctccatccatgttgctgcaaaggatgtgatctcattctttcttatggctgtgtagcattccatggtgtatatgtatcacattttctttatccagtctaccattgttgggcatttaggttgactccatgtcttcgttagtgtgaatagtgctgtgatgaacataggtgtgcatatgtctttatggtagaaaaatttatattcctttaggtatatacccaacaatgagattgctgggtcaaataataattctatagaaggctttttaaagtgtgggctagtattgaaggtaaagattgccttattcagttctgtatgctcctctgttcctggcacaaagaagacagtcaattaaaaatgtttacatgagaggccgggcacagtggctcatgcctgtaatcccagcactttgggaggccgaggcgggcagatcacaaggtcaggagttcaagaccatcctggccaacatggtgaaaccccgtctctactaaaaatataaaaaaaaaattagctgggagtgatgatgcgcacctatagtcccagctacttgggagactgaggcaggagaatcacttgaatccaggaggcagaggttgcagtgagccgagatcacaccactgcactccagcctggtgacagagcaagactctgtctcaaaaaaaaaaaaagttacatcattaaggggcaagatgctaattaattctcatatctgtgcctctgtgccacccagaaatgcagaaggaagcttataaacaaaaaacagtgggttaaattatctgaccttcatggggacagtacaaactatattcataagcagtaatagaacatggcattatttactttattgtggtgttgtcacatcatcagtctcttacttcatgtttctgggttttgtttcttgcttaagatctagagaattaggccactttatcattgtcacaaaaaaagtagtcttggaaaccaagcgatccatcacttcctctcaactgggcaattcagcttttctggaatgcaaatatgtttgtcttcaccttgagatttgaactttctaattagtaattctttttcttagtgatcataaagatcaagcaagaaagtactagtcttcctagacttgaacactacctacatacattatatgtattttactaaaaatagacattcctagacgatgacaagaaaactatgtaataacatttatggaatggaatgcaaccaaagctatactccaagtatactagcgaaggccaaactattctaacaaatatatgccaaacgttcagaggcttaatgaacaaagtttgtctttcttgtgaaaatctggagcagatattccaggtcagcagatgactctgccttacatgatctttgaggaactgaggttattctcatttggggactctgctatttctcagagacttaccatcatatgcagggtcatggcctggctatgccaggtttcacttagcaaggagatgaacgagtgggtatggagcaggcatgaccattcccttaagaatcatggacaagaaataatagaattactgactcctaagattatggacagctttgggtagcctgtccttcaatggtaagacaattttagaagtatctaccatctttcataaaacgtgtggacactagttttcagctattctgcaccagctcacaagatggcggtgttctattttgaatgacttccatgggtgattgagtgggagggatttgaatttaaatagaaccaaatgacactttttttaatggttggctgaattgccaaattgctatttccctttttctgagtgtgtgtctgtgtccgtgtgtgtgcatgtgtgtgtgcacgcacgcgcacacaggcagacgctaggggtagagtgtgatggttcaaaaagaaaaggaaacgcttaaaggtagtgaatcacgttttgcccaggaaaacacacttgataactgaaggatgatgaagtgtccacaggctttactagctatcttttggcttctactgagctgtaagtagggttactacaaagggtcaggggcaaccaggaaacctgaggattgatcctcagaacactaaaagggtaaagtagacttcgttctgacttattgtctgggagccctgtggttccaacggtgaataattatcacatttttctacacaggggtgagcagtgaagacaaggtggtacaaagccctctatctctggttgtccacgagggagacaccgtaactctcaattgcagttatgaagtgactaactttcgaagcctactatggtacaagcaggaaaagaaagctcccacatttctatttatgctaacttcaagtggaattgaaaagaagtcaggaagactaagtagcatattagataagaaagaactttccagcatcctgaacatcacagccacccagaccggagactcggccatctacctctgtgctgtggaggcacagtgctccctagtcacctgcagcctgtactcaaattctacagctgaggctctgcaactgtaagatggggaacttgctacattgagcaagccctcaaaaataaactatacggaaaagcagttattggtcaaaatccttgtgcctatgttgacaattacttttgcagtttactgaatcctaactcagagtcatatcgctgcattcactactttctctgtgagttttctatgggattcagcatagctaatatttctagagggtcactcaggatactaactccattgccacaccattatgctctgtggtagaaagcaagcccttttatcaggattgtacaggcaactgatatgtgcactacacattagggaatctacctaacagctatggatgttttagcttctttcccaggacaggcacatttataggtaaagttctgcctataacatttttttctggacctactagcaaagaacaaagggtaggaacaagcaggtatcattacctgattaaaacaaaaggttttcattctcagttgcattattcttacttactatcttcattttaggattgttgcctatgctaggtacttcattaaagtggtgatagaatttttcaagatattacacattaatttgtgtacttagaaccttaagcagcctacgaaaagaaaggagttagttgaagtaagttatgtgaagctaacataaacttagcctacttatgttgtgatacactctttcaatgaattatgtaatcatatgtatggtatttacaaagagcttgcaatggaagctaccatttattgaaagcaagtattatgtaccttgtattttgcaaatatcatctcattgaattctcaaaatcactttgataaatcatcaatattactttctgttaacatattaggaaatgcagactcagaaagattaagcccccttccccacctcctaccccagacaaataactataacagaatctgaaatcaggtctatgactccaaactatactttgtctattacatgccctgatgttaaacatcactgaggagaaaatttacccacagtgtgaccacaattatgtgtaaaaaatgtacacaaaatacgaaaataatgtgttcaacatgtaaataaaataacatttgcaataatatgtgaataaaataactccaaaagtttgcaacagtattagttatctttgaatactgaacttaatactgttcattgttttactcctttataatattctttatttttcaaattatctactatgaactcaatactattattatttcagaaagaaaaatatacattttaaaataccaaaatccaagtaggctgaactgcattatatgataattatctgacactcacagtagcttaattacaatgaggaatagacatgactatacatagccaaatgatacagcattaaaacaagatttttgattgctagctcttcaaatcactgtagactagtgctctcttcaattgggaatgttttaaaattacaagaagacctatttctcctgagaatttatttgaatgactgtcctatgggtagaatgctttaatatcccatctctgtgtaggagaggacaggcagtaaaggccacccgtgcttgtgagttcattagacaattcattgcaaattgggcatggtttaggtttcactgtctgggaaatggggagatagcctgagaaaagggcaggtaaacattcaaagaggaggggaagaaacagtataaaaattaatagaatgtatcctgccatttttagcctgcacagtcttctgtccattttcctttctcctttctatctacatcaaaacccagaaatcacacagtggatataagaggaaactctgacagtcatttatttaagactgaaaaatagagcgggaaaccctatgcaagatgcccagtgtgtctggctctgcggtgtgaagagtttatgatttagaagccagagatttagctgtctttgatgggaatgtgcagttggaagggggaagtttcttttttcactctttattgtttcctatcctaatgagaaccaaacaatttacatctcaaaagatcaacctgtcaccaaaataacatgtcttttaatgctaagactaaatatccatttgttataaaagaaaaaacaaattaaaaaaatttataacctcaacctacagacattaccactattaactatttagcattttgctttccatttcacctgtatcaatgaacatgaaaaaataagtctgtagagatgtggggaattcaacttatttcaaacaaagagtgtttctcaaagtcactgcaaaaataggtgtttctgttccttaaaaaaatctacatggttaagatcctcccacttttgacctgtgagttgtgataaaaagcttccagaaaactcatctcagtgacttgattatgaaatgctaccagtttgaagcagtcactgaaaaacataaggtcataaatcaggaatccagaagaaacaatgaatagcaactttatcttcacttcacttctaacactggctctccaaggtaacagccctatcctgtacccagagtggcccttctggagaaggtggctggtttgacctatgactgttgagtgttttacattacagggtctgggagagcagactggatcaagccccaggagacagaagtatctggaacagaagggaagactgtgaacctactttgtaactatggtacatcatcggggagctatcttgatctctgctggttttgacagtatccgagccaggcatcagaatacattctctacagagggtggggatattctggaaaaggagatgccagttttgccataggaaagtttattcaaagagtacagcaaatgcaataaatgtgtacattagaaatctggttcctgcagacactgccttatattactgagatgcacaaaaagaacactttctaggggtgtcatacaaaaacaccagcgcacaggaggaaggagagcatttgttataaccacactgatttttttttttttttttgcaaaggcgtcattgtaagtggaagacactggatcaggagaattctgctttaataatagctatatatagtaatttgtaggcaaatagcttgagcttttagagtttccatttcctgaaattagatagcaattctaatttgtaagcttttatgagacatggttttaacacttggattaagtgcctagcatgtcctacatgctcagcaaatggcaaatatcttttcttgctctccctctctgtctaactactttgacctcaaaggacccttctttcactatctgagaatcttctatatactcctactggtaaaataacaacaacaataacaataataataataataaccctaaaaacatacatgcaagacctagatagagaaggcttctttgcccagggatcaatggtcattgtgccaggattttaaaagtgtatgctcagcaaatccaacaatcagaggacaaaaggaccccgagacactagctcctgagttcatagaccagggcagttgggcatttatcgtgatctgaacaagaacaggagagagttcctcacaagactaaagagaagagaaagacatttagcattaggtgggtggtgggagagaagagagaaattcttgggaagactacagccatgttctggtgtcagatctgacctccctagatggagaagagaggccaagtgaggcagtgggtcctcagcccacctggtagaggaagagggcacctgccacttcctgcactggttcaaactacactcctaacagaatcctatcatttaatctggatgtgagcaaagcctagcatctttgtttggactggtgatagatgaaaggtaaaagaggaaggaagatttaatttagagccttattcaatagtctgcagcagcactagcaccttactgcttgcaggccggaaacctcaaggtctagcagttcacagtgaagcctgcaccacactggctgctgagtaactgccccagtcactaggagggcttggaaatcagacagcaaatgacaccttaaaaaatatgtataaggccattcttgcactgttataaagaaatacctgagactgtgtaatttataaagaaaagaggtttaattggctcatggttctgcaggttttacaggaagcatggtgctggcatctggttggcttctcagaaggccccaggaagcttataatcatggtggaaggcaaagggggagcaggcatgtcacatggccagagcaggagcaaatgagagagagtgagggggaagatgcaacacactttatttaaaccagatcttgtgagaactcactcactaaagcaaagacagcaccaagccataagggatcccacctccatgatacaaacacctccccccaggccccacctctagcactgaggaatacaattcaacatgatttggatggggacaaatatccaaactatatcattccactcttgatccctcctaagtctcatctccttctcacattgcaaaacacaatcataccttcccaatagtcctccaaagttttaacaaattccagaattaactcaaaagtcccaagtctcatctgagacaagtcaagcttttccaccaatgagtctgtaaagtcaaaaacaagttatttactcccaagatataatgtgagtatacacattgggtgaacattcccatttcgaaagggagaaattggccaaaagaaggggccacaggtctcatacaagttcaaaacccagcaaggcagccattaaatcttaaagctccaagataatctccttagactccatgtctcacatccaggacacactggttcaagaggtgggctcccaaggcgttgggcaactccacctctgtggctttgcagggtgccacccccacagcttctctcataggttgttgagtgtctggcttttccagacacagggtgcaagctgccagtggatgtactattctgggatctggaagatggtgacccctttcccacagctctactaggcagtgcttcagtgaggattctgtgtggggcctccaactcctatttcccctccacactgccctagtagaggttatttgtgggggctctccccatgcagcagtcttctgccttggcacccaggctttctcatacatcctttgaatctaggtggaggctgccaagcctctttcactcttacattgtgtgtgcctgcaggcttaacaccacatggaagctgcccagagttatggcttgcaccctccaaagtggcagcctgagatgtacctcggcccctttgggtcatagccagagtggccaggatgtggggagcagtgtcttgaggctgtgcagggcagcagagtcctggacctggcccctgaaaccattctctcctcctaggcctcaaggcctgtgatgggaggggctgctgcaaacatctctgaaatgcctttgaagccttttccccattgtcttggctatctggctgtcttttagttatgcaaatatctctggcaagcagttgctttgaggcttgcttgaattcctttcctgaaaaatctttttctttctctcccacatggctaggctacaaattttccaaacttttacactctgctttttaaaatacaagttctagctttaagccatttctttgctactgcatctgagcataggttattagaagcagccaggtcacctcttgaatgcttcactgcttagaaattgcttccaccagatatactaaattatcactctgaagttcaaacttccacaaatccctagggcaggggcacaatgcagccaagtttgttgctaaggaatagcatgggtgacattcactccaattgccaataagttcctcatttccatctgaaatttcatcagcctggccttcattgcccatatcactatcagcattttggtcacaatcatttaaccagtctctaagaggttccaaattttcgctcatcttcctgtcttctgagccctccaaatttctcagacctctgcctgttacctggttccaaagctgcttccacattttcaggtatctttatagtaatgccccacttctcagtaccaatttgctttattaggcctttcatgcaccactataaagaaatacctgaaacttggtaatttattaaaaaaaaaggtttaattggcttatggctcttcaggctttacaggaagcatggtgctggcatctggggaggcctaaggaagctttcaatcatgacagaaggcaaaaggggagcaggcatgtcacatggccagaacagacacaagacagagagagtgagggggaggagccacacacttttaaatgactagatcttgtgagaactcactcactattgcaaagacagcaccaagtcatgagggatctgccctcatgatccacatatttccccccaggccccacctccaccattggggattataattcaacataagatgtgggttgggacaaatatgcaaataatatcacaataatttcttttataaaaaagtgaaaaatacttttattagagaataattttcaaagatctgtttaaaactaacttttaaaaacaatgaactatgggaaacattcactaatgcataaaataaaatatgtaatctttttcattttcagtttgtgcaaagttattttcacaccctgctggtagcaacacaatatattggtacaatcttttacacagtgaattacttggaaagggattttgagattcattaaacagttcatgcctttgaactgtttgaaactgaatgaacacctttgatccatttctcagaatttatattaaagattgattttaagtagaaaaaaccctctaggcaagaaaatagtaaaaatttctcaaccagttagaggaatttggatggcaacttgactgaatactttacaactatttaatgagttaataatactaaaaacatagtaatgctcttgacatacagttagagaaaacatagagttcctataataaccatatgctcacactaatatcgaatgaatgaagcacatagataaaaactggaagttttgatgcaaaactgaaagtatgaaattatttagtgtatgtacttgcaatattttaatttttattttttcatggaataactgtgaacttgtgcctacaataaataacattttaaaaattctcttgactccaaatgttgtagctagtggaaaaacaaacaaacaaggatctcaaccccagctctgtgcctcagctgtttctcctttcttcaactctggggcatcaattttctggttcccttcccttaactaagtcctcttcttcattattccccaagacctgctgacagaaactctgctgaaatattatttgtgtctcaaacctatctttgatatgggcaaataaggaaaaaactattttcagttcttttctattttctctgcagtagactcagtagctagaagattgagctgattgtaccaaaaattaagaattcttcattgacatcacatgggaaaaccatctccggttttccaagaaggaagattaggtaaggctatataccttgtcattttttttaagttggaacattaaagataaagcttaagtcctctctgctcatgttttcatctgttctcttttcccagagctaaatgttgctctgggtttgtgaaaggaaattaaatcttgggaccccaaactcattgagccaaagggaaaagttaagctgcgaactgggccatgcaaacctgccttgccctttcagttcctacataagatggctacaagatgaaaagctacatgactccaccatattttgcccacaaggaaattcctagtgagctgcaagatctttaccctatagtgtctctgttaaaatttcaccttggaaggccgggtgcggtggctcatgcctgtaatcccagcactttgggaggccgaggtgggtggatcacgaggtcaggagactgagaccatcctggctaatgtggtgaaaccccatctctactggaaatacaaaaaattagccaggcatgtggtgggcgcctgtagtcccagctactcgggggctgaggcaggagaatggtgtgaacctgggaggcggagcttgcagtgagccaagatcgtgccactgcactccagcctgggcaacagagtgagactctatctcaaaaaaaacaaaaaacaaaaaaaaatttcgccttggcaatgtaaactgatagcttattatctttacaggtgcagtcaacccctgtccaccagacataaatacacatctgattgttcccctgccccattttgcctatgttatcttgtgtaaaaatgcaaattccctgcattttttctctgccccatttatctatgtcatcttatacaaaaaaaaaaaagcagattcactaagccagacaaaggcatgaataactatttttccctacccttctcttacctaaaaattgtatacttctcaatatcccaccctttcccctttaaatctggagccctcaaaatcatcttcggagaaagtcatagacctgtctcctgggcacacatccttaactttggcaaacaaacctaaaatgattgagacttgtctcaccatttttctcaattgacacgtttataatttacattttaaattctttatctttattaatatgcacatataaatgtacatactcatgggaaatataaactatgattttatggcatttttaactaaatgttacatatgatatgtttttctccacaatttcctttcattttactcaacaaaatagacttgaagactagccaggttgatagagatcatctcatttccttttaattcatgtaaagtaaatcattctatcaatatgctatatttaataatactgatagtaataatattatttctccacaaagtagacaactaaggttcagaaagattaatttgccaaggtcacataattagtaagtggcagaatgaaagacaaatcaaatcttctgactttagaaagttcttctgtctttctcatttccaacatgtttagtggcaagagaaaggttttcttcacagaaacctaatatcccaagcaaatttgtatgtaggatttctcttgaaaattacctctcacttggctctgttcttatggctattaggcaataaatactaataataaaaataaaaataacaaaaacccctctctcccatattttggaaatttttcaatgcaacacaatggtcaatgttgttcattttttccctcatttctttgtctccaaccaaagaagcatatctctattttaattactcaacagtggggaatcaaactgattgggatataaacctaggcatttgagctggcaatggctaccctctttgggtcccctccctttgtatgggtgctctgttttcactctatttcactctattaaatcttgcaactgcactcttctggtccatgcttgttatggctcgagctgagctttcgctcaccatccaccactgctgtttgccaccatcgcagacctgctgctgacttccatccctccagatctggcagggtgtctgctgtgctcctgatccagcaaggcgcccattgccactcccaattgggctaaaggcttgccattgttcctgcacagctaagtgtctggcttcatcctaatcgagctgaagagtagtcactgggttccacagttctcttccatgacccatggcttctaatagagctataacactcaccgcatggcccaagattccattccttggaatctgtgagaccaagaaccccaggtcagagaacacgaggcttgccaccatcttggaagtggcctgccgccactttggaagtggcccaccaccatcttgggagctctagaagcaaggacccccggtaacattttggtgaccatgaagggacctccaaagtagtggtaatattggaccactttcactcactattctgtcctatccttccttagaattggaggaaaatactgggcacctgtctgccagttaaaaatggttagcgtggccaccggacttaagattcaggtgtgaggctatctggggaagagctttctaacaacccccaacccttctgggttggggacgttggtctgcctggagccagctcccactttcaactttcttggggaagtggagggctgactagaggcagaaagctctcatccagaactcccagcagtagccggttgagaccatggcgcagccagaagtctctagtcaacagtcgcccatacctcctgggtcccgaccacaactttcttgaaagtgtagccccaaaattctccttacctctgaatctacttcctctgatccctgcctcctaggtactaatggttcagactttcatttcctctagcaagttgtatctccaaagggatctaaggaagctctacactgtgtccttaggcacttaggctataacccagggagtcttatccctggtgtccctcccaatttaggtatacggctctcaacatgggctgttatgtgggacacattccccaccacccttgtcagggccccaagtttgtaatggctaagagagagagacagagagaagacagagagagagagagatggagagagagagagacaaagatggagagagagacaaagagggagtcaaagagaaaaagatagaaatagaaaaagaaaagtgtgccctgttcctttaaaagccagggtaaatttaaaacctgtaattgataattgaaggtcttgtccatgaccctataacactccaatacttttttatttacactttgttgtcagtgtaaataagggcttagcccgaaagcactgaggccactgacaacctgtagctttcctatcaaaaatccttaacccagtaacccacggatgggccaaatgcattcagtcagtaccggcaactgctttgctaaaagcagaaaagtaacttttagaggaaacctcattgtgagcacacctcaccagttcagaattattctaagtcaaaaaagcaaaaaggtagcttactaactcaaaaatcttaaagtatggggctattctgttagaaaagggtaatgtaactccaacctctgataattcccttaacctagcagatttcctaacaggggatttaaatcttaattaccatacaaaggtccgaccagacctaggaagaactcccttcaggacaggatgatagatggttcctcccaagtgactgaggaaaaaaccacaatgggtattcagtaattgataaggagactcttgcggaagcagagttagaaaaattgcccaatagttggtctcctcaaatgtgcgagctgtttgcactcagccaagccttaaagtaattacagaatcaaaagactatctcaatcctgactcaaaaggttacctacaccctctctgaaatgaatttgcataagaactgttgtttatgggaatgcatcttgatggggcagctgggttgttatgaaatactcaggaaactagcccagatctaggactcacccctgagagcaaaggcaatgttgggcatgctggtaaaggaccgctagaatccagcagccaggaccactttctttgtggtcaagaaaggtgggaaaacaggtgcaggactgctacactggtaagcataactaatccgataagcagaggtccatgggtggttacgcaccctggaaaggaataagcattaggactatagaggacactctaggactaatgctcatcggaaaatgactaggggtactggcatccctatgttcttttttcagatgggaaatgttccccccaaggcagaaatgcccctaagatgtattctggagaaatgggaccaatctgaccatcagacactaagaaagaaatgacttatattcttctgcagtaccacctggccacaatatcttcttcaaggggcagaaacctggcctcctgagggaagtataaattataacaccatcttacagctagacctcttttgtagaaaagaaggcaaatggagtgaagtgccatatgtacaaactttcttttcattaagagataactcccaattatgtaaaaagtgtgatttatgccctacaggaagccctcagagtctacctcccgaccccagcaagaccccaactccttctccaactaataaggaccccccttcaacccaaatggtccaaaaggagatagacaaaggggtaaacaatgaaccaaagagtgccaatattacacgattatactcgctccaagcagtgggaggagaatttggcccagccagcgtgcatgtacctttttctctctcagatttaaagcaaattaaaatagacctaggtaaattctcagataaccctgatggctatattgatgttttacaagggttaggacaatcctttgatctgacatggagagatataatgttactgctaaatcagacactaaccccaaatgaaaaaagtgctgccataacagcagcctgagagtttggcgaactctggtatctcagtcaggtcaatgataggatgacaacagatgaaagagaatgattccccacaggccagcaggcagttcccagtgtagaccctcattaggacacagaatcagaacttggagattggtgccacagacatttgctaacttgcgtgctagaaggactaaggaaaactaggaagaagcccatgaattattcaatgatgtcccctataacacagggaaaggaagaaaatcctactgcctttctggagagactaagggaaggattgaggaagcatacctccctgtcacctgactctattaaaggccaactaatcttaaaggataagtttatcactcagtcagctgcagagattaagaaaaaacttcaaaagtatgccttaggcccagagcaaaacttagaaaccctactgaacttggcaacctcagttttttataatagagatcaggaagagcaggggaatgggacaaatgggataaaaaaaaaaaaaaaaggtgactgctttagtcgtggccctcaggcaaatggactttggaggctccagaaaagggaaaagctgagcaaattgaatgcctaacagggcttgcttctagtgtggtctacaaggacactttaaaaaagattgtccaagtagaaacaagctgcccccttgtccatgccccttatgtcaagggaatcactggaaggcccactgccccaggagatgaaggtcctctgagtcagaagccactaaccagataatccagcagcaggactgaggatgcccagggcaagcgccagcccatgccatcaccctcacagagccttgggtatgcttgaccattgagggccaggaggttcactgtctcttggacactggtatggccttctcagtcttactctcctgtcctggacaactgtccttcagatctgtcactatccgaggggtcctaggacagccagtcactagatacttctcccagccactgagttgtgactggggaactttactcttttcacatgcttttctaattatgcgtgaaagccccactcccttgttagggagagacattctagcaaaagcatgggccattatacacctgaacatagcagaaggaacacccatttgttgtcccctgcttgagaaaggaattaatcctgaagtctaagcaacagaaggacaatatagacgagcaaagaatgcccatcctgttcaagttaaactaaaggattccgcctcctttccctaccaaaggcagtacccccttagacccaaggcccaacaaggactccaaaaaactgttaaggacctaaaagcccaaggcctagtaaaaccatgcagtagcccctgcaatactccaactgtaggagtacagaaacccaacggacagtggaggttagtgcaaaatctcaggattatcaatgagactgttgttcctctatacccagctgaacctaacccttatactctgctttcccaaataccagaggaagcagagtggtatatagtcctggaccttaaggatgccttcttctgcatccctgtacatcctgattcccaattcctgtttgcctttgaagatccttcaaactcaacgtctcaactcacctggactgttttacgccaagggttcagggatagcccccatctatttggccaggcattagcccaagatttgagccaattctcatacctggacactcttgtcctttggtatgtggatgatttacttttagccacctgttcagaaaccttgtgccatcaagccacccaagtgctcttaaatttcctcaccacctgtggctacaaggtttccaaaccaaaggctcagctctgctcacagcaggttaaatacttagggctaaaattatccaaaggcttgagggccctcagtgaggaacacatccagcctatactggcttatcctcttcccaaaaccctaaagcaactaagagggttccttggcataacaggtttctaccgaatgtggattcccaggtacagcaaaataggcagatcattatatacactaattaaagaaactcagaaagccaatacccatttagtaagatggacacctgaagcagaagcagctttccaggccctaaagagggccctaacccaagccccagtgttaagcttgccaaggggcaagacttttctttatatgtcacagaaaaaacaggaatagctctaggagccatcacacaagtctgagggactagcttgcaacccgtggcatacctgagtaaagaaattgatgtagtagcaaaggattggcttcattgtttacaggtagtggtggcagtagcagtcttagtgtctgaagtggttaaaatgatacagggaagagatcttactgtgtggacatctcatgatgtgaatgccatactcactgctaaaggagacttgtggctgtcagacaaccgtttacttaaatatcaggctctattacttgaagggccagtgctgcaactgcgcacttgtgtaactcttaacccagtcacatttcttccagacaatgaagaaaagatagaacataactgccaacaagtaattgctcaaacctatgccgctcgaggggactttttagaggttcccttgactgatccccacctcaacttgtatactgatggaagttcctttgtagaaaaaggacttcaaaaagtggggtatgcagtggtcagtgataatggaatacttgaaagtaatcccctcactccaggaactagtgctcagctggcagaactaatagccctcactcgggtactagaatcaggagaaggaaaaagggtaaatatatatacagactctaagtgtgcttacctagtcctccatgcccatgcagcaatatggagagaaagggaattcctaacttccgagggaacacctatcaaacatcaggaagccattaggaaattattattggctgtacagaaacctaaagaggtggcagttttacactgccggggtcatcagaaaggaaaggaaagggaaatacaagggagccaccaagttgatattgaagtcaaaagagccacaaggctggaccctccattagaaatgcttataggaggacccctagtatggggtaatcccctccgggaagccaagccccagtactcagcaggagaaatagaatagggaacttcatgaggacatacttccctcccctccagatggctagccaccaataaaggaaaaatacttttgcctgcagctaaccaatagaaattacttaaaacccttcatcaaaccttccacttaggcattgatagcacccatgagatggccaaattattatttactggaccaggccttttcaaaactatcaagcagatagtcagggcctgtaaagtctgccaaagaaataatcccctgcactgcaggccatacatttcaatccctgtatctttaacctccttcttaaatttgtctcttccagaatcaaagctgtaaaattacaaatagttcttcaaatggagccacagatgcagtccatgactaagatccaccacagacccctggaccagcctgctagcccatgctccaatgttaatgacatcgaaggcaccccctcctgaggaaatctcaactgcacaacccctactacgccccaattcagcagaaagcagttagagtggtcatcagccaacctccccaacagcacttgggttttcctgttgagaggcgggactgagagacaggactagctggatttcctagactgactaacaatccctaagcctagctgggaaggtgaccgcttccacctttaaacacgggacttgcaacttagctcacacctgaccaatcaggtaggaaagagagctcactaaaatgctaattaggctaaaacaggaggtaaagaaacagccaatcatctatcacctgagaacacaatgggagggacaatgatcaggatataaacccaggtattcgagctggcaacggctaccctctttgggtcccctccctttgtatgggagctctgtttttactctatttcactctattaaatcttgcaactgcactcttctggtccatgtttgttacggctggagctgagctttcgctcaccatccaccactgctgtttgctgccgtcgcagacctgccgctgacttccatccctccagatccggcagggtgtctgctgtgctcctgatccagtgaggcacccgttgctactcccgatcgggctaaaggcttgccattgttcctgcatggctaagtgcctgggttcatcctaatcgagctgaacagtagtcactgggttccacagttctcttccatgacccatggcttctaatagagctataacactcaccacatggcccaagattccattccttggaatccgtgaggccaagaaccccaggtcagagaacacgaggcttaccaccatcttggaagtggcccaccgccattttggaagtggcttgccaccatcttaggagctctgggagcaaggaacccctggtaacaaaacctgatgtttgttctctactaaggaataaaacaggcatacatgtgagataactataaagagtcaggacatgatagaggtctgcacactatatcagaagccctgtttccagctctgtggctgcagcatcgcacaactccagtgctctgcctgaggctggctgtgcatgcagagctgagccctaggttttggcaggacaagacatgttttattcagggagatgagaaggcctgtcaacatgtactgccccacctgctgcggccaactgtggcctccatcttccccagtaggcagggatggactgagggaggaaagacacctgcggcacatctgaaagatgctttgggccggggacaaaaaagaagtgatagaaaccaggctgtgctttttattgctgtcaggacaattttcttaggacatgggggtttcttttttttttcttttttttttttttgagacggagtctcacactgtcgcccaggctgcagtgcagtggcgtgatctcagctaactgcaagctccacctcctgggttcacgccattctcctggcttagcctcccgagtagctgggactacaggcgcccaccaccatgcccggctaattttttgtattttttagtagagatggggtttcactgtgttagccaggatggtctcgatctcctgacctcatgatccgccaacctcggcctcccaaagtgctgggattacaggcatgagccaccgcgcccggacaggacatgggggtttctaaacaaggctcttcagtatcagctcattgtgagtcacagatcagatctgcccagttctcttttgctgttgacattgttgtttcctctgcaggattcagcagtactgaaagggttattcagtcccaacatgggatctttacacaagaaggggagcttgtgaaatgcaagtactttgcaaatagctcaacttattttctttcttgttttgggcagcattccagtgaggaaatatttcacctgatttctcagagtttaggagcatccaggaacgcaaggaataaaaaatgttctgtgaacctgcaaatagctgccaacactgtcattctcaccatttcagttatgagaccaaaagactcaggaaacagtttctgtgcactcaagacatctacagtaagaggaacaataaaagttgtagttaaaaaaaacaaaaaacaaaatactcagagcttgtaccccagactcatctgccacagggactgggagagatccacgggccctaaactgaaaaaatgtgagcctgtggacagcattcatgaagtatggacaggaaacaggtaactgttgcaagaaaaaccctctcaaactgcattcattgagcagtgctttcaatccacagtccttaaattgactttctccttcaaattttagcaggtaacaaaacagtactttattttaatctaattatttttcttttttctttaactttttatttgatatatttcaaaatataaaataatactgcttattgtaatagatgaagtaataaaaagttttataaagaaaaagttaattctcactcatctgctccctactgaagtaaataatattaataacctgataagtgtcctttcccactattctttctgcttatataaatataggcaaaaatccctcctagtggaacaaatctgtttggggttttttttgttttgttttggtttggttttctgagacggagtctcgctctgttgcccaggctggagcgcagtggcatgatcttggctcactgcaacctctgcctcctgggttcccaccattctcctgcctcagcctcccaagtagctgggactacaggtgcccgtcaccacgctcagctaattttttgtagttttagtagagacggggtttcaccgtgttagccaggatggtcttgatctcctgacctcgtgatccgcccgccttggcctcccaaagtgctgggattacaggcatgagccaccactcctggccacaaatctgttaataaatgtgtgaccaattggaatttttcctctgaatcgccttttacatctttgtccatttttcttttaggttatatatttctcacttaaaaatgcatgctagagatgtcaaaaattttttttatttctccagtctattgtttgtcttctgattttgtttatagcacgtagcatggtatcctttgcctctaaatatactctaaactgtatatagttaaatatgcctgtcttctttatatcttctgcatttctaccatacttaaaaatagtacaggtttatataaatattcccagattcttagacaacagttttatcattttgctttttacaataaaatctttcaaccatctggaaactgtttttatatatgaaatctattttccactattgaaatgtctttgtcatattttatgtttcttaaacataatcaaattatatacatccatattaagaactttaccagtatccaaacattacagaataatgtaagaatcacagtggaactgggtgctggtgaaaataatcactgaattctccagtgccagtttgaaaggagaaattattagccattccactggggtgagaaaggccaatgagtttgactgatgttaaccaaagagagattaaaggatggactaaaagtataaaggggtgacatcttggggaaatgcaagtcttgtgcagagagaggaagatgtttaacttatcctactcaactcctttcctatatgaccggaggtgcctagtccagcttccacccactccactaagttgaggaatagctatcatcacatgtctggaagataatcagcttctgaactggcagagcgtctctggttcttgtggcaaagacataaaatgtgggagaaagtagagaaaaagaaagtgtggtagcctgcattcccaccttttattgaggcaatttttcatgtactagtggttttaatgaatctgtataggtctgaaccaacttgaacctgaacctaccctgcctccaaacagctgtcacttaggggaaggctctagcacaggaggctgtggattgacccatgtgtgaactggaggaggaggaggaggttgagcttgagaacgatcaccactccaggaaatcacgcagatgaagggccctgtagccccctgaagaaaacactagcacaccgttgtgagaaagcacacatttggatttctgccaccaagagggaatccatggccaggaagagataagaaccaacaggaaggagaaggaacctctccatcagaaccctgagaaattcacataaggaaacagcatctgagcaaccaagaagacaaggcccctcagcccaggagaggctgaaaagagagtcctttatttctcccaccactctgcccaacagctgagggttgacatggggtgaagtctgaaagaatagcacatctacctgtcagtggagctcccagagtcttcctgctgggtgtgggtggagggtagagctttgactctaaaatactaattaagttcaaaatgaatacacacatagttggaacaaaactgctttagtaactaaaagagaaaggataacctgtttcccagtggaaaagagatgattgataagtgaaaaaaaaatgaaaacaatttcacactcacatttatctcatgacttgaaatgctctagtcagcacagtaatatctggatctctttgggtattttctattaaatgttccgcttattggcttaatccttcacttatatcatattgttttgtttagagtagtttagagtaagtttttatgtcataaaaaaactgatcttaatattccttttcaagaatgcagttgaaagttcctagatatttgttctctcttatgcatttcatcttgttcaaacaaatggcattctgactgtaactactttggaaagtttaacattttaggacattatatttttccacaaaagaaaaatccatctatttaggtcttattttaaaagtaaattttgcatgtttgtttgtttcttacataccttccactttctttttttttgagacaggatcttgctctgcagcctaggctggagtgcagtggtacaatcatggctcactgcagcacagacctcccaggctcaaatgatcctcccacttcagcctctaaagtagctgggattataggcatccaccatgcctgactaattttgttttttagagatggcgtctcactgtgttgcccaggctggtcttgaactcctggcctcaagcaattctcctgccttgaccttccaaagtgcagggattacaggtgtgagccactgcacctggccagatttctgcttttcttattaaatcaattgctaaatattgtatcatctgtgttgcattattactgaaatttttcttcatttagagaaatttattccatataaggaaaaattactaatttttaatatttgcttaatagccaacaatttttgttacttgttgatttttagcagtactatgaccaaagtggcacatgtacatgtttattttttaaattcctgaatagtacagaaaagtctgtattacaaatctggtttcttatttctctccaactttcaatccttgtccataaatatttacacttttaagtctggatcttctagcagtgagctccatatttctaaataatatgttttaactacttcttgcaacatacattttattcttttattttatttacttatttttttagatggagtctcacactgtcaccctggctggagtgcaatggcatgatctgggctcactgcaatctctgcctccggggttcaagcgattctcctgtctcagcctcccgagtagctgggattataggcatgtgccaccacatccagctaatttttgtacttttagtagagacggggtttctcctcgatggccaggtttgtctcgaactcctagccccaactgatccacccgccttggctgcccagagtgttgggattacaggcatgagccaacgtgcctggctgcaacatgaattataggtgttacctgttgactttcgttttgttttttaaatagacttaattttttaaagcaattttaggttcacggaaaaattaagcagaaagtagagagtttcccatatacttccaggcctcacatatccacaggctcccatgctatggacatcttccaccagagtgataacatttgttccactgatgaagctacattgacgtattattattacccacagtccatagattacattagggttctctagtggtgttgtacgttacatgggtctggacaaatatataatgacgtgtagccgccattacagtctcatacaggttgtttcactgccccaaaatcctctgtgctctgcccgttcactcctccctccccccagctcctgacaaccactgatcttgttactgtttccatggtgttgactattccaaaatgtcatatacttagagtcataacagtatatagcctttttagattggcgtctttcacttagcaataggcatttcagatttttccatgtgtttcatggcttgatacctcatgtcttttgagtgctaaataatattctgttgtctggatgtaccacagtttatttacctattgaaggacatcttggccacttccaagtttgggcaattatgaaggaagctgctataaattcatgcacattttgaactcatttgcttaaataagaaagagcataatttctggatcatatgcaaagaatatgtttagctttgtgagaaactgccagttttcttccaaaatggctgtaccattttgcattcccaccagcaaggaaggagaattcctgttgctccacaccctcactggcatttggtatcgtccgtgttttggatttttgccattctatctggtgtggagaggtcgctcattgttgtaatttgcaattccctagtgacatttgcatggagggtatcttttcatgtgcttatttgtcatttatgtacatttttaatacgtttcactttgggggtcatttagccttcacctggcaaaacaaacaaatgaaaatttacacataattctgtgaattaatttttaaaaacttcataaacctcacctttatccacttttattcttacttatatttacctagtcagacttttcagaactttttccaagttgtcagaacatatttaaaataataaaattaaaataggaggaatttttgcctgtcacctttgctcttctctcttttccctcatccactcccacaccttttcttctttagtttccttccccaaccattccaaacactcattatgcccaagcctctttggacacttcgatcaaaattttctcctctatatcatccggaggaaatgcaccgtttgctcagggacacttagctcacctgcttcccacgttttctctcggtctccacttgtgtctggactgagtgttgctgaccaccacagcatcaaagagcctgtgagaccactggatgcagtctgggggtcagtgacctcagaggaaataccttcagtgtcccacgggctctgcaggtcagtgcactcagagtgagcttcctcacactttgctggggaaagtgtccagtagcttcaataatctcatgaccaaaagactgaagagaggggagaagacatccgagttcacattttcaggcaatagtagctgacatttcctgaatgatccttgtgtgtcaggcaccttaggtccgttcatgacttaccacatgtttctgtatgacagcaccatggggaagcttctgtaattaattcctattggataggttgctgctgatggaagtggggtctccaaatcctctatcccagagtctgtgctgttctgcagactgaatatgctttctccccaccccttcctcaggctttggcaaaggagacctctgaaaaatggcacttagtatattattgacttttgttttttaattggcttttggactaatgaggtcagtataatgtgtgaaaccaaactagaaggcagtgctggtaagtttgttgagtctctgacaaatatttggattctgagcaattcaaacatccaggcaactttaaaaggtcttcttcctctgagactcatagtgacttatacaaataaaaataaaagattagtaataatagtagttcatcaaacactgcatttacttatattttctcaaatactattttcttttttttgaggcagagtcactctgttgcccaggctggattgcagtgatgcaatcttgactcactgcaacctctgcctcttgggttcaagcgattctcctgcctcaatctcctgagtagctgggattataggcatctgccaccaggcctggctaatttttgtatttttagtagagacagggtttcaccctgttgtccaggctggtcttgaactcctgtgatcacccacctcggcctcccaaagtgctcaagtgatcacccacctcggcctcccaaagtgctgggatttcaggtgtgagccaccatgcccagcttcgaatactattttctaccataccatttaaatgtcattcaaatttaatattttcaacaaattttgaaagaaggcaatcaggcaaatttcatctcagtcaaataatccctaaagttacacatgctgtggctgtacctttctcaactttgtttcccttcatccagttaagacttggttgtgcagagttaggggctccgcaggtgatgacatgatcaaaggccctgacccttgtcacaagagtactcactaagaataaaagtgtttgacatcctctcagcaactctgatgtgtaatcccaccagcaattagtgtttttctttctccgcgttgattacagatagtttgcttttccctgtatgactgcaaaggtgtgtatatttgaatgtatgtctgtatgttgtttgggttgcagggaaggaaggagtagaaaaaggaataagaggtggctgtgattggctggtcgctctgaatgcaaataactctatgcttttcacctttagtgaatatataaatgtctcaggataggagcgataataaataatgccaaagatcttccttagtggtcctgtggcttcattgaaggcatacattgaaatgtttctagccaggtgcagtggcttacacctgtaatcccagcactttgggaggccgaggcaggtggatcacaaggtcaggagttcaagaccagcctggccaagatggtgaaaccccaactctactaaaaatacaaaaaattagccgggcaaggtggcacgtgcctgtaattccagatactccagaggctgagacagagaattgcttaaacctggagaggcggaggttgcagtgagccgagatcgtgccactgcactccagcctgggtgacagagcgagactccgtctcaaaaaaaaaaaaagaaagaaagaaagaaagaaatgtttctgaacaggggaaaagccaaatgcaatgggcattcccgaaagactgaagaaagaatacgtgcaagttgattcttctggggtttccaggaaagttgggaaaagaaaatgaatcatttaaaaagtggagagctgatgcctggccctctgtacttgtttctctcagggaagaaaggcagcagaaagtagagcagtgtcccagtccacacgtgtccagggaagagaggcttctatttttaactgcagttacacaagactgttggcttttatgtttcagacgcagtgctgtgaaagaccatgtccttgtagttttcattatttcagaggtaaaatggaaagcaggagtaagagccccaatcattaagaacacggcttagctctctgcagatcacagactcagccaccaactcctgccctgtaaccatggagatgcccccacttcagtctgtacacaaccccacaagaggaaccacttactcgcttccttttctaatcagcatgaaataatatttttcataattattatctgaggcttttctatttcctcctctctatctactttgacaacataaaaatatattagggcctggtcgtggtggctcacacctgcaatcccatcactttaggaggctgaggtgggaggatcacttgagcccaggaggtcgaggctgcagtgagtcatgatcatgccaatgcactcagcctgggcaacagagtgagaccctgtctcaaaaatatatatatatacacatatgtattaggcattatgctgtacacaaagagcttattatctaatacacatgataatatctgtcactagatgtaagctttatagagataccaatttttttatccaataaccactaaccaaacaatgatcaaataaataaatggcaggttatatgtataccgatgtgtaaaggcaaatttatggccaatggttaaaatttactgaaaacaaatttcagctcgctataaaaaagaactagcaatcagagttttcccaaaaagaaacagacagctttaaggcataaaatattcctttctacaggaaatattcaaagaaaagtagaatgcccatttccagtgatgttgcagaattacaaaatgatatgattttgtgcaaaactaaaacatgtaagttttgtatgggggaaaatagcatcgaagaacagaacaaccaaacagcttgtaaaatgcatcgtgaataaaaaaagctacttccagcttaatggaaattggattttggatttgtatttgaagcatgtgtaggatttaaaatgagagagatggtaagagaatacatgccaggcaggataatcttatcaagggcaatgatcaagaaataacagagagaaaggtttaggaaattagaagtttccaaatatgactgaaagaaccaatttttattggaaaatgctgtgagataagagggaatcttggcttgagacaattgttagtgtaagaggactgcacacagcccagaactgggtttctttccagacaaagagaaaatggtatgagattatccatccttaccataaacaacattaaggaatatcttgaaattgtttttcagaaagagctaatattaacctaaatttaaactgttaaataacatcaaagatttactttacaagcacatttctaaatgtactgaaaaactatatttccataataattgattcaatggacagataaatttccttttccctgagtagttctatcatcaactaatagcccttattgcaggaaacgaaaaatctaaacacttttccgaaagtgtcgcgattccccgatcactttccagcgtgaattttcttaggggtgaggatgggaacactaatagtttctctgcactcaggaacctcataaaggacaaactttcaaatcaaataatacagaccaaataaataaaacagagctacatcttgctttgctttacacttcgttctcttccttgtctgtctgcaaaaacctttgcatgattttcattgaaaataactcctgaattgatgcgagattttacttaccctgggacctacccaggcctggtttagatatgttcccatagtcttccctgctcttccgggtactgagttaccataaggataaaccaggcagacagttcttagacattagggctaatttctaatttacccccctgtgtctttcttttatcatcacaaacatgtttggtgtctaatttggtttactcttaggaaaggatggtttggagtacataaaacagaatggttcctcaggcagcaatatgctacagttttagagatcttgtagctctatttttctattaattgatgcaggttttgagaatcaacaagcacattaaaaatagacatcaacactatagtaaaattaaaacagttattctgtcttttgttgttgtttccacattattcagaaagagaaaagtactctttaaaattagaaatggagaacaacaaggaagagaaatctattttgttgaaaaacagcttttggtaatattattcagtgaaagatgaagtgacagacgtggaaacttctagtcaaagtttgcagcttttatttgcattgaatatctatccaagatgaatcatcctagaaaagcagccagtggacttggaataatctcgctcaccatggtttctgccaaggaaggatttctttggcgcagaatgttgggtatttatttggggtcttgaatgggtgaaagagacaaagaacaatttacgagaaagaaaggagaagaaggaatggatccatggacagaaaagatttgtcctcaagggtacatccaagatttgctttaatctgtcatataatggaaatttgaaacagttattagcacaggttcacagcttctcaaaactaaaaaccattgtggaaaagaggctaagcacaaagatgtaagcactaaatgagtataactgctttgcagacagtttcatgtcagtggacatgtgccatttttcttctttttttttttttttctgcccagtgcagctgccacatattattcaatgcacaactttacagggcatcattcacatcttagtaagacatggagaaagacaatgctgagataaagaaaagcagatttccgagagcatcatcagagcctacaaattcagctctgcctggagctgcaaaagtcaaaatattctttttggggatcaagccagcatgaattgagattctgtcatttacagccaatggattcataattctcatagccaaaagggagagggatacttttggttctctgctattttatgagctgaatttatggtccacagaagcattttctactcaaaataactagagttatgtaaagacaaataatcattggtctactctcattatgggaaataagagccataataaccctatgtgtgttttatgaatttcaaatgggaaaaattttgaaaactactaaaaattcataactctacattataaacataagaactcttactttttctatttttactttttaatttccacttttgttactatttttacttattttccttgtttacatttttgcacatgaggaaatcatattgtaagaataattttatgaaattttattctcatttttagaattaaaaatgccttggatttatagtttgaattggctactatttcacaccgtagatatacaatactttataattttcctgattggggatatttttattatttatttccaatttttattattttaaatagcattgtggtaaacatctttaaatatacattttattttatttatatatatatttttattatactttaagttctagggtacatgtgcacacgtgcaggtttgttacatatgtgtacatgtgccatgttgttgtgatgcacccattaactcatcatttacattaggtatatctcctaatgctatccctcccccctccccccaccccacaacaggccgtggtgtgtgaacttccccttcctgtgtccaagtgttctcattgttcaattcccacctatgagtgagaacatgcggtctttgggttttttgtccttgtgatagtttgctgagaatgatggtttccagcttcatccatgctacaaaggacatgaactcatcattttttatggctgcatagtattccatggtgtatatgtgccacattttcttaatccagtctatcattgacggacatttgggttggttccaagtctttgctattgtgaatagtgccacaataaacatacgtgtgcatgtgtctttatagcagcatgatttataatcctttgggtacctacccagtaataggatggctgggtcaaatggtgttgctagttctagatccctgaggagttgccacactgtcttccacaatggttgaactagtttacagtcccaccaacagtgtaaaagtgttcctatttctccacatcctctccagcatctattgtttcctgactttttaatgatcgccattctaactggtgtgagatggcatctcattgtggttttcatttgcatttctctgatggccagtgatgattagcatttaattttcatgtgtctgttggctgcatgaatgtcttcttttgagaagtgtctgttcatatccttcgcccactttttgatggggttctttgtttttttcttgtaaatttgtttgagttctttgtagattctggatattagccctttgtcagatgagtagattgcaaaaattttctccaattctgtaggttgcctgttcactctgatggtagtttcttttgctgtgcagaagctcttgagtttaattagatcccatttgtcaattttggcttttgttgtcattgcttttggtgttttagacatgaagtccttgctcatgcctatgtcctgaatagtattgcctaggttttcttctagggtttttatgattttaggtctaacatttaagtctttaatccatcttgaattaatttttgtataaggtgtaaggaagggatccagtttcagctttctacatatggctagccagttttcccagcaccatttattaaatagggaatcatttccccattgcttgtttttgtcaggtttgtcaaagatcagatggttgtagatgtgtggtattatttctgagggctctgttctgttcaattggtctatatctctgttttggtaccagtaccatgctgttttggttactgtagccttgtagtatagtttgaatacaggtagaatgatgcctccagctttgttcttttggtttaggattgacttggcaatgtgggctcttttttggttccatatgaactttaaagtagagttttccaattctgtgaagaaagtcattggtagcttgatggagatggcattaaatctataaattaccttgggcagtatggccattttcatgatattgattattcctatccatgagcatggaatgttcttccatttgtttgtatcctcttttatttccttgagcagtggtttgtagttctccttgcagaggtccttcacatcccttataagttggattcctaggtattttattctctttgaagcaattgtgaatgggagttcactcatgatttggttctctgtttgtctgttattggtgtataggaatgcttgtgatttttgcacattgattttgtatcctgagactttgctgaagttgcttatgagcttaaggagattttgggctgagacaatggggttttctagatatacaatcatgtcatctgcaaacagggacaatttgactttcccttttcctaattgaataccctttatttctttctcctgcctgattgtcctggccagaacttccaacactatgttgaataggaatggtgagagagggcatccctgtcttgtgccagttttcaaagggaatgcttccagtttttgcccattcagtatgatattggctgtgggtttgtcatagatagctcttattattttgagatatgtcccattgatacctaatttattgagagtttttagcatgaagggttgttgaattttgtcaaaggccttttcggcatctattgaggtagtcattggtttttgtctttggttctgtttatatgttggattatgtttaatgatttgcgtatattgaaccagccttgcatcccagggatgaagcccacttgatcatggtgcataagctttcggatgtgctgctggattcggtttgccagtattttattgaggatttttgcattgatgttcatcagggatattggactaagattctcttttttttgttgtgtctctgccaggctttggtatcaggatgatgctggcctcataaaatgagttagtgaggattccctctttttctatttattggaatagcttcagaaggaatggtacaagttcctccttgtacctctggtagaattcggctgtgaatcatctcgtcctggacttttttcggttggtaagctattaattattgcctcaatttcggagcctgttattggtctattcagggattcaacttcttcctggtttagtcttgggagggtgtatgtgtcgaggaatttaaccatttcttctagattttctagtttatttgcgtagaggtgtttataatattctctgatggtagtttgtatttctgtgggatcggtggtgagatcccctttatcattttttattgcgtctatttgattcttctctcttttcttctttattagtcttgctagtggtctatccattttgttgatcttttcaaaaaaccagctcctggattcgttcattttttgaagggttttttgtgtctctatctccttcagttctgctctgatcttagttacttcttgccttctgctagcttttgaatgtgttttcccttgcttctctagttcttttaattgtgatgtcagggtgtcaattttaaatctttcctgctttctcttgtgggcatttagtgctataaatttccctctacacactgctttaaatgtgtcccagagattctggtatgttgtgtctttgttctcgttggtttcaaagaacatctttatttctgccttcatttcattatgtacccagtagtcattcaggagcaggttgttcagtttccatgtagctgagcagtttggaatgagtttcttaatcctgagttctagtttgattgctctgtggcctaagagaaagtttgttataatttctgttcttttacatttgctgaggagtgctttacttccaactatgtggtcaattttggaataagtgcaatgtgttgctgagaagaatgtatattctgttgatttggggtggagagttctgtagatatcaattaggtctgcttggtgcagagctgaattcagttcctggatatcattgttaactttctgtctcattgatctgtctattgttgacagtggggtgttaaagtctcccattattattgtgtgggagtctaagtctctttgtaggtctctaaggacttgctttatgaatctgggtgctcctgtattgggtgcatatatatttaggataggagaattgatccctttaccattatgtaatggccatctttgtctcttttgatctttgttggtttaaagtctgttttatcggagactaggattgcaacccctgcctttttttgttttccatttacttggtagatcttcctccatccctttattttgagcctatgtgtgtctctgcacgtgacatgggtttcctgaatacagcatactgatgggtcttgtctctttgtccaatttggcagtctatgtcttttaattggagcatttagcccatttacatttaaggttaatattgttatgtgtgaatttgatcctgtcattatgatgttagctggttattttgctcgttagttgatgcagtttcttcctagcatcaatggtctttacaatttggcatgtttttgccacggctggtgctggttgttcctttccctgtttagtgcttccttcaggagctcttttagggcaggcctggtggtgacaaaatctttcagcatttgcttgtctgtaaaggattttatttctccttcacttatgaagcttagtttggctgaatatgaaattctgggttgaaaattcttttctttaagaatgttgaatattggcccctactctcttctggcttgtagagtttctgccgagagatccactgttagtctgatgggcttccctctgtgggtaacccgacctttttctctggctgcccttaacattttttccttcatttcaactttggtgaatctgacagttatgtgtcttgtccactccagaccctgtttgcctgggtatcagcagcagaggctgcagaacagtgaatattgctgaacagcaaatgttgctgcctgatcattcctctggaagtttcatctcagagggatacctggccgtgtgaggtgtcagtctgcccctactggggtttgcctcccagttaggctacttggggtcagggacccacttgaggaggcagtctgtccattctcagatctcaaactctgtgctgggagaaccactattctcttcaaagctgtcagacagggacatttaagtctgcagaggtttctgctgccttttgttcagctaggccctgcctcccaaggtggagtctacagaggcaggcaggcctccttgaccttcggtgggctccacccagttcgagcttcccggctactttgtttacctactcaagcctcagcaatggtgggtgcccttcccccagcctcgctgccgccttgcagttccatctcagactgctgtgctggcaatgagcgaggctccgtgggtgtgggtccctccaagccaggcacaggatataacctcctggtatgccctttgctaagaccattggaaaagtgcagtattagggtggaagtgtcccgattttccaggtgccatctgacacagctttgcttggctaggaaagggaatttgctgacctcttgcacttcccggatgaggcgatgcctcgccctgcttcacctcatgctcagtgcgctgcacctactgtcctgcacccactgtccaacaagccccagtgagatgaacccagtacctcagctggaaatgcagaaatcacccatcttccgcgtcgctcatgctgggatctgtagactggagctgttcctatttggccatcttggatccacccctaaatatacattttaatttaactttttatcgtttcattaagacagcatcctcgaactggaattagtggttcaatgggcaaaacagctttatagcctgttggttccttgtctgtcttaatagcataacaccttttaaaagctttctaaattccttatctctactccctaacccctttcttactcaaaacccagtccaggcagatttttatccctatccttgtatcagaatcactttgttaaggtcacaatgggtttcatagcctcaaatccaatgatccattaccatgttttatcttactgaatttctcagaataatttgacaatttggttattctctccttgaaacattatctttgcttgagtttggggattccacactttcctggtttgctttcaacctcacaagccactccttttctagctcaccttcctcttgctgacctctagatactgtgttgtctcaggactcagtcctcaaacatatatgccgtctacatgcactctctaagtgatttcatccaggaatatggctttaattaccatccatacattgatgactcccaggtttatacctccatccaacccctctctgttgaaagccaggctcatatatactataatctatataacatctttgccagatgtctgtctggcatctaaaatctaagatatccacaacataccttattccctcccttacgctcatccctcactcttccccatctcaagaaaacagtgatataattcacccactcgctatagccaaaaatactggaatcttctttaattcttctctttcccccataccccacattgtcaacaaactggccacataagatgtgttttctgtcagaaaaaaaagcctgacttcattttttaattcaaataagaatgttacatgatgggttccaatgacaacccagtcatttcataattctaattctaaagtaggtagatgaatatggtaaggaaccttgcattgtggctgtcgccagttgaaatatattcctgttttgcaatatttcttgcttagcttttaagggctctcccgcagattccagaagctaataaattgtctctttatttggcagcttgggaattttttttttagcaccctggaccaatgcaccattccggatggttgagatatatactttttctttaaggggtaggaggtaagggtgatgttggaaagagaaatgggaaagaagcagcagcttaacatttggaccctgaagcatgttctagagcaggctggttttaagaaagtcctcatttgcctcaaggtacgtgaccccagtttaatgactataggcctaaatgggacaggatcacaatcacatttgtcaccagcagactcatatctaggaggcatacaagttattcctgttagaacagtgacttactggaaagtcatttcccaccactgatttgagtcgctgttattatcgtacatgaatttccatatacaattaggccatattacagatttgctattccatttaactaacctgtctgcctacccttaattttcacttaagaattttctttctctttcttttcacttctgtgcaatagaaaatatactcttttcttctacattttcttctgttttttttgttttggcataagaatgacaggaattttttaaatgtttaattgtagccaatcctttgctagtggtctttgtcctcttttaggttttctgatgtacagtcattttatctacttacatgcagatgatgttttatctcttcctttccaattcttatgcttcttattgtttctctgggctgactgcattagcaagtagcttcaacacaatcttagatagcagtagtggtaatgaacatctttttccttcacctactttaataggaaagcctctagcactttcccataagttggtgctggtttgggattacggtgtatgcaagttttatgtgatatgttaaagaattagttattagtttttatttttcaatgttttaacatgaatctgtgttgtattttgtcaaattccttttctgcatcaataaagataatcatatgattttttttcttggctcttgtatcagttattaagctactaactcttacctacaattgcttagctcctatacctcgcttctagagtagtaactgctgatgtcaatcatacactggcccctagagctagttgactttttaggtgtgtttttcttctctctccaactggataattagcatattctattttgtacattttattaaatgtctccacagggttaagtgaatttgttgaggtagtgacactcaacatttattgtttacctgccacaacccctgtccatcattgctcagtaaaatcgttaatcatctatagctagacatatacctgctagtacctacctagaatgttgaaatcacatacctgagataagagagaagaaaaattccaaggagaactctcatgtaaatgctacttcctccaagcatctaaaacagctcctctattctttctaggaaaaaaaatcccttctttgaggacattcctggtaagtatcctcataaatagaaaaaaaattttacaaagagaactaaagttttgctagcatttctgtggtttcagacttaatgtgatgtggggatgctctgattgggaaaaagaaagatcataaggtttctagggaagtgtaccagtttacaaatagccagattctccagtgaccacctcatgtgtctattgtttttttctcaagcagaaatgtgaaaacaggagaaggtagagtccagtcttacccaaaccctgcatgtccaggagaaagctaactctagtctaagctacaaaaaacgaaaaaaaaaaaaattctccttgttttacataatttcatacacaaaaaagaatggaagagtaatatccacaattaacatcaaagatcctcttattcttcatagactcagtgtagaggctcagacacttatgtcatgaccacagaaagaaatgaaggaagaaaagaatgaggatagatttgctagggccagggctttacccaagaaatatagctgagaaaatgtgggagggtaataggtaggcacctatgctccacaggatgagacctggatgcaaagaacagatgagagctttcttccctatcctctcctcatcttgagtccctagtcattgctgcaagtacaggaaaccataaaacagagtttcagaaaactaatatgtaaaacatgagaaattaccagtgtgcacaggtgcccagagctaaatataaagcacttggatatttgcaaaagcactagcatgctcagagttagccagttactagactgctttctcacacctgaaaacatcctaaaagaaaggatactacattttcctcctttgtctttttaacgagaatttggaaaaggtctaactcttttaacttatttaaagctgctgagattgagacatataatacagctctggtagaaaaataatcaattaagggaaataatcagatcttctctcaacctattcctacccccctcagaatgtactacagtgccatagaggcaaaaagcctgcataattctttaaaggtgaggggagtgagggagtttcaggtgtaaaggattttcagacagtcataactggagaaactttccttttaacactgtttgctttctttcttttttgtttgctcctcacctctctgtatgttccgtctacctttcatttcaacataacgagttactttatattaagggggaaatgaaaaaacaatttttttgagttcagaccacctgggggcagtgcttcctttgacagaggcactgccagaaactagaacaaggggaagggaacagcaggaggagggcattcaatgatgtgtgtgatgtaacagtgaggttttgattatccgtaaaaacaatgaagattccccaaaggctacccaaccaacagaaccagaagactctagaacagtgaactaggcccagtgaacacggccaaatctaggtctccaaactgaatccacagaggctccaggaaaaggaaagaatggaaactccactgagcactctgctgctgctcctctgtgtgcagctgacctgtgagtcaggcgagtcatgaggaggggaggaatcaagtaggggcggccagggcattgaaatttagaaagatcccggggacaatcttgggtctagtctcaggaatgtaaaacaaataatgaaactgatgaacaaacacactatatatatgaaaatgtttcattcctcctaagcagggtcaaatggacaactgccagtggaacagaatgctccttccctgaaagtcaaggaaggtgacagcgtcacactgaactgcagttacagagacagcccttcagatttcttcagtggttcaggcaggatcctgaggaaggcctcatttccctgatacaaatgctatcaactgtgagagagaagatcagtggaagattcacagccaggcttaaaaaaggagaccagcacatttccctgcacatacaggattcccagctccatgactcaaccacattcttctgcgcagcaagcacacagtgcccacagtcacctgcacccggtacctaaagcttgctgaggggcctgggcacacctccttttataagggccctggggcactgactataactctgctgcatacaaagggaaatatgagggactgttttataacataatatcaaacatttcatttgaagaccatgtgaggaaggatagtgttttcaaataccatctaaagtactttgtttctcagtgtgaggcccttcctttgtgaaaactagcccaaaaactagaggctaaatatcaaaaaggagagagcactaaagaacaaagaaagaacagggtaaaattcttgtctttgagcttctttgtagacttttacaaagatatagaaaatacaaaatcttgaaagccatgaccatcaaattcagtagtgaaaggaaaaatattttgacatgccaaaaagattggcttagaagatcaagtaccaaaatctgagggaaaattgtacaaagcatttaaaggaaaagagaacacaacatggtagaaaagctgtcttctccttaaaagggataaaatgccaaccagctagctagaaaggaagtcaatgatgtgaggagaggtcataaacagtgagtccagcatcctgctcttttctagggtcagagctctgagcaggtagggtgggaggagggtgagtcacatttagcaatgactctgaactgaaggaacagtgaattttggaaaaaactgttttgatcattgtgtcttatatcaatactcacaagaaaacgcccattacagaggaagcattcaacaaccatgtggacaagacggtcggtccaaagcatgtcagccagccagagaatgtctgtgcttgtcaatttcttgaacaatagacccatgaatagattagctgaggtgacagattgagtttctttataagcccagaagcatgggttttctcccaccaagacagattcagctacttctgctgctgtcacaggacttttccttagttcaaagacagggttcttttcccatgggcacgaaaattcaggctcgcaaacaatttgaatggtgagtaagacacggttttattgggtgaagaggaagaaaagggggaaacagggactcttacaaggccagagtccctgctagagcacttcccaccccgcagttcgaatcccaggttccacacaggaagaggaggagcctggctcctccccactgcaaaggatgccaacttctgcggctccaccccagtgcacaggctgcttggaatttctctagggaccccctcccacctggctgtctcactaccaaatgtccaccctgtcagcagtaaatacaacactgagccttcgatgtggaatcatccttcaaaggaaccagccacacactagttggcaagttgattacattggaccacttccaacctggaggtattaggaattttttttcttcttaatacatattctgggtgtgaatctgtggtctcctccaaagtgccacacatagttgcatgaactgatggctcagagtgtctcattgatcattctgatcatcaaaggatttcacatcccttgcatcaacagacccactttatatcaagggcgtgtgacagtagtcatgtcatatagcatatagcttcatcatacagcattagccatgaaccactagcctgatagaactttggaatgaccacttaagggcccagctaaagcaccagcttagggacagcaccctgaggggctgaaaagctattctttgagatagtgttgtgtccctgttacataaaatacatggacctgggtagcaagggatggaagtaggactatcaccccatcaaccaccactttcagtaacccacttttgtgcttcctgttcttataactataggttctgctggactagggattctgtttccctttgagggggaaaagggaggatgctgcttctacgagggaaataggtttttaccaaacccaagataatatatactacctcataatttggggatcttcatgccagtcctggaggccaagaaaggagttactactgtcatggacaagttgatcctgattatcatgaagctaaaccccatagcggaactggggatatatgtctacaactcagggaattcactgtgatgacttttagcactttcatgtcagtgattatcgtaaataggcaactgtagcaactacagcctgacaagagcagactaaccaggggcttatacccctcggtgatgaaggtctaggttacctccctggaaaagaaatctagagcagtagaaaaaaatgctagccgaaggtggggagaatcaagaataagtagtatagaaggtagatggaggagataataaatatgagttgcagtcatgcaactaactataacaaacgtaacttgtcccagtaaccctcttgttgtcaaaacaacatcaacaacaaaaactagtgatctatatgaatttaacacacagcacaagtggatctgagcaaggcaaggagtgaactgtatagatactgttggttccctacctatatctcctaggcagtcacgccaacatgctggacaccactcgctgaaaatcccagcaaccctgaagatgactttgactttctggccatgaatgtggaggctgtggaggacaagccagaaatgcaaaagagttaatgccccaaaagcagttcttaatcagtgatagacagggagtttaggcatgattactccagtttcttcatgactcatttggcatagctccaaagagtatgctatgctgtctcttagagttattgtgacaggtagttagacaggcatgaatggggcacaagagagctctcccctccacccaccaggagtcatcaggcgattgttcggcagttatcacattacctctctaaaaatgataattggcagcaaattatcactggcaacttccccaacagataaagacacttaagattggtaatcagcttccaataaaatctcaggaattggtgagtgaacccagcatgtacattaagagacaaaacagcagagtatgaccttctgtgggcactccaccagaaaaaggaagaaagcctcagatgtgcatgagtacaacttcctaaacacactgctcatgcccacgtcccaagcaggaaggagggcactgcacatgcgggcagcccatcctaagggaagaatcatgggaaaggggcacaagatgctggaggtaggtcagtgtataaaatcttaggattaaggttaaaggctgcacttgtccttccagttgtccgcttgggtctcttccaagtgtactttcctttctctcctgctctaaagctttttaataaaattccactcctgttctgaaatttgccttggtctttcattctgccttatttccctcagtcaaattctttctgctaaagagacaagaattgaggttgctgcagacccatatggattcaccaccagtaactcagaaccttctacctctaacattatccagctgcagaaagctgcaattgcccatcgtggtaactgccttgatggcacattctgtattggcttccttccttccctgatttacctcttacccatgttttgccaacaaaaaagagttaaactctgtaaaatagttaaagaggttgattctgagccaaatatgagtgaccatggcccatgacacagccctcaggaggttccgagaacatgtgcccaaggtggtcgcagtgcagcttggcttatacattttagggaggcatgggacttcaatcaaatacatttaaaaaatacattggtttgatccaggaaggtgggacaactcaaagcaaggggcaagggggtcagtgggagtgaggagcttccagcttataagtagatttaatatttttctggttgacaattggttgagtttatctaaagacctggaattaataggaaacgtctgtattgcgataagaggttataaagaccagagtttgatcaggcagatgaagcttccaagtagcaggtttcagagagaatggattgtaaatgcttcttatcagacttcaggtctgtgttgatgttaatgccagagaggtatgatgaagcatgtctgacccccacttcccattctggcctgaaccaatctctcaagttgaattttaagagagccctggccaagaaggaagtccactcagatggttgcggggggctggggggccttagaattttatttttgatctacagtttcctagaatcacctataataaactatttacacacaaattattgtgtcgaagctgacttttagggatccaaaaccaagatacaggaattcaaatcatgagacaagggtgaagattatccagaagaaatgttggtgccccttctcttattgctaccaagctgagctttgcagcacaagggattttagcagtctcattcaggatgggccccagtgcttacaaactccttaagcatctctctgagaggggacactcagccacctacctctgtgacagagaactcatgctcctcacacagcacccagtacataacagggcccccattcataatgcccagtttggggaccccaactcaggaattacataaggatccctgatgctccctctggaaatgcaaaattctaaagaatcagagtaaggtatttaaaaagagtttttttcacaatattttttcaaaatggaatgaaaatgataagagcaattcttgatataaatataaattaagctgaggcaatttagtgctgatgagaacttctgcaatagttatttcagagcttcttgatatagcataaacaaggtggttttgtttatttgtttgtttgcgtttgttttttgagatggagtttcactcttgtcgcccaggctggagtgtggtggcacaaactcagctcactgcaacctttgcctctcaggttcaagcgattctctgacctcagcctcctaagtagctgggattacaggcatgtactaccatgcccagctaatttttgtatttttaatagagatggagtttaaccatgttgcccgggatggtctcgaactcctgacctcaagtgatctgcccacctcggcctcccaaagtgctgggattacaggtgtgagccaccatgcctggccaacaagattatttttttaatccatgtaaaatgtgaacacaattacacactacatattctgcttttacttatctctgaatttagtcgatgctcttttcagccacaagcatatatcttttttctcattctttattttgagaaattataaaaatgtaaaaaaattgaatataaataggcatattcttatcactcaaaattaagtgtccttatttcataagatttgctttgtaattttttttaataagaagaaaaataaaatcacagtttgccatttgttgtgaatggagtcagaggcttctgctcaccattctggatcacgctctcctctccaagattaggtcgtattaaaaacaaatttgccagctccattttctctttatttttcttctaggctaactaaaagcactccagaaacattttttattttcatttgaaattataaccagaggcctattttctgagagaccaaaaagtattcagaaatgtttccctccttgaaacctagtcacccacccacctatcatagcatttcctgccctgaaggagaattctcaccaagcacagaggagaacccatcagagcaggagacttttcactctgcaggggagcgctgtcagcatgacacgagttagcttgctgtgggcagtcgtggtctccacctgtcttggtaaggaagatgtggttctttctttataaaggcatctaatggggctgtgaagcaggagggattaacagaacagcaactgcattgcctcttagagcccagctacctggaggcagaaatatgctgcctgaggctagaatcacaaagaaaggtgtgtgggaatggggaatgggaatcagcttgtgagtctgtttctcactcacacgtgatatcccagtgaagtcctttctctcctattttccacagaatccggcatggcccagacagtcactcagtctcaaccagagatgtctgtgcaggaggcagagactgtgaccctgagttgcacatatgacaccagtgagaataattattatttgttctggtacaagcagcctcccagcaggcagatgattctcgttattcgccaagaagcttataagcaacagaatgcaacggagaatcgtttctctgtgaacttccagaaagcagccaaatccttcagtctcaagatctcagactcacagctgggggacactgcgatgtatttctgtgctttcatgaagcacacaatgagatgagcagcagggagaggcttacagaaacctcagacctcagcatctgtgcaaaggtcacagggtgagagggaagtggtagggtaataggtatagaaaatcattgacttctcttggaaatgaaagcttctcctatttcttctcctgtaagaaactcagagagatggctgtctgcaagcttcaatccttaaagttacataaagataatgacgtgtgcagtgcattccagttttacaaggtgccttcactaaggtacttattacaggtcagatttcctaagcattttctctgtccagaaaatttttataatttgcctgggcattcttacctccaggaattttaaaccttttccatttgttaattgttgcttgtccttttatttgtccatctggtccaaaactgcatctcctccgaataaggtacccattttagaacacaacaggtgtgacaacggtggcataaccacgaaggggacttgctgggcccaccagactcaagagatgacctaggtccactgcagtagaacctagaagaatgatgaaaaggctttaaaatgctccgctgaagggccagctcgtgggcaacacctcagtggttggaatgctatgcttcagaaaatgataatattcgttaaaccactggctgattcatggtgtcgtggcaaaagtttagaaaccaagaaatagacatagaatagagtcttctcctatcactccctataagtcattttcagaattcgtgtttccctttcccacaaccctaggttctgctagattagaggtcctagttcccaaagaaggatgctcccttcggggattcagtaacctgcagctatggctgccacttttaggtcactctgaactctctgtgccaatagcccagcaggcaaagagaggagctattagaccagaaggggtcattgaccctgactgtcatggagcaccaggttgttgtgacacaaggagggtgaggaggaatgtggctataatgtaagtatttcacattggtgtctcctgatgtttccgtgcccaatacaaacagcaagcggcagttcttgtagcagcaaggcctgaaaagggcaacgtgaccaagaactgagactcttcagcaatgaagttttcaagaacagaagctcatgtcatgcaaccttcctgtattaagggcgttgaagagattgcagtcagaggcaaccttgaagacacagtgacacagtggaaataatatagggcaagcatgcatctgagtagtgcaaagaaaggactgtaactgatatatgcgccctgttgccccatccgaatgtctgtctgattttagctggagttatagtagacaatcacactcacgtcatgctggtaacatccagcgttaagcacactctgtgttttgttatgttatgttttgttttgttttgttgctttctatcccaaagtcttctctaatgtctcaggagatcccttagtttaagggcaagcacagcctgaaattatagggaaactaccacccctgttggcaaacaccaaccaatggggaaaaagagccagggaataaacgcactagctttgcgtcccttaaatagacaattctgagcggcaacctgtgtgcttcttgggagatcctaccagaaccgagtcccacttgagtcagttattgctcgacccactttcttcttttataacttatttttatagatcaagggagtacaagtgccacttttgatacatggatatattgtgtagtggtgaagtatgggttttcagtgtaaccatcacctgaatagtgtacattgtactcattaggtacttttcattcctcattctcctcccacactcccaccttttcaagtctcaatgtctgttatctttgtccatgtctatgcattatttagctcccatttataagtaagaaatgtagtatttgaatttctgtttctgagttacttcacttaagataatggcctccagttccatccatgttgctataaaagacatgagtttattctttttatggctgagtagtattccatggtgtgtgtgtgtgacattttctttatttaatcatccatccattgatggacacttaggttgattccatatcttttctattgtgaatagtgctgtgataaacataacagtgaagttatatttttgatataataatttctttttgtgggggtagatacccagtagtgagatgctgggttgaagagtagttctatttttagttctttgagaaatccctatactgttttccacacaggttgtactgatttacattcccaccaacagtgtatatgtgttaccaaacatctgttgttttctgacttcttattaatagccattctaactgatgtgagatggtatctcattgtgcttttaatttgcatttatctgatgattagtcgtgttgagcattttctcatgtttgctgaccatttgtacgtcttctttgagaaatgtctgttcatgtcctttgcacacttttcaatgggcttatttgtttcttgcttgttgagttgtgtgagttccttgtagattctggatattagtcctttgttggatgcatggtttgcaaatgttttctctcattctgtaggttgtctctttactctcttgattatatattgtgtggtacagaagctatttagtttaattaagtcccattagtctattttttgtttcgttgcatttgttttaagatctcagtcataaattctttgcctaagccaagatccagaagagtttttcccaggttttcttacagaatttttatagtttcaggttttatatttaagtctttaatccatcttgactttatagtaagagaaatggatccagtttcattcttctgtgtatggctaactaattttcccagcactatttattgaatagggtgtcctttccccagtgtatgtctttgtctactttgtcaaagatcagttagttgtaggtatgtggctttatttctgggttccatattctgttccattgatctgtgtgtctatttttcatacaagtaccatgctatattgatactatagccttgtagtatcatttgaagtcaggtgatatgatgcatcaagatttttctctttgcttaggattgctttggcattcaggctgtttttttgtttcatattgattttagcattttttcctaattctgtgaaaagtaatattggtattttgataggcattgcattgaatctacatattgctttgggcaatatggtcattttaataatattgctttttccagtttataagcatgagaggttttttcatttatttgggttatccacaatttctttcatcagtgttttgtagttttcctagtagagatcgtttacctttttgtttaagtgtatttctaggtattattttgtggctattataaatgggattatttattttgtggctattataaatttagtttgtagcttggttgttactgatgtatagaaatattactgatttcatacattgattttgtatcttgaaactttactgaattcacttatcaaatctgggagtcttttggaggagccttgagggttttccaggtataagacatatcatcagcaaacagatagttggactttttcttttccagtttggatgccttttatttctttctcttaccaattgctctggctaggacttctagcactattttgaataaaagtggtgagagtgggtatcctgctttacccattttctcactcctgcttcctgagatcacttcctaaataaactacctgcacccaaggtagtttcaggctctgtcttggggggaaatcaaactaatacagggaatctttggaaatccaaagattctttgaaaatttaacaaagaaagaacagaggagagttcaaggtgaaccttactgggctaagctaataaaggtaagtgtgtacttgagtgagaaattgtaaaaaaaagatgatgaggcagatcgcatttactaaactccaatctctgcagatatgtgattacgtcttttcagtgttcaaaaactttactttccaagtttaagctctttcaactgtctctcatttccccttcccaaatcttctgaccctttactatttaaacttcattcctagttattcccaaaatacgtctctcttctagtcagtttattccccttactggctcataaggacttaaagctcattgctggctctagcatttctctactggttgctccacccacccaaatttcccttttgtgtatatttcagactgcttaaaccatattaatcttataatgaccaccagaaatctctcttccctctaagatttcttctctaataatcaaacaatcctttaattccttctcttccaaatgtcatacagtaccaactgtggaccaaacaatccgactcttactgacataccttcctaagacatttgctgttgtttcaaggtactcatctttcctccccaaatacattatattctctatgtagatagagtttgccttgtacccttcacaattcctcactgctcttagcacagtactaagcacataataagtgctgataaggcacaaatatgcttaaggtttaaattataatcatgctatatttctgaaagaatatgaaggaaaagaaacaggtttctctgaggaggtaagatgtgatagaaggtagaatttaagaaagcagtgataaaggaaaggacagatacatttcaaacatccaagtcttttgatttagtggaaacataaatctgaaactggtaaaaagattacttttagaatacatttcttactaaaccaagttctttccatacagaaaatcctagaaactgcctctgtaattatctctttgatctgaagagggcactgtttgctcctgttgatagcagttacttacaaaaaaccgatctcattttgaagaatccgctattcctaatacatacaaaataactagaacaaatcctatgttatccgtagagtctaggtcagatttccacattctggaatcaagttttccaccaattaaaaaggtcaaaccatggaggagcttttaggaactgtatttgtgatctggtggctttggcctgggtgagagctgagtgaattcatttcatcagggacacagaggactcagaaggttctgagaactagtctctatattttacagaagggattcaaagaataaataaaacatttaatttaccctttatttaatttacccttaattcatcttttttaagaaaatttgctatcaaatgaaggaagaggaatgctcttctgaccatctgtccagagagacacaaccaatctctgttctccagagagacagagccaataggatgaatatatagatatatgagaggggatttattagaagaattggctcatgcaattatggaggctgaggagtcccatgacagactgtctgcaagctggagaacctgggatgctggtagtagtgtgactagtccaaatccaaaagcctgagaacccagggggccactggcataaatcctacagtccataggccagagatcccagagttcttgtgtctaagggcaagagaaaaagagtgtatcccagctccaggcaagagaaagaccaagttgcttttcctaggtttctgttctatccaggcctctagcagattggatgcccacactgaagatggatcttccccatgtattccactaagactcacaagccaatgtcctctagaaacaccctcataaacacacccaaaaataatgctttaccagttctctaggtattccttaattccgtcaagttgacgcctaaaattaactatcacaccatccatgaaggaaagatgttttgtcatctactataattatttgaacaatgtttcagatccatgggacagaatgaaaaagatctagaataaatctgatgtctttgtttctgttcttgttaactagggttttgtagtgcaggggaagataagcagcctccttcagtgctagtaccagctccctctccctgaaccacaagaccacccagtcgagggacttagccatctatgtctgtgctgcagggaacctacatgcccctgaaagcacctaaatgcaccaccccctccaccctgcattgggacctccactcaggggttagtaaaccatcttcatcacctcctctgaccaaaagaatattgtaaatgaatgtaacaaatcagagaaaatcttttctaaaagacttttagaaagctttttgttcactgtattatcagataaggaattcagagtcatgagaaccctgatcatgagctgtctgaggtgattaggaccagggaccctgagtgttctttcgtcaagacccactcatctaagaggggctgtctcaatgattggagcggcttctcccacttgtgccattaattgctggtatgcctcagtttttgcatctgtaaaaattctcccacgagaacctgagagtaggcgtgtgatactcacatatttttctcctagtttttactttttatagtctaactagctaactccagtaagaaatcccatgatggtagttgccagatagggttgatatcccaagggagcacagtaaaatttctcagactgcccagaaggggttctgcttccacaaaaaagcagccgtctgcccaccccacccgtatttgcccacttgcaagttcttttatatacatcgctttatttggtcttcaatgttcaataatttgattaactgtggaagttggaactgattgaatgataaatacaagatactaaagttctgattgcataggtcccagaggatcacaaaaaagatctaaagtggcaagatctatctatggccacaccaccccaaatgtgcccaatctcatctaaaatggcaagatccattcagcattgcagcactggaatccccagtcagcattgcagttgcaggcccagtgagcccaggcaagaggcggaaaacatttactcttgagaccctaattagtgaactcatagatagctgcagctggcctgagactgggagagaagacagcccaatcgtctggagcttcctatacagactagagagtggtggcacatgcctgtagtcccagctactcggaaagctgtggtgggagcatcacttgagcccaggaggttgaggttgcataattgcgccactgcactccaacctgggtgacagagtgagaccctgtctcaaaagaaaaaaaaagagaggagaagggggtaaattgtaaaataatagcatatttgccaatttcctgtgaatttgtccagaaaatagtaggtagtgcagaaatttaacaccacgcaaacaagaaaagtagaccacctatggaagaaactcaacatgctgtactttaagaagtcctccggagttaagaacggctgtggcaaaatgcccactgttagcaccatttccaagtggaaataataaatgggaagggagagttaagaccaccactccctatacggcaagtcagcttttaatttagtcttttattctccttcttgttttacagggggaaaagtttacataaagctgaactatacagaagccttatctaagattggatgacacaaattaaatagggagagaaaattaatgcaaatgaaactagtagttctctgtattgtgagttttcatttttgctctgttgcctcttctataaaatgcagactaattcctgacctttcctccctcaaagaagaatgtgtgcatgaggaaaaaatcagatgccaatgaaaagctgtcagatgtgcaacacagaatgttcccaaatgaattttatgttgattgttctgagtcttctttcacaaagtcattaacagaagctcacaaaagcccttgccaccagtattgtagagctccttgacacagccaaaatcaggtattctttttttaaaaaagaaagtcttcagcaaattacagtataattagatatcaaaagtctggtttcaattttctctagactatctgaatgttattgttgttgtcattatttttcatcatttctcaaagtattaaaatacaatttggtcaaacaataatataaccaatacctgtattatcataacccagagataattttctgatattggcttcaagacagaggagggaaagaaaaaaaggaaagaaggaaggaagaaaaaaaaaaggaaaaaagaggagtaaggggaagggaaagagaaggaaagacgggaaggaaagagagagaaagagagagagaaaggaaagacaataaaagcttatagagaaaactgaagtcacagcattagcttggcctgtcttttccccacccatctcattctcctatccaaattatgtctttaaaaaacaatgtatcagctccctttcctcttcatgtttattcccaaataaattacagttccaacaacatcttttttcgttaaatattatggtccaagttttattctctgaagcaaaagacaaaaagtatcgaagagctttccctaagggagacatcataaacagcccacctgacatcccatttcctgttctgaagcagctacggcaccagtgcagctgatactcaaggttcagatcagaagaggaggcttctcaccctgcagcagggacctgtgagcatggcatgccctggcttcctgtgggcacttgtgatctccacctgtcttggtaaggaaggcgcatgtattcaccttaactagtattcaatagaacagagaagtgggaagaaagattaatagtgcaagaatctaatctcttcactgggcccagctattaggggcaagaaagctgatggattttgtcagaggtttggatcaagaggaagaaaggcgggtggcaatgggaacaggcttgtgagtctgtttctgtctctcacatggtatcccagtgaagtcctttctctcctctttcccacagaatttagcatggctcagacagtcactcagtctcaaccagagatgtctgtgcaggaggcagagaccgtgaccctgagctgcacatatgacaccagtgagagtgattattatttattctggtacaagcagcctcccagcaggcagatgattctcgttattcgccaagaagcttataagcaacagaatgcaacagagaatcgtttctctgtgaacttccagaaagcagccaaatccttcagtctcaagatctcagactcacagctgggggatgccgcgatgtatttctgtgcttataggagcgcacagtgagacaagcaacagggagaggcttacagaaacctcagacctcagcatctgtgcaaaggtcagggggaagtgttcagggttataggaacataaagaggaaataattgtcttccctaaagaaaaaaaaatgtatctgactataggaaacacagaggggatgtctataagctgtaatttttgaaatagtaataaaataatgaatccacacatgccttatagattttcaaagtaccttcacatgttaatccattaaacctgcataagcctgtgtgttacataggtcagatcagatattctaaggatcactgctatccagagaatcttagagcttgacctaaagctatattcttttagaattatatatttttgctttattattttaattactatctatctgtacatcccatgatcatatcaaagtcaatatatccaaaactgaatttcttaccatctccacaaacctttattttttcttcatttttttctcctcagccttgctcaagattcaggaacacaataaaagtttgctattgctgggtttccagtttggggaatttcttcaccctcgactttccagcctgggctatcagatttttatgcataccttattacattctaattataaaatggtgcaaaaaaaaacactacatcatgtcagtctcactgtttcccctctatccgtcattctttctgactttaacctggcttaatcctgtatttcttaacgttctttaaagcatcatttgtcttgacataagaaagtaaggaaagaaagcaaacgactgtcaagtaggatttcatgtactgctagtactcaccagcaaacgctaaaaaaaaaaaaaaaagaggaagttaacttctggtaatgctataattgcttctggtaaggcaacctagcaggtggtgacaattttgataaacctggtccaacagggagaccaagcagctgccatggtccaagtctccacccctatgtcttctgagaattgggagatgcctggaccgtgagaggattctcccttatgctaagggaaaaattaaaataaatgaaaaaaataatgccaacatttctttttatgcccacaattcccccaatacatctccttcactattaagccccttgtggagcattttattccatctgctcactgtgggtggcgagaggaagtttggaatgacaaacagccgaaataattaagtccaataagcaggctccagagcttaggctgggggtctgtttggaatgagtggtgagagtgactggatgtggaagagggtaaggggaggccaagaccaaactgcagaatcataattcagattgccgagtcatttcccaaacacagcagcttcagtaacgccacaccctagcccagcttagcacccaggcttctgcttgtctgaaaaagtggggtaggcaccaatcaaaatgaaaacctttctctcacacgaggaagacaccttcaggctattcaggttttgtcctcccttttacccctgaggcccatgagtcacccagacttagattcgggctagttaccaagtttcatatcaaagctcacttctttctatccttgcttctagtgctttcacgcagctcctctcatttgaattaataaataatcattaatctactctctctaccttcgattgtgtcctcttttaatatggtttagctgtgtccccactcatatctcaacttgaattgtatctcccagaattcccacatgttgtgggagggaaccagggggaggtaatggaaacatgggggctggtctttcccatgctattctcatgatagtgaattaagtctcacaagatctgataggtttattgtgggtttctgcttttgcttcttcctcatttttctcttgccgccgccatgtaagaaatgcctttcacctcccaccatgattctgaggcctccccagccatgtgtaactctaagtccaattaaacctctttttcttcccagtctcaggtatgtctttattggcagggtgaaaacagactaaaatacacccttcaaacattgcttcacatagctgtcccagtgagcatcctataataaaaatcagatcatgtacacacacctctgcctcaataaagcctcatttcccacagaaaggcccagtgattatttagaatataagtccatcaaagcggaggccaccactgtatctccagcacttaccatgcctaacagggtaaatggtcagggtcatctactgatggattaattagtctgtaccctgcttagcaactcagcctcatttgttgccatattcccatccccccaaactgtacacgcccatccgctcagcaaatgaaattgtttcctgcatctatgcctttgccagcattgtcccctcagcatggaatgcccatccccaattaaccacttgcctattatttgaaaggttcgcaaacctcccctcttctctgaatccttgtcctgacccttttgcactggtagaactgatcactttctcctttatctcctaactgaaaccctaagcatatttctaacgtggcaaatccaacaccttatggtgtttacaggtatttttcactgtctccccactaaaatgcaaactgttagttaccaaggacacagttttacccatttcaatagcaactgtgcctccaacaatctttaattcacagaaatgattcttaagttttttgaatgaaggtaattaattgatgggcattttcctcattaaacattatagagtaaaaatggataaattttctattttgttatctcctccatagttgtgttaactcagaattctgagctaactcataggactgtaaggcatgtcaaaaattaatagtaacaacagtatcatgctgataataaaaatattagtagtagctaacaattattgagtatatatatatatatatatatgcgccccatattctgagaggtgcatgacatgctttatttcatttagtagtcccaacaaatccatgctgtagctactattgatatcccagttttatatgaagaattaatataggttcaaagaggccaaaatgcctagaatcacacaatgtacgactccctgaccactggcctttttcccttcccaaagggtggcaaactgctatagcatctcagtcttattaatgtaatagacacatagaacataagaaagaaattcatgaaaacagtgctgcaccatacatgcacttgtagtcctcactttttctagagtagtaattgcaagatgagacttatttcaagtatccttattaatagaagttaaatgtaaaaataacactattaccattattgtttacataggaaatttttgcctttttaacattagtttataattatttgacctgggactatacaatattttaaacttcttcagtgcatttttcaatagcgtttaagtttaaaatgcagtctttggcaggggcattaataaatgtttcaaatgtcattttgtataactctttaaagaatacaagagtttagaagaaatttctaacctttccaagttatctgaatttccaagttatcataggaagatccttcctttgtaacttttaaaacttttttgtatatggttgggcgtttctatgaatgatgcttttcaattttttttgcttcagtgaaaaattatatattgtgaaagctttcccacataaacaagcagtttttctatagcatgagtttcccatggctacaagatattgtatttttgaaatacacctcattttacccaataacttgaggttttttttgttttttttttttgtttttttttttttcagatggagtctcactctgtcacccaggctggagcacagtggtgcaatctcagctcactgcaacctcccacagccaggttcaggtgattctccttcctcagcctcccaagtagcagggattacaggtgcgcaccaccatgcacagctaatttttgtatttttagtgggggtttcctcatgttggccaggctggtctcagactgctgacctcaagtgatccgcccacctcggcctcctaaagtgctgggtttgcaggcgtgagcctctgtgcccggcctaacttgagttattgatcgagtaaatcaatgaatacagtaagcatgataagtacattgtttccaaattggagctataataagtaaaactgtaattttaaaaagatacttgtacataaaatagtatgcaagtaagagagagcccagatcaaagtaaccgaagcaaaacaaaacaaaacaaaaatctgttggctaataaaactgaaaaatctgggttaactactttaggaaggactgaccaaatgctcaaataatgtcaccacagcgtgtctctatcgtttggctcttgtttatattggctttactctgaagaaagctcaggcccacatgatggcaaagatggccgccaggagcctcagacttgtgtcctactgtgttagtttcctcctgctgctgtaacaaattatcacaaacatggtggcttgaacaatattactttattatcctacagtttgggagctcataagtctcactgcactaacacaaaggtgttggcagggctgtgttccttctataggctctaggggagactgagtgaaatcctgagcatccctggcttctagaggctgctgcgtgccttggctcatggccctcttccatcttcaaaactagaaatcgcagcactgtgacctctaccaccattgtctcatctcctgtcaccctcatggccctcctgagccttgatccttgagattacattgagatcccccacatattccagaataatcttcccatcttaagattcttggtgaatcccattttctaaatcacattttcaaggacatttgccacataaagtaacatattcacaggttctgaggataggtggtggacattcctatagactgaatgtttgcgtcctctcaaaatttgtatgttgaagtcctaatccccaaggtcatggtattaagtggtaggacctctgaaaggtgattaggtcatgagggtggagttctcatgagtgagattagtgcttttataaaagaggccccagagagctgccttgctctttccaccgtgtgagagcacagcaagaaggtaccatctatgaaccaggaaatggccctcaccagacactgagtctgctgctatcttgatcttagatttcccagccttaattgtcagaaataaatgttggttgttaaagccacccagtctatggcatttggagtataactgccccagtggatgagagagacatctttggaaagctacttctctccttaccatacctgccaaattaacaactccagcagaagaaacaggcttcttttgtgatatttccagaaaatatcctggactgactttgcttagactgatttcttcagatttgggaaacaggcagaggtggttcctcaaggcaaagccaagatgctactagaagaggaatgaataaggatacgtaaaaataacagatgaccccaatgctattaatttatttcaaactcctttttgccatcagaaagcagtaataagctcacatatcaattccaataaaataattttttaaatcgcccaaacttacatttcaacatagcaagcaaaaagcaatgaataaaattgcttcaccaaaatatagaagctctgttgaccagaaattcagcatagacagttgttcaagataatttcaatgtgttcagcagataaagggacaaataaggactctttaagggcaaatttagctgagggatgtgttaaattgtatatttggcagactgaaactaaagaataaaaaaagagacagcttgatataactttctatgccaaacccaatgttatactctaaatctaaaactccagaaaaagtttgaaagcaacaaatatgaagtcaggaaaatcattctaaattaccaactatttaggtataatcttgagcattttagctgtagatgaaagtcctatttattcatatagattctcatatgctatgaataatagttcatttggatgtctctttaaatcaaggagggataaagacaggaaggaagaaagctggcaggcaataagagccaaagtaaagatattattttgattaaaatatactcattgttgaggtatccacaaatatttgagaacacattgaagaagtaagacaggtcagaaaatataagtatatgatcagcacttagtgaaaacagttaaagagaaagaaagagcaaaagaaaaattgcttaaagcaacatagatattcaaagataaggaattaaagctgagataaatgtgacagaaatggaaaggaaggaaaatgaagttatgaaacattggcaaaaatagctaaagaatgcagaataaaatgtcctagaaaacatttatcaaagggttatattttattagcattcagtagtcacaaggcaagaaatatgatagctataaataaatacatgagaatgtttaaggttttatgatgatcgtggctttactgttcaatatatattaaataaaccacaagttatctataacacagttctgaataaaatttaggaaacgtagagtcaggtacctcaatatagaaaaatacagaaataattaaccataatgcagacaaagtgacacccagttgtagagagcattacaagcattgaaatattcagaatattatttgattaaaaaaaagctcatgtaaagataccctaagcaataccaaagatacacacacacaaacacacacacacacacacacacacgacacatacatgctatatataggaaggaagaaagcttctttattggggacacagtttacatattacctcttgtttctatgagatgctataagaaaaaatctcttaagatttactacatgggtaatatatttatatagtgtctgtgtgtatgtatagcaaactcttatatatatatatggatatcttacagtcttatagacttatatgagagtgacagtaaaagagagagagagagaggagtgtatacctatttcctctcaaaaaggccatattctggcaactcccttattccccattccctactatgcagtttgatctagccttagatttcccaggaggttctcttccagaaaagtgcctgtagctataaaataatcttcatcttggctgtttcaatgcaggattcctattgagccaataccttaccattttctttccttcgtggaactgtgctttgtcataatgcaataagttttctatgaagtatatcataaacaacagtcctacagaattcatcattggacataatatagcttctttattggggacacagtttacatattacctcatgttctatgagatgctataagaaaaatttctcttaagatttcctacatggataatttgtacctacacttgtagtttgtttttatcatatggatgaggtaattatcacaggactgattgttttccttctttacattgactgctaataagttcagagccaatgttagcttaactccaactatagaggctgattgcatatattttaattccaaatctaattcaaggtttatgttcctgcccttatttttttcttcttgatttttgtatttctttgctgttgtttttgtagatttttctgtgccttatacttttttcaaagataattaaaacagtgtgtgaattcagtggggtggatgaatgaatgaggcagagaaaaaggaaattgacatggtaggataacaaactcacataatatgtagatacatataaaaagacacacaaagaaaaaaatttctctaatatatctaatcttctttatgaatgatcccatctaccaaatagtcaagaaacttaaattttgtaaattgcaattaacaatgtctcattttattcaggtttaaagagttcctttcactttaaatattcagttcatttaagttcaattccatgttagggctgatgtaaattctttcttagatgactcagtctctttaggtgatatgtttggaattcaaccaccttacccttttctttccgtgatgaaatttaggtgataaggtgagacagttgagtgtcacctgaggcaaaaaaaaaaaaaaaaaaaaaaataggcttaaatccatgcattgccttctggatcttttggtctgagcagctgagcagccaatctactctgttccctgtgtaggtacctagttatatatggattttcctacctggacttttgggattatgtgttgacaccactgctgaagccaattgtttcagccgcttgactccatctcaaagaccctcatcatgggcacttctttgtacttagcccaggactttgccaggccactagctctctcaattctctgcatctacttcctggacccctggggacttctgtattccctgcacctgtaaacagaccatggggattctagaaagtagcctctgactcatgtagccaagccttgatttttctccagcgccatcttcccacgacttaagtaagacttcccccagagacatgcagcctgcccctagaacactgtgagaggtgctctactacccagtactcttgtgctgttcccatacttatctaaatgcttctagcctttcctaacccaatcagtgtccgcccatagcagaccaggggaaagaccagagtcctgacacctaagttccttgttctgcctccatttttctttaccctctaggacccaaaaaactgacctccctctctgtcctgcacctttctgtcaaactgatgtaaaactctatgatcaagtccagctggtcttacatataatatggtaaagaatacaataaataattaagaaaaagtgttacacctgaaaaaaaccttacttttaaggcagttctcttgttaagtaatcaaagatccaaatttagatgtcagagctgaatattaatgctttctatttccattcctctcagaataatctaatctctccccactcaagacagatagattcctcagaagaatatagataaggttatgtatctgaaaatataaaggagaaaagaatattaatacatttcaaaaatataatctcaattacaagtagagggaggaaatattttatatcaccaagggcactcattggaaaatcaccatagatattttcaaagaaaataaaagacttccaaaatcaaaagaaattaagaaaatgaagaaaagacaagccacagactgggagaaaatatttgcaaaatgcatatgtattttttaagtggtatccaaaatgtgcaaagtactcttaaaactcaacaataagccaggcatggtggctcacgcctgtaatcctagcactttggtaggccaaggtaggcaaatcacctgagatcaggagtttgagaccagcctggccaacatggcgaaaccctgtctgtactaaaaatagaaaaattatccaggcatggtggcgggagcctgtaatcccagctacttgggaggctgaggcaggagaatcacttgaacctgggaggtggaggttgcagtgagccgagattgagccattgcactccagcctaggcaacagagcaagactccgtctcaaaaaataaataaataaaataaaataaaacaataagaacatttaaaacccaatgaaaaaaatgggcaaatatctgaacagacacctcagatctgaactatctgaactatctgaacagactataaacaaagtatatagatggtaaagaagcacatgaaaagatgcttaacatcaaatattactagggacttgcacattaaaacagtgaaatatcactacctgcctatcagaatgactaaaatccaaaacactgaaaccatcaaattttgtgagaatatggagcaacaggaacccttattcattgctggtaggaatgccactttggaagatagtttggcagttactcataaaactaaacattctcttaccatatgattcagcaatcatgctccttagttttaactcaagtgagttgaaaacttctgtccccataaaaatctgcatgaaaatgtttgaagtacctttatttataattgctaaatcttgaaatcaaccaagatgtccttcaacaggtgaatctatcgacaaagtatggtacatccatacaatgaaatattattcaatgataaaaagacatgaccaggccgggcgcagtggctcatgtctgtaatcccagcacttcaggaggccgaggcaggcagatcacctgcagtcaggagttcgagatcaccctgggcaatacggtgaaactctgtctctaccaaaaatacaaaattagctgggtgtggtggcacatgcctgtaatcctagctactcaggaggctgaggcaggagaatcgcttgaacgaggatgtggtgagccgagatcatgccattgcactccagcctgggcaacaagagtaaatctccatctcaccaaaaaaaaaaaaaaagacatgaccacaaaaagacgtggaggaactgtaactgtatattgctaagtgaaagaaaccaatctgaaaagactatatactgtatcattccaactatataacattctgaacaaaaacaaaactatggggagtgtacactgatcaaagtctaatgtaaattatgggctttagttaataacaatatattaatattggcttatcaattgtaacacaagtatgacattaatgtaagatgtcaataataggggaaatggggaggatgagggttgagggggtgtataagagctctgtatttccactcagtagtaatacatcccatgctagtcttaatcttaaaaagggaaatatattctagttgctgtatttcacaatgctatgatcattccttgtcttacttagttcattaaagctgccatatacaatcatagactaggtagcttacgaattacagaaatttattctcagagtctggaggctgggaagccccaggtgaagacaccaatggatttggtatctggtaaaggcccatttcctggctcataggtgacattttctcatcatgtcctcacatagcggaaggacaaggcagctctctggagcctcatttataaaggcaccaatctcattcatgagggctttgccctcatgacatagtcaccgcccaatggcaccacctcctaatatcatcactttggcaattaggtttcaacatatgaattccaagggggaagacaaacattaagattgcagcagtcctttcttctctatcaaatccttgcttatccatctagatcctcagcaaatacaacttagactatatagcccataatgatctactttgctaatcaactcacatacaacttcttgactctgccatatgggggactttttaaaacattgacttatatttctacttaatcgtgtacaggtttatatgtgtcaatattcagaactatgatttacacacatagaaacatataaattaaaccaccatcatcactcccaatcatacacacacatgttcatatacagcatccaataaagcatcctattcaaatttggtaataaataaatatttacttcttgaaagatcaactggctaaagaaaataatgtattccgattcatccactttcccaaaggagggttctacacaacaatcactagtgtgtgcctttggtcacacttttaagtaacagtaagcaatgaaaaaacaaatagaaaatgccaggctgctctcatttgcactcctgcttcatgtaaatgctttcaattattcatctagcaaaccacacacacattgcaaatgcctaaaatttccttttgccaattagaggtaaacgcagtccccaatttctatccatagaagaattaaagcaattctatttgcatccaatgtaaccaaaagttgcctttctcaaaagatacctatgtggcctcaataatccagacaaaaggctcactctctcagtgtggctgctgtacttcttgcctcttgtctgtataatctactgaaattaggtaccacagcactttctctccaacaaatccatggaaagtaggaaaacatgttgaactactccaggactcccaaattcaggttgaaattttctttcaacatagaagtagaaacttctggtgaaagatggtaatagctcagcaggaagtcagcacaaacctctaaaggcaaagcaggaggccggagtcctcccctctctccctccctcataaggagccctgctctggagacttccatggggacaagagagaagaaatcgttttgctgctcagatcctaggattgagtgacataggaatggagggcccaaaaatttgagtaaaattcctagacttggtttctgaaactatcctgactctaagattaagcaacttctcttcttaaatttcttcttataaatctctccttggggaacgttcctgggtggataaaacctatggaagaggggaaacagagttgtggagattaaagttaaaataaaaaaaagtctttttgttttgttttgtttaatcctattttctcattatttatctgaggtaatcaagatccagagaagtccctcccttgccctacatgggatagcagggggttccgcaaggattctgtcctcgcactgactcccactcccagtctgtgtctgcttttcataccaaacactaaatatgttattaaacaggagaataaaagttgtgaatatcaccctggcctagacagaaacacacaatatatacaataccatactataacagatattctactagatatgagagagccaatacaggctaatgaagaaacaagaggaaaagatgaaaaaaatgacatctagaggtattcgtaaaataaaaatctaataggtaagtaggcatgagttaatctgatctttcctctaccccaaattatttttctgccccaccgtctaggctagaatgtctacttcctgcttctgtgcctatagtcatcttagtctttgtctaagaacttggtcaaaccagaacctttaggtattgtgactccatcagttaatccctatggatattttgcttcttagtaacattctgggataacatttgtagactgctttggttattaacaaaaccaacaacatggagctttaatgcactctctaacttgagttctttgtcttgtctcttttacagctgcgttttctctgtgacaccaggaatcagcatttccattcaaatacagcaaactttaaaccgctttttgacaggaggaaacactttctgcctaatgaaggggatgaagcaggtaacccagagagtatctgccacacaggcctcctctacagtagctcagaattgcactgtttgattatttcttacacgtggcatctgcaaattcagaaaggtgagtgatgtcagatctaaaggtcccttcttccatcttggttcattcaaattcaggtctaagaggaaacattgaagaagctatctgaatttcaacaggactgattactttccaccaaaggctgtaggagacacagatttaaagagtgactagggggttaaacataaacatatattgacagtaattcctgcattgtcatcaaagtgtgctcatgtttgtaggccaactcttagtggtattcagacattggaaaactgtaaaaccttcatgcatttttaagatgacttctaaaatattttattattagtttaaatgtttaaatagctacaaaggttgtaaattccactgtaatataaacattgacattttcaaataaaactcagaatagcttttaaacatatccagtgaaaccttaataccaaagtgatttgatacccatcaacacccagttaaaattcacaacaagctcttcattgacaattgaagaccttatattgctcttttctttccttggaatcatatttccattcaacttctcctgcagaacttaattttagtatatttttgtttaaaggcttttgttgatcacccaaaatgcctgcaacaaaatcacgtaaaaaattgaaattgcttttaaattttctctgaccatactgctctaattgctaaaaattatctttctagattgagttataaatataattattgttgatgtaccttttattaaaacaacaaaaatatatttcaattttagttttaaacttacaggcgaaaattttttggaaatgcatttcttaagaaaatcactggggtcggcccggcgcagtggctcatgcctgtaatcccagcactttgggaggccaaggcgggtggatcacgaggtcgggcgattgagaccatcctggctaacacggtgaaaccccgtctctactaaaaatacaaaaaattagtcgagcgtggttgcacgcgcctgtattcccagctactcgggaagctgaggcaggagaacggcgtgaacctgggaggcggagcttgcagtgagccatgatcgcgccactgcactctggcctgggcgacagagcgagacactgtctcaaaaaaaaaaaaaaaaaaaaaaaaaagaaagtgactggggtcatatttatggttaattaaaggaggcttccttgacaccaataaattgtccctttgtttaatgttccaggggtgtttaaactgcagggcaatgctgcaaaaggagattccgtcttgaataaggttggggaagagcaattatgaaatttgagacgggaaacaagaaccacagtcaagctcttgaacagatcacttttaggaaaggttacatacagaagttgaagatctggaaattgattcccttaaaatacataactgttgcctagtttgaaaaatcactgcattagattgctctccacattactgatttcattctcagccagacttcatgaagtggtgaggtttgaggaaaatcagcaagagattttaatgacagagccttgagtttcagtaaacctgataaatttcctaaaacttatttgacatttctggcttgaaagaatagctcctgatgaattagaaaattatgggagattgagttcttgcatgacacaaagtcatttaaacatatatctttatcttgggaaagacagtttaaatgtcatggccatttattaataatattgtgaaaaaaagttatcccaatcctggaaaaaagaaaaatgatggttgctagtctttttttttctctatctgcaagagcattttcaagtaagcaattatctggcattcttggggatcgtaactttgttgtcagagcatatttacctagcaatccataactgagaaaaggctcacatagtttacattcctgtgggttggaggttaacccacagaaatggaagagttttgcgttcatagcctggaaaaaaaaattaaccccagattatcgtgtcaaccctaatagcattttattttgctatctatatagttgtatctttttcctgtaaacatttgtggaattagctttttttagttaatgattaagaatagtaacaaaatgtgaacccaggctcactccctatttgtattagtattttgttttttagcacatttaaggccatcctggcactaaatcagaaaactacttcctgatacctaaactataaaatcctggtttcatatacatctgaattaggcaaaaacatagctggctattatttatttaatttgatgtcttaacatgtaaagattttcttttcagaagaaatctaatggaccagatgtcctgaaacactcttaattatttttcagtagtacgaacatagccatgaaggcaaaggaaggtagatgatcaattcatgttaagagtttcaaattccatggactaatttatatctttctccacagccacctggcacattctgcctttgaacagatgctttacaaaaacataatctgtggacatggagatcttgcataaagcaaattctctctgatccacagcttcactgaggggtttcagttttctaggccagagtgactgctggagatgaagagattctatcaaacgtcagtgtaaaattgtctcttacttaaaatgccctcattgatcttatcctgatacccttactacagaagtttatcatgactcatctaggagataccagagagttcactagccaattcaagagcatgacttctcaaaattctccatgttttcctctttccttcctagctaatcccactttctcctgcctttgaaggctatagcttctctgccaatttcttgaattatggggttcctaagccctcttctatgttatccacagattctaggcaatcttactggctcctgagcctcgaataccatttaactgctctagactgacaaacctgtatctctagccaagactctccttggcacagacacactattgggctccctatctcatcaccccataggtccaccttctctgtgtccccatcctagtaaacgaagccatcagtgcctccaacatgttctcttcagtctagccagagttattatttaaaaatacaagtgcaatctgtttgctctcttgcttaaaactaatcagtgacttccagtttcccaaaggatggaatcccaaatcattactaaggctcacaaagcctttctttctctagcttattcctctggtttcatctttcatctttattcttcacccatcttgcactctgtgcttaatatctcctgtttgcttccaggtcctctctccatccttccacaccctgctttgtgccccaggtgactgacctatagggattataccaataagctatcttgtcttttggtttccagtaggtttttgcccaagggcagtacccacagagaacagaaaaaacgaggaaagtaaggtcaggctatatattcccccaacttcctcccttcccacatactgacattaacccacaatcagctccttacggtggcctctccaaatagcctgtctttctccaggttttggtaatcactccctcctttccattcaaggcctggagtgatgctagtcccaggttgtagcactatctcttatatgttccctgctcactgcttgtatttttataactagtgtcatgtttctcaaattacacaatttcagtatgccataagtttcctaccagaacccagattgatactgtctgctttcaaatcctaaaaggtgtcaactatggcttaaatgttccttatttcgggaggccttttctagccgtcttgacttggatgtaaccgcctgctaaacctcctacagcaccctgtccatctcctgacagaacatccttcacacttagcagcaatcattgaatgagtattagtgtcgccttctctaaacaacaaacaaactgtgtcagaaaaatataaagcaaaatttgtaggaaatataaaaataacttgataacatattcattatgggacaccttaatatctttttctcagagagagaaagagagagaggatgatggaaaaaactttatattaaacatatagctacagaatatttacaaaaaaatgagcatataatatgactcaaaaaatgggaatcatataagccacattgtctgaacctaatgcaataaagctagaaactaataattaaaagatagcaaataaatgagtagaaagagaaccacttataatattctaaaacattttcaggtcaaagaactaagagttaaaattacacgtcactaaaaatgaaccctaataatggtactacataaaaaaactatatatttgttcaaagcaatattcacaagaaaatgcatccatctattaataaaaagtaaaacaaaggaggcaaatctggcaattcaagaaataaaaaagaaatgagcaaaataagccaaaacagagaaggggaaagtttaatgataaaagcaggaattaatttaaatgcaaagcaataattagaatgtacaaataaaggcaatatttctaggaaaactgataataaaaaagaaaacacaaatgtgcaatgttaagaacgcgaaaggtgctataaccccacaaaaaaaagcaatttttcaaatcactggttaatgccttgtatacatagatcttgatgaaattggtggtgtttagaaatatataactttttaatttaaacttctctactttctaaaaatttatactattttacaattccaaagtcaatatcaaattgtaaagaaaaaaatcctgaattctgcctcttcttccttcttcacatacgcagcaaataaatgctacacatataccaactactatgtctcgactctcctatgttttcatcattaaagaaaaaaacattgcattcctactatatgccaatcattgcactacacactgggaaatcaaaaatgactatgagaaattccctgctttcaaggagttcatagtctagtgcgagaaacagacagatgtgcacactgattataatactatgtggtacctgtgataatgcataataatgatagatgtctttactgagtttctgctaagtgtcaaacaccttccattcagctgagatcttgtcctttcctccaactcttacccgggcattttcacataatagctcgttatcatctcaatttcaaaacactttttgtactcagatgcttctccaatttcccagtttctgtaaatggcaccacaacatttccttattcaggcttgaaccttttgagtttatagtcaggtaccaatgcttgtcagtttttcctttgaagtgctattgaatgtatattttgtttagaattcccatgactaccaccttattcaagtccttagattgttcccaccaagttgaaaggggtgtcctccttcctcttcattattgaagtctctttcttgctcttctcccctatcctaccagctcccaaccaccctctgaccctctgcaccactgccacacctttctttttaagatatcttttcatcatatccctccactattcacaatcttacaacagtttctattttctcatgaatataagccctttgaagtagctttcagtgacttccattatctcctcctcatttcaccaatttatcctcattcccagacactattacccagactctgttttctctgttagctggaccattcttcacactttctcaaagacatgtcatcctcactcctacctctctatatttcctgaaatagcctttagtgcgtgctctctctctctctatctaaacattatgtgttttttaggccttagctcctccaaagagattgtactaaattcctatagcctttcataatttccctctcttttgacctcacgtacagcatacacaaaaaaaatgcacccaatgctatgctactgtacaaagcagtgtactgctttgcactgttaactttaactctatgtgcattattttaatctttctaactatcttacaactccattaaaaccaagactagatactgtggaattatttaatacccccacccacctcatcatttatcacattacttgatacttggtgagtacttgctgggtacatttgaatgtaatgtcttttatttcttaatgtctttcattttctcaagtgttgttaaaggcaaaaagcaatgttggatggttttatcagttatgcagagttcatgcaggaaaagagatttcagtgggaccttgcttaagacaatagagaatttagtttaggatttaacaggtctagaaattaatgtagaaagctgtcccacaaagatctattatccagaatatgtaaggaacctaaacaattgaacaagcaaaaaacaaataactccatttaaaaatgggcaaaagacctgaacagacatttctcaaaagaatacacgcaagcggccaaccaacatatgaaaaaatgctccacatcactaatcaacagagaactgcaaatcaaaaccacgatgagatatcatctcacaccagtcagaatggctattattaaaaagtcaaaaaacaacagatgctttcaaggctgtggaaagaagggaaaacttacacactgttgatgggaaggtaaattagttcagccactgtgaaaagtagtttggagatctcgcaaagaacttaaaacacaactactattcaacccagcaatcccattatggggtagatatccaaaagaaatcaaatagttctacccccaaaagacacatatactcccatgtttattgcagcactatctacaatagcaaagaaatggaatcaacttaggtgcccagcgatggtgaattggattttaaaaatgtggtacatgtacaccatgtcatactatgtagtcataaaaaagaacaaaaccatgtcctttgcagcagagtgaatgcagctggaggccattatcctaagcaaattaatgcagggacagaaaaacaaataccctgtgttctcacttagaagtgggagctaaatattgggtaaacatggtcataaacatggcaacaatagaaactgggactactagaggaagaaggaagggagtggagcaagggctgagaaactaactttcaggcgctatggtcgctgtattagtcccttttcatgctgctgataaaaacatgccaagactgggtaatttataaagaaaaagaggtttagtagactaacagttccaagtggctgggaaggcttcacaatcatggcagaaggcaaaagacacatcttaaatggtggcaggcaagagagaaatgagagccaagggaaagtggaagcctcttataaaaccatcaaatctcataagacttattcactaccaggagaacagtatgggggaagctgcccctatgattcaattatctcttactgggtctctcccacaacacatgggaattataggagctacaattcaagatatttgggtggggacacagccaaaccatatcactcactatctgggtgatgggatcatttgtgccccaactgtcagcatcatgcaatatacccagataacaaacctgcacttttttaccccctgaatctaaaataaaagttgaagggaaaaaaagaaagctgttccacattgattgcagtgagtataatgggcaaaaattactgcccccaacccgcagcccccaaatcctaacagaaatctgttacatacacacagacaagcatggattgagcattagctcagtagacaggtcggttgaatcccactttccagctgcatgatcataaacttattgtttaacctctgtaagcctgtttattcttctgtaaaatatagatcttgtgagaattaaatgagattatgcattcacttagcatagtgcctggcatacagtacagctcaatacatgttagttattattatcatcttttgtcctttcttccacaactttgtataagaagtgttggaggaactgaagaaaatgtgatgtgttcaacatggtacagaaaaggtacaccatgggcagatggtcaaggtgagtcatagactaacccagttcacaggagtagctactcatgttagaggagtcctaaagaaataaaagccttccttccctcccactctccctccatcaatggtccacagagttgagagaacacaactgtggtaggcatctaccattttgttcacttagaatggcaactcattcctggtaaaatataaattctaaccatgtgttatgaatggagactgctatcttacttatgaatgggctgatgaatccacccagaggtggatgcctgacccagctgaaccaatcatgttatgtatacaccactctagtcacaaattgcccccctggatgggaacctggctcagactgaagcaatcaaagacttacctcaatatttttaaatctgggatcagaaaggatcctcagtacttctttggtggctacactgtgagatgaatcccaaccaaaaaatgtttacaatcatgcctcctgctttgtggtggaatctggtctgaggaatgaaactaagacacgaatgaaaggaaaagtcttaaaggattaagttccctggcaccctggatgcctgaagtccagatacacttctgctcttgccaaggttattggagtcagtgcatttctcttcttgcctaagcacatttgagttacatttctgtcacttgtaacatcaatgagacgttaaagagttaattcactaggaaatttttaggaacaccttgctggcttacaagaagcatcaattctacgaattactttctcaggaatttctctaaatatcctgaagagggcactgtttccattcataacttctgtccaaacccacccccattcttttgtttttttttaatttttctttttatttcttttttttctttttttttttatgaaagggagggactgagtaaattgcaggatgtgattctaattggttggaacatcttttgaaatcgtgtttctgtagagaaagaaaaactaccatatttggatagccctggccaactttcaaggctcctaaatctgagttttcagtgaactggacagaaaaaaaaaatgaagaagctactagcaatgattctgtggcttcaactagaccgtgagctgggggttcattgaaaagggagccatgggaggaaaggaattgtccatacaatgtttgggggtagagacaaggttcaatgcgactcatttgggttccctcgggaggaacaggattattggggtaaccagtgaatgcctccttctgaaatgttctctttggacagggttaagtggagagctgaaagtggaacaaaaccctctgttcctgagcatgcaggagggaaaaaactataccatctactgcaattattcaaccacttcagacagactgtattggtacaggcaggatcctgggaaaagtctggaatctctgtttgtgttgctatcaaatggagcagtgaagcaggagggacgattaatggcctcacttgataccaaagcccgtctcagcaccctccacatcacagctgccgtgcatgacctctctgccacctacttctgtgccgtggacacacagtgctcccctgacgccaccagtctgtacccaaacctgcagctggtgggcccactcctcctgcaggaactatgactgtgaggcttcgttcactgtctgtacatttctttctgcaaggaaaattctgagatgggtgaaaaaagatgctgttttaccttcttaactgtggaatattttttaaaaggaaaatgtgttcaggctgagggaagattcctaaccatgtatttcctgagaatatgaggtctcattctttactgcctcacagtcagaatttgttagtcttccattatggaataattttacatgtagtgcaactgtcacaaataattcctatgaaatatggaatcattatttgttttatatgtgaatgtaacatatggcatttaccaatgaaagaaagaataaatgctttataaaagaatggtctatgtgaggttccttacctagtgtttcctgctaaaatattgactacagtagtcagataatatccgtgtgatctaagtacctgtttatctcaatgtgtggagagtctctgggaaatgtatcctttggctggatttactccaaaactatctgagggtccttgccaaccagaagaatattatattttttcttgtattatttgccagtttcctcttctcctccctccattttttttttgtaattgttttgctacatggtagaatttatattaaactttatttgcccattgcagactagataaaatgaatttcactttcaggaaaattgtcttataagaaatccccaatttgaatgttatacaaaaataattgaaaataagttttcctgtcccactaatgagataatcagtaccttcagatatcaattgcatcatattttcatcccagacttctaggaaaataataaacttgattcagtcaggcttttaagtgacaatatttcagaaattaccattacaatgtaaaagctgaccttaacatttcaacatttgtaccttcctaagcaacagcacctttaaaaacatttaaaaactaaaaacacttatttctctaaattgcccctagagtctttacaagcgaatcagcttctgcagcaatttgttggcagattatgaaaagtcagccacagcagtgtacagaccaaaagctcctgctaccactcagagcctccagcagggactataataacttccgtatttagataaaataaaatttgacatgaaaaaccgactagttccatcatcctttgagtcaagcagaggtttcactctgacagagtaggctgaaaaaactttgaccttgtatttataaatactcacaacgtatcttaaatttcaagtttcttgatctgttaccaaagcaagtttccttgtcaatgactgattgtcgggaaatttttattttgcattgatgatcttatttgttgtgttgttacataatcagaaaacaggatgttacatcagattttctataacctttctggagcatttaacagcatgtcttcacacactcatttccatgctgaaaacattttcaccaggaaactattcatgacggggaaaaaaatattgttcaatccaatctaattaactgaaggaacaatattgacttaagtccccaaatctcttccttcttagagagaactcttggattctgaagatgaacttttatatcttcttcagatcaagaatataaacaaaccctaaaacaaatgaatagaactgaggatttcattaatttgatctttagaacataaaaaactaagttctttccacttctccttcccaattttcctgactccttcccaacttatgagtatatagattttttgctttcttttcctagaatcacttactgtcactgaaaatatatcattaaaccttattctcgaagaaacaatacagacattcaaaattgaaccagttgactttaagggtgtgatggtgtagtaagaaaatactatcgaaggtgacaatctccaatacattagagcatgctaagccaaatatgttttcccccagtaggacctttaggaatgtctcaggtgactccaagcttccggcacttgctgtccatgaccagagcttctactaacaagaagttccataaaatacttggatccatcctaatcagatacaccagttgccaagtccacttaccacagagattaggaaaggagacatttttctcagttgtgctattcatgtcccagaaatggcatttaagacaaataattctttgagtatttcttccaccctgtctcatctgttttggtgtgaactagtctcttttttcattgcttttaacacagctggttattttttcttttaatagtgtgtctgcttcaaggtttatctagaagttgtttcttaatatcaaaaaagttaacattttttatttttactgaattatgatcagagaatgcacctgtatgagctgtactttttaaaaactttcattaagatttacttgaaggccaagtacataatcataataattttattggaaagctatgaatttatatatatgtgtgtatctatgtattcaacttttttgatcatatcattaaatcttcctatgtccttgtttccattttctaaaatctgtcacattctgaaaaagactatcgaaatctttcacttattttgtcaagttcttgcaaattgcttttgctttatctagctgcaatgttttcggtgtatatggtttatgacttacgtctcttcagagagtctttttagcattaataatgtccaagaaattatccatctcttctagattttcatcattatataaagtccttcatcctgtgtggtgcagcctgatattttttcctcaatatccattctactgtcttccccttttttactctgccccagaataaaatctgtgttgcccagacctccttacagctaagtattggcatgaactaaattctggtcaatgaaatctaagtgtaaatatgaggtgcaccttctaggaatttatctaagactcagtatgcatgttcttccatctctcccagctacctggcctcccatcccctttcctgctggatttgttgatcctcggagactcaagtacatccttcacttagtctatgcactatataccttcttcaatgaggtccctgtgtcagggacatggttctcagtttccagctactttccatgagctccctcaagcaagcaaatatttttagaaggtatttttagaagacaacattttaaaagaccatagtgtcctttctactctactgtgtctgcaatatgttgcagtagaacatttcacaaagctagatcttctcagagctccagatgggaaccaggcaaaaagctctctttgcagcggacagtcaacctatcttgtggtttccattgtccgcattcctagctcagggttttagataggatttgtgattttttaaaactgccctgaaacctcaggctctgctcttgacatataaattatcaaaaagaaaaattaccaagtacctgtctcttgcaactcaaaaaaatgccttatttcaggatattttttcctcctaagactttttaagtccattttgaatacaaaatcaataatttgaccctttgatctcactggatcctttcacaatctccctttactggagcaataagattcatcctcaaaatttgtggcaagagatttacaggggaaaaaatgaattttaaagaaggaaattatcatatttgaaactgttagtccactccatttagactcagagattctaataacacaacagtgtgaacaccagatttggttatcagaaagaattcctgagtattcaaactcttctactgtgagctctatgcccttaggcaagtttcataatgtatttaagcctcacttttctcatcaaaaaaatatggaaaaaataataaccactttctaaagtttttatgacatttaaaatgagatggtgtatatgtaaagtaaacagcacacacaccagatcttctagaacagtgtttactagagaaaattcataaagacaagagaaagagcaggtgtgtggtttccccagaggcagcactcaccctacattctgaaacagcacacagcaacctagcatggccaatgtgagaccctaagaaagagaacccagtcttgagccatggaactttaaggctgcactggggaagcaccaggccttactgtagcatgggggctgggctccaaattatgtgattatagcaaaatcaaggaaatctgcaacctccagtcctgatctgccacctcagctctcttacaaaatttattgcctcaagtgctaggctggggctctattagaaccagttccttctctggaaggccaccctgcagggaatccattacccttacctctcagtatgtgaaattcactagcacagagcctggcatgtagttggtataaatgtggaatgaatgtgtgcagccatggaggacaatgtcttcagtccctttgtaatgcagaaagtgtgcttgttctcagatcaaataattaacttattgaacaagtgtttataggtatctactaggtaccaggctgtcttctagacacttgaactatcttcttttaaaaaatgcacgaagatatcagattttatagaaaatacattctagtaagcattaaccataagtaaattactatatggtttatgacttcagagagtctctttagcgttaatatattttgcattacaatatatgagaagataagtcggacgggcgcggtagttcacgcctgtcatcccagcactttgggaggccaaggcgggtggatcacaaggtcaggagatcgagaccatcatggctaacacggtgaaaccctgtctctactaaaaatatatatatatatatataaaattagccgggcgcggtggtgggcgcctatagtcccagctactcgggaggctaaggcaggagaatggtgtgaacccgggaggcggaggttgcagtgagccaagatcgtgccaccacactccagcttgggtgacagagagagactccgtctcaaaaaaaaaaaaaagaagataagtctatggagacaagaatcagagcaagttaggggatagggaattctggagggggccacagaagggtggttcccttgtaattttaggtaaagtgtcagagtagcctcactggaaggataacatttgagcaaaattgaagaagatgagagagtgaatcttgcatatacttggagcaagttttccaagtagaggagagtccggtcctaaattaggaaatgcctacatgttctagaactaggtggaatgagaagccataggaaggctttgagaaaggagtgataaaatctgacttccatgtaaaagtcttactctggctgccgtgctgagaatagactgcagatcatcaagatgaaagtggggaaaattgttgtattaacattaaaaccaaagatatctggtgttactctgagctcagaggcttcttccaccagaaaagctcattcaagagcagctgttgttactgctcctgctgatggaagaggggctaaagacatatttgatagcctttctgtagatctcttgactgcagatgacctgtgagtttaggggaaaatgacaggaaggagtcttaatttcagacacaagaaggtctgttgtgaaggcatcttccagaaggcaatatttgtgctttcttctgttgtgtaagactccctactcaaatttaggcagtttaaggaccttagaaaattgtgctgtggtgataaaggtaatggaagtcagagcagagggataataaaaatccatatgcctctttgaaagcctgtgtaataaagatatctgctgcctcaccgatctgaacagggttgaataagcaacaaatggacaagaatgctcagtccctgagctaccaggagacataggcctttagtgggactgcctatataatttacgggacccagtacaaaatgaaaatgcataacttcctaagaatttgaagactgcaacagcagagcattaaagcatgagttctatgagactgtacaggtttcatacccaggaagctggccctgatcactactagtttggaatgccatcattattcagatatcgatgttacaggcaggagcatgggaaagaccttaaattaatttgataacaattcaacctagtggcatacagaatgagggcaaactaactgagtagtttggtgtagaaaagaagcacctcacctcctcaaattacctctgagatggtgagatgccctgtccttttgacatctacatatttaatataaactcttcacctaggaccacagcagtggcagagatccagatgctcggagagatctatttgcacaagaaaaaatatgcataaagaggttaatagtcaaaccaaataaggggctgagttgtaccgtgagcttttttacaacttcaaagtgggaaacatttattgcccttactcatggtgctgtctaaagaataactttttactctcctgaacatttcagggttctactcttattagagaaattgtactattatcattttatttttaaaatatttttagaaatgggggtctcactgtgttggtcaaactcttgagctccagccatcctcctgcctcagcctccaggggagctgggactccaggtacgcaccaccccacccggccactgagtcactattaaaaatcatttagcatagccaggcctggtgtggtggctcacgcctgtaatcccagcactttgggaggctgaggtgggtggatcacctgaggtcaggagttcaagaccagcctgaccaatatggtgaaaccccgtctctacttaaaaaaaaaaaaattagcctggcatggtggcacccgcctgaaatcccagctactcaggaggctagggcaggagaatcacttgaacccaggaggcggaggttgcagtgagccaagatcacaccactgcactctagcctgggtgacagagtgagactccatctcagaaaaaaaaaaaaaaatcatttagcatacccagtctggggctttctactgagagcctttgttgacttctcttctaaggcaaagagcagggatataaagaagtaacacttcgaaagatggatgttctagttacatttctaggctctgaaatcaaatacttaatccacatattgactgattaatttatccaacaaatattaaacttgaccgacccttatagtgtctggagcctagtaaataactattgaataagctgtgaacagacagccaagtcctgcggactcagagaataatgagacaaatcagatattgaatcctggcttcaccacttttgagcagtgtgacctggagcaatttgtttatcctctctgatcatcaatttcctcatctataaaatgggaacaataatattaacacctattttcacaatcatgtggattaatgtatgcagagcctctggttcatcactaagcactcagtaaatattagctatcatcatcatcattactaatttctattgatttaactagacacagaaagggcagcatgtgtcttacaagccagcgcttccctcttctaaccactaattcaaaaaggattgtaagtaatgtttagaggtcactccctagcccaaaataggatgccactgtgttgtgctttgttttctttcttcctccagtgctgaagcacttgtgtgttttggttaatctaagatttaaaagattcctacatgtagtcatgcaaagtacttgtatatacctctaaggacctagcaggtctagtgatcctggagtctcatatccgaaagaggaaccagtactaaaagacaaacttcccaaaatctaaagaagggaagtgcaatcaatggtatgagttagaagcctcaatcctgggagagacagcctgtgcaagccaggagaaatcatgggttctccagtccccagcactggagcagccatgatcagtgcctccacttcaatgcttgtgaggctgttactctctggtgagcaaaatgacagtttaaaattttggctcttttataatttctcttatttctcattttgttacttagattcaatgtcgtttccattcattctaataagaactttggctttccaggaagaaccactagagactcagtgaattagacacagggctatgtgaccctttcttcaggggcacacctgacgttgaactgtacctacagaatgggtaggtaccttcctcttgtggtatgtccaatatcccaaagagatatcaaaatgccttgtctctgaggcatcatgataaatgaaaaggaagatttcaggcccattaagttaagattaaaacctctttccacttgcagaaaacctctatccaagcactaggcacaattgtgtacttttatgttcctaatgacacagtaggggagactaacagaggagttgagtgcaaattgcaaggggtatgagaggggctgggtgtgagcagtttctttttcctatccagacagggccctggagtgcaggagtgtatgtgggaagttggacaggcttcgtgatttgctatcccaggttaagtagcacatgagactgcatcttagaaatggggaaaggaaagatttgtcaaaacattgcccatatctgtcctctaattatagctcactgatcaaaactacaagcctagtaatgtaacgaaggaaagttctttgacatcagttatttaaaatatgtacaatgtgattttctgaaatacctttgtatttaaaatgtaatttaaattacccttaaaattaaaataaatcaataactgttttagtccattttgtgctgctataatagaatacctgagaatgtgtaatttatgaagaacagagacttatttcttacagttttggaagatgggaaatccaaggtccaggggcctgcatctggggagggccttcttgctgcaccatactatggccaaaggcagagggcaaaagagtgcatgcaagagggagaaacggataaagtgccaaactcattcttttatcaggaacccactcccaagatatctaacccactcccatgataatgtcattaatctattcatgaggacagagccctcatgaccttttaaaggtcccacctctcaacactgttgcattggggattaaatttccaacatatgaactttggggggcacattcaaaccataacaataataaaacattaatattcctggggaaaatgagcaattcacaaaaagtagtacaaatggccactttataaagaggtatataaattctttagtcatcaaagaaacatttaaaaaagtgattcattttttccagctatcaaaatagtgaaggttactgacacacacacacacacacacacacacacacacacacacacatatcatggaatttttttctgttactccaagaacctcctatggcaccatgagtcttgagccatttactatgtaaccagaaataaagactgcaaatactcaactgtaagccaagccacttctagtctaagtgcaagattgcatatttgaagagaaatatttccatttctgagaaaccagataaaattatgccaggactgaggaagaaaaaaagagaaaaaaaaaaagagcagtcaggaaaaaaaaagcagtcaaaaaaaaaaaaaagaacaaagttaagtagactttgcaaaatgacttcaattgaattacaccatcattatcaaataaatcttcaagtccagataaaaaaggaataagtgtaccctcagcactacccttttctagaagagagaaccaaaaatatcttgattcactaccgttttcagtgaagaatattgcaaatgtgaaagatggtaataacaggagcaatcaaacaatagacagtcctgagaggttactgctcttttactgtaaagctaaactttgaaatgtgaatgctaagtctttgttaacacaattataataataattacattttagatagaatttcatatttattcttgcattgttgaagttaattctattttttgatattcagattcagctttagcttcccccagatattgactttaacatctcaccattcggcatttggtcacaatgtgtgttcagtggaccatgttttaaggaaataattagacgtatgaagagggtttatgtaagcatagatttatcacaatgttgtttgtaaaaactgaaaatattgaaacaactgtctaaaatactgacatgttgtgatgtctaagttctagtggaaattattctcccttagaataagtgttgtagcgataacagacttaggagtgtggtgagtcccctttgcacaaaaagaccacctcacacccaacatgactcttaagaatgaggacagtagtgaggacacactgcagaacactgagaggcagatgacgtcttataacctgttcattaacttgccacttgggggtgctattcaccagtgaaatcataatttatgcatgaattctgagtacaactgtgaatcctcacttcaacagtgatgccctctgctaggccagagacactaacaatgaactcctctctggactttctaattctgatcttaatgtttggtaagtacattttattaaaattttttgtattatttcaaaataataaatacttctccaaaagatacaacaactctggccaaacccataaaatcagtacttttttccccctacaggaggaaccagcagcaattcagtcaagcagacgggccaaataaccgtctcggagggagcatctgtgactatgaactgcacatacacatccacggggtaccctacccttttctggtatgtggaataccccagcaaacctctgcagcttcttcagagagagacaatggaaaacagcaaaaacttcggaggcggaaatattaaagacaaaaactcccccattgtgaaatattcagtccaggtatcagactcagccgtgtactactgtcttctgggagacactgtgttaaaagcacagtgggagctatacaaaaacctcaaaggctcagaggaagtatgtagtgaggctggaaaacccaggttgtagagccctgttctctctttcacagacagtcctgttaagacattattagaagataaggaaaatcaaaatcagatataactgcctctaattccagggggcacaggggtttctttgacagaaaatggggtcagggaagagggtctcagatgatatccctgctctcaattaggtcagttctctcttgtccttcaggctttcttgcatgatgtgtaggaattagaatatgatgacttggatgtcagtcctggctctactacttattagctatgcaaatttggccaagttaattgatgtctcagagctttagtttttttcacttgtgaagtagaaataaaaataatcacacaaatttagcatggagataaagtggaaaaaaggtaggttaggaaggggcagattagtactcaaagcatttctggaacttgcaagtcccaccgtagcagttctgctctctcacagcaatctctctgcctagtgctgaccatcctaacagggcttggcatgcccactgctttgtcacaccacaccacaccccacgccacgcccagccccaggccattatgatcaacatatcatcttttctctcacaggctcctactgacactacacacaaaaattaactcaaagtggatcatagacctaaatgtaaaaactaaaattgtaaaacccttagaagaaaacatagcagtaaattttcatgatcttgggttaagcactgatttcttagatgtgacaccaaaagcacaagcaataaaatagaacattgataagttggacttcaacaaaattaaacttgtttatgcttcaaaggacaccatcaagaaaatgaaatgataacccacagaatgggagaaaacatttgcaaatcatatgtactatgtacccgatgataagggacttgtatttagaatatataaggaacttttacaactcaataataaaaagaaatataactcaagcagtgagcaaaatatttaaatagacatttcttcaacaaagatacaagaatgtctaatatgcatatgaaaagttactcatgattagtcatgagacaaatgcaaatcaaaatcacaagatatcacttcgcaaaagtaaaaggctatgactttttaaaaaggacaataatgagtcttatcaaggatgtgagaaattagaaccctcatacattgttggtggggatgtaaaatgatgctatcactttggcaaacagtttggcagcacctcaaaatgtgaaacatagaattagcatatgacccagcaattccagcccgatgtatctacccacaatgcatatgtccccacaaaaacctgtgcatgaatgttcataacagcattgtttatggtagtcaaaagtgtaagtaatccaaatggacaaaccagatgtggtatctctatacaatggaatattattcagccataaaaaggaataaagtactgacacctactacaacatgaagaatcttgaaaacattatgctaagtggaaaaatccagacacaaaatggccatattgtgtatttcatttatatgaaataccaagaataggcaaatccaaagtcagaaagcagtgtggctgccagaagctgaaagaagtggggagtggggagggactacttaatagatgtgtggggtttcttttggggaaaatattctgaactagatagtggtgatggttgcgcaacattgtgaatacactaaaagctaccatattatatactctaaagtgattaaaagtatgaattttatgttgtgtgacttttacctcaataaaaaagaagacaaccaaaaaatctaaatgtgattcttaatgggacaagaagctctaaaaaaattaaattcttactattccattgcaaacaattccaataagtatgtgaaatatggagccatctgataaaacctatagcagtacgggaaggtatactaactcagcttttaactaaaaattatacaaatgttgactgacacaaaggcaaaggagaatagcaaagatggcatgagcctttaaggaaatcgttaaaaagtggaaaccttttaatgaatgcagttaaggcttaaagaaaatgtgaagtggaacataaaaagcgttttagaacagtttggagaaatgaagagggtggggtggggaggaaggttaatttacatatcgaggaaaacagaataattttggtagagaataaagaagaggtagggcacttcgacccctggtttcatcctctattcttcatcaaatacaataattttgggccgggcgcagtggctcatccctgtaatcctagcactttgagaggctgaggcaggcatatcacccgaggtcaggagttcgagaccagcctggccaacatggcaaaaaccccatctctactaaaaatacacaaattagctgggggtggcagtgggcacctgtaatcccagctactctggaggctgaggcaggagaattgcttgaacctgggaggcggaggttgcagtgagccaagatcatgccattgtactccagcctgggcaacaagagcaaaactccatctcaaaaaaaaaaaaaaaagaaaagaataattttcaaactggaaatgaagaaatgaaaaattatgacagataaaaagatactaagagagaacttagatgctttgaaaatgatcaattcttctgggtcttttaaactaatccccaacatacaaaaagaatttgcaggcatggttggcaaggcattgggagaattttttgaaaacctatcaggaatgaaggaaatccccaactcaggaacacagaaatagtggatcgatacccagcaaaattctagagcagattattaacagataatgtgtgggctcttagaaaataatgcagtgatcagtaccaagccagaatgagctcactaaagacatttttaaaacaagtcctaaattcaaaggacttccgtggacttcaaacgtgtcaaatatttgcaagatatttaataatttgtttttcactatatcaatgggaaaaatatatatatattatcatttgttgagtgttgtgtttatcacaggccctgttgtactacatatgtaataagaactaacatttatttatcaagggcttaatgtgcatgaagtgttgttctaaatgctttgcatacattaattcacttaatcttcactacaacctcatgaagtaggtgcaatccttattatagataaggaaactatctttaatacagaagaattaactaacttgcccaagaacacagagttagtaagggaagacctggcatacaaatacagtttgacaagcccaaagcctgcattcttaaattctatactttgttacctcccaatgttatctgtaatccccaccacaaaactataattttggtattgttacacccattttatgaataaggagactgaggattggagtattgaatagaaaaatccagtagaatctagtaagtagtaagactaaggctcaaacctaagttcatttggatctagactgtatcctctattcactttgtcattctgcgtaatgctagacttggtgaattctcagctgaaagaacggccatgtataaatatacaatttagaaaaatgtccctattgttacacctcatgattttatccttcactttgacctgttcacattgatcttatgtaaattcacacaaggtatgcccattaaatgtacaaatagcaaattttgagatcggtatatgatgatcatgtcctaatgatctccagctaatatgtttatttacagcataaattaaagattgaaaatcatctgaacaaactggaaagatagactgaaactgtcaaaatagaatttaatggagataactatatatttatacagtagttttataaaaatgagttgtaatgtctggaagaagggatcctgaatttttagtatttgttgtgtaacgcgctcatagtaattaaggaaaagattttctgaaaggatattagaaattctcataaaatcaatttgtgcaaaatacagctaggactcacagaaagaagaaaatcaccaattggctatgctttccgaatctacttttctctggatgtatgatctgttctcctcctgggaaaccagattccactgtaagcctgtcatattctactccacaataacttcagtttgaacatacccagctctgtttgctaagagatgagtctggtttgaatagcacagggctttaaagctctagttacactgtctaactgcggtttctgtacctctagttcaaattaatgagcgtagtatcttcccagatccaataagctattgccagaaaaaggaggttatttggtacaagcatgacctctatgtcatctctttagaaaggaatcccaaaagtggaaaaggactacatgctcaaaataattcaccaatgtgataaaacaactgaaactatcatagataacaataaaacaagtggaaaccagatgagtacagtaatactctgacagggcaacaatatttgaatcacatttgaagagacgtgaacaaactgtagcaagtctaaaaataagaaagataaaactaataaagtagtctgaaataataccatgtgcagaaagaaacaaggatgtcacataaagaaaccagagatatttataaggacacctttacaaaaaagaacagatctggccttgagttttcaaaagatataatgtgaaatgcagctactctacttgatctatcatagctggctgaagtctaacaatcaacaagcttctgttctcccacactaccctcacctttcttctaggactcctagtaggaggatgctaagtttggttctctatctgtattgtgggtgagaggggctgtttgtttgttttagagacagggtcttgctctgttgcccaggctagagtggagtaacatgatcatatctcactgtatcctcaaactcctgggctcaagtatttgacctgcataataaatgtctacgcctcatgccactaggtggcaatgtgggtgttatactgaaaagatcacagatggttcactttgcaagtaaaactgtaaatgttcttaagtgtgcatttctgctgcttctgatgggctgaaaatcccctttgatttctaaagtaaatgtagagacgttttaaaaataaaggactcctttgtccaagatatattccgaaatcctccaacagagacctgtgtgagcttctgctgcagtaataatggtgaagatccggcaatttttgttggctattttgtggcttcagctaagctgtaagttggggagtttcaggacatgagatatttttcaaaattctggggaggggagagaagggactccaagtggctaatctggaggccctcctgaaaatgtgtaaagaaatgtgtataaatattgcaataattgtaatattctgtatctgatgatgtctttgagaacaggtgtaagtgccgccaaaaatgaagtggagcagagtcctcagaacctgactgcccaggaaggagaatttatcacaatcaactgcagttactcggtaggaataagtgccttacactggctgcaacagcatccaggaggaggcattgtttccttgtttatgctgagctcagggaagaagaagcatggaagattaattgccacaataaacatacaggaaaagcacagctccctgcacatcacagcctcccatcccagagactctgccgtctacatctgtgctgtcagacacagtgctccccaggcacctggagcccgtacctaaactctaaagttgaggcatcatttcttactcctgtctttcagacttgtctgtctctatccttggtcagatgatgtaaaatgtttaagtttttaaaatataatattctccccttctagaccatctctcttctctacaacatcatcaccaattatgttaaccagacagtatgtgatttttatcttgaaagtaaaatatacagggtataaaaatcccgattctgctacttattaactggatgatcttgacaaagttacttaacttctctgtgcttcagttttccctcagctataaaaaggaaacagtgttagccatggtacgtaaccccaattgtggggattacatgaggtaatatacacaaagggcttgacacatttcctggcacgtagtgttacataaggggtatcaattattagtattagttttagatgtaccatgagtttgctaatattcactatggattaataccacagatcattggagaagtatgtggaatataaataataagcaccttataataattttagtttttagattctttcctaatgatgtccagcacttggcctttttaatagtgttaagaaaaacagggagtagctgtagaaaacgtaatagaaggatgactctatggtttggtttgtggtgtggaaatgaaagactggtaagagatgtttctgaggaagctcagctgcttctttggaaaaaaggacaggttctaagttttcatgtggagatctctaatggaaacttgcatttgtggaaattcatgaagcaaaatatcaaacccagtgtatctaaatcaacggttctgtatatcccccaaggattctttacattactattcccaatcccagtggaattcttatatcaaaacaagttttatgattataattgttcttattactcaacaacatcaatcacatatattaaattacagctacattcttttttaaaatcaaaggctttttaaatcaaaatactacctgcacatatctaaaaagccaatagtattataaaggtctgttccttccttagcccatcaagaaaacagaaataccatgctctacccccaccttccaattcaaatccattctagcaatttctaattaatatgtatatactcttgatttatcattattaagcattatctattgacttccttctatggcagcatgcaaatactctcactttctcaacatagttatatatatatcataagctggggttaaatagacagtcagtgcatatatgattatgaccacatgaatattgccactgtccaaccaaaatgacaactatgagtatatatcctttctggtacaacgtattttcttagttaataattacatttttttcatttattctatgtcaatgtgctattttttctaagttcttcaacacagtcttaaaaatatttattaataatttctctcaaatgcttcaagcaccttaatttcttttttttcccctcaagattccctttcctttgacctccattgtttctctgtgtgaactgattgctctataagcataaatgtgattctagacattttagtaccactctcccaagttggcattcttgcattttggatctcatatcttcatttcccaaagacaaatactagagagaaaaaagggagaggaagaagaaggagaaagagaaaggagaaagaaacactcttgggctcacttttgaacaatgagagaaacaaatgaataaatggttcctgccctcccccatgccctgcaggaggaaaagtctgcggcatattccaaaagactcttcagaaggtcatgccaggatcaggcaccagtcatgcacatggtggccagctccattatgcaccattgcattggctctctccactacccaaatttgctctcttgatccctcactcctgctccatgagatcagttcccaaaaatgccctgcatgcaaacctttatctcagtctcagcttttaagggaatgtaagctaagacatgccttttctccctgtgaatagagaggacacggagccagaagacacaaccctgcccgtctgctctcagtagtgcctcatccccttcaaaagccctagatactggcctatgcagctgtcccagggactactgaccacagcttctctatcggtgatacatgttcctggcttcctgtttttaagaagtactggacacacctgtgtcactttcctgaaagaaagagtgctgagattggagggtccaagtggaattacaggctgagacagagagaagatacaggagatgctggccctaacagagagggaaaacaaaacaaaacaaaacaagaaactattcttatgaaataaaataaaaagtctccccatctgagagtccactggtctttcctgaaagccaagtcatttttccatcgaataaatgcacgagtaaaaatcaagaaaacataaacatggataaaagtttcctcatagagttgacaagattattcacagagacagacttcttggtctcaattttctcagcatcctcagagtttactgtgtggacactatgatcacagaaagaatctcaggtgccaaagctagcaattcaagttgtttctggtggaagtcagtgccctcctgtagtcaaatgaatgaactagtagaaaccactgctttggtcagtttcccctctcctgtatctggccttcagcacctcagtagatgcttagagagcacttaccaggcaccagctcccagttgatatgggaaccattagaactctctccagagaaactcagtctggcccagtgtttctgacttcaagcctcatttccatgaatcaggtagctggtgaaattgatagactgcaaactccatgagggcaggaaccatgccttggtcattacagtgtccccagtacttagcatagtgcctggagccaggagcgttctcaatgatctacgctgctttgtcatctgctctgataatgagagtttcttgatgtcaagggctgtgttttgttcatttttgtatccacaaagggattagcactgtatttaacaatagtagaaactgaagaaaaaaaaattgtgtggaattacatttcctctttttcatcagaagtgacttagtcttgctgactttctttctatgcccttgtgtgttgcctctttgtttgcttacttgatttttttgcctcactgagaatgtaaggtctgtgaggacatcggcttgtgtttcttcatccctgatatttcttttgcaaccagcccaattctgatatctagaaggaggtcaagaagtggtttttggaagaataagtgaatgtaatagttatttcggacttgtgttaaaaggcctctttgcacgatttagtagaaaaagcactggagtcttagtcccggttttgcagctaacagggtaatgtaattctgaagtcacatccccactttcggcttcagtttataacctggaaaattaggataataatacacactctacctttatcaaaaaaaatcacgatctaatctgaattagatcatgaaaatgaataccttttaaaaagtgaaaaattttaaacaaacaaaaattaatattattaaggaattttatatatatatatggaattaaatggacaagaaatattatcctaatatactccaagacaatagttttcactcccatacttatccgcactgctatacaattcagtcagtgccaaatcactacccacacacctggttgtccttattactgtggctttgcaaccttcccatcactcagcttatctaaatattctcctgtatctaaaaccagtttttagaatctccaaagagcttgttttccaacatcccccagaaacatgcatttctcaccttactgagccaaactattccccagtgttcatcctctctccaagaaaagtttttattcatttggtcattggtcaacatttttctcagctgtctatttctcaaaatgtatgttctattctactattttcttaaactaatgctattttcaccactggccaaactttgtatttgaatttgaatcttatttgaattttacattctactttggccatatctttgtaatcagaaataccagtgatagtactcaccattcggtgtacaaagtatataaaatagacatgctccatatctattaagtgatgaaaattttctaggtgattttattataaaattaaacatttttagaagaaaatgcttctttagtagattgagaagaaaatattccaggcaatgaccaacccagtgatgtcatcttactgtatatataaatattcatacttgattactactataatcaactacaatgtaaacatttcttttgaagtgctaatcggtatgaaatattctcttcaacctcagattaaatattcaccctcagtccccctcatttcccctgaaatacaatgacattaaattgcctgatctttgcattttctgatttattttatttttatttattttcctttgaggtgggctgggtacttgcaatggctaatagtgcagagctgcaattctaggcactatcagcaggtgttttaactaacacattatgtggattatttaaaaacttaatttaaggtatatgataatatagtactgctttgtatttttacaaactcatatttttttttttttttttttttgagacggagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatctgcccgcctcggcctcccaaagtgctgggattacaggcgtgagccaccgcgcccggcctacaagctcatattttaaagctccattcttagctcagagctgagccattaaagttcaataatgtaagacagcaagaatgctaaagcttgatgctaaacctattcagtaatatggaacagcatttgagatcaggaaggaggtggtcccacaactgggaattaaaatcaaaatggatttgagcagataaagctgcatgtccaaaggaagttggtgggaaaacttgaatctgccaggaattttctgctagatttactgcagatcctgccagattcaagccaagcatagaaaaataagcagaaaacctccttcatcactgcctgtgaaagaatgttgagtccaagagacgagtagagaaagacctctatagattaggacccattaatatacactgacttggcaaaccgagacctagaggcaagtacagaccacaggaccaccagatgatttactaccttggatcctactggtggcaaaagctgctcccagggtccacttccctgtacagaaaactacctcatagaaactgaaaattatatggcaatatacatcaaagagtccttgcactctgaccctgtaatttcacttctagaaatttcttctttcttaaaaaaacaatcaagtatgtacaaagattcattttttaaatgttggtgagagctttatttaaatgagtggagaaggaaaagaaaccccaatgtctcacaaaggagttgatttaaaaactgggggcacattggatataaccaataaaaatcattttatctaaacttctgcttccagccacgccgaaataacagggaccagatttaccattccacttgaaacaacagcaactgagaaggctgcagacaaatgacataaatcaacaatttccaaaacacggtatactaagcaataaatgaccatgatcctgagagatgggaaacaaatgaggcgagccctaacattgcaatagcttattgccttgagagagtttctaggccacagcacaaagaggggaaactgaggcagaacctggtaggctccctgaattgaggcaacagatctgagacagagaagactaaggcagctgaagttcataagacagaatacacgagaggagagaggggcacagagaggacctagagatctgccgagggtgccctcaagtattcagcagaatgctcatctgcgcacgcatgtggaatctacccgagggtgggtggcggcagcagggaataaccattcaaaaagattaaaggaaagaggacctcttcaagtatgtctagaatttagaaaagagtttattgcttagccatatatttcttaattctttaattaatatttcatacatttcattttctctggctctagtcacttatcactgtggtccattttcaaacaaagaatcatttcacatattgaggaaacaatatatgaatagcctgtctggcttagataaagagtaaaggcaagagaccaggtgcggtggctcacgtctgtaattctggtcctttaggaggcagaggtgggcagattacctgaggtcagaagtttgagaccagcttgaccaacatgatgaaaccctgtctctactaaaactacaaagaagtagttgggtgtggtggcacatgcctgtaattgcagctattccagaggctgaggcaggagaatcacttgatcatgggaggcggaagttgcagtgagtggagatcacgtcactgcactccagcctgagcaacagagcaagacttcatctcaaaaaaaaaagtaaagacaagaataagtatcacccatatggcatgaccaaagtttttggtaaacctagggttttttttctgttgtcagtaataaaattgcccttaaaaactagtttttatttctcattcctgaactcatttacatataatgtcgaagtatgataaattcaaactatgctgacacctgtacgaatgtggcttagtatgatataaagtctttatactttcaccaacttcaaacctcagtttctactgttataaagttcatttcactctctcttgtgaccatttaaatactttcacatatttcatcgcatttttcatcttctagggctgaggactcctaattcttaagaatatttctgttatccctataattactgtcgtgtctctccaggcattcttttttagtgaacagttgtcattaatcacttccagaaaggattcaaacaccatctctacatttatccttccaagtgctgtgactattgccttgcgaactacattttccaggctcccttgcagctaaggtgcagatctgtattcagccaagtatttgattgggagatgagccatatgaggaacaggttaggcaggggcatcccttttcttggtttaggggcagtggaggccatgtggtctgggttaggcagcaacagcatcttcttgattgggccaggagcagtaacttcctgtttgggcccatttggctgcatattctgttgctggcagcactggaggcagctggcatagggataggactgcagccttcttatgaggctgatggatgggtggttctgggcatcactcctggaagtcgagcctagaatctttttctccagtctgcccaatgattctatgagccttctgcctccccaaatcctgatctgcttacactaggtaaagcgatttcctttctttcttgtcccttagcacacagatatctcacagtgtttagtctgagacccaccacagctttcattccagcatcctttaagctgagtatcagacctggttcactttttcactgcagtacacttggctcattccaatgaggatgacttcatgtttatagtgatttctggttcctttgcttggaaatcctaaaagatagaaaagagtctccagttgctgcagacgcaggcatgagatataccgaaaactctccaaaattgtctcttggaatgtttcttcattacttcactaggtttctttctaaccttcagagctagtaaggaccttggattaaaagggccattgaatttctagtttagttaagaaatattttcctcatttcatgggaggggggaagcagtgcagactaaactcagagcccacatcatgttgttcttaccagttcaaatcaaatcacggtttccagtcacttggctaatatttatccttctttaaatcttgatgaaatgtctcttcctcaatgaacacttctctgcccctcaacctaaatttgttcccctcgtgttactgttttaaagaaccctgtaatttctatgtatttctgtgtgattatttgtataatatctgtccttcctattaacctctaagttccactaaatgctctgtgttcagaatagtgcctggcacaaaggagtatgacaaatagtgatgagtgaatgaatctgagccatcagacatgtatcttactttgtgctgggctgtccctcaagtgtagatgttcctagtgacaatcccattaattcaaacactgactggagaggattgaaaacatatgaagcagtgcttttggaactgaggctgtagtccaatatgactggagataaaaaatgaagactttaaaaacagaattcacataaaagcaggtatcaacatggaaaactgcagaggatgcctgtatacacagtgggcacagcagcagcattagaccaatcacctccaaacttgaggttccaggctgaggtgacagatcagagtgaaccaggcaccgtagaacaatgggaacacttagattcctgacactggaatttgctgattcttctactaacgtgtagcaagaaatttagccttacccaaagtcaggtctggtctttgtcccagttcctgggagataacctctgaaggctcggaatttcctgaattgttggcatgtctttataattgatggtggggtccttggaccacacttaatagtttctgctatcaagatgactcattgtgaggctggccacaatcaatggtctcaggatgggggctggccatgccagaaagaccaaccatataacatagggtggagggtttgtgtcacaacctagagagtgagttcaaccacacaggctatcagtcatctgatataatgaagccccaataaaaactctggacaccaaagctcagctgagttttccagactggcaatattccatgggtattgtcacgccttgatgctgggagggtaactcatccctgaggacagtggaagtttcacgtttggaaccctaccagactctgccctatgcatctcatcccttggctgcttttaatgtatcctttctctgtaataaacgaatcacaagtatactaggtttcaatgagttctatgagtctttctagtgaattatggaacctgatttaggaaatacccaaccttgccattggtgccagtagtgagagtggtcttgcatgaacttatctcccctttgtagttgagtcctagcgacttacagttgggggcagaagtcttatgtagatttagtctggaggtctatgaccttaaccttgcagtttggctaactctgggtagctacattttgtattgagcaactctatatgaataaaagaagttttgttcatataatgccttaacagtgaatcaagtatatcaagaaagttttttaaaagttaaaagtaggcaagtctactggtaataaagtaggcaagtcacaaggtaattaaatgcctacgtttcaatgattacacatgttgcttagaacatacacatatatgagatcatcacgttaaaatatttctaacacacaggctggcaacacctaacaataataataattagtaattgtctagttcttactactaactggtttctgttctgagtgttctacatatattaactaatttaattctcataagaactctggttattagccaggtttgtagaagctgaggcacaaggaggttaaatacttcgccctatggcacactcccaaaatttgaatccaaaccatccaactccatagctcatgctcttaaccaatgccccatacagcttctcagaaggcaatcacttgaaatttctctctgatcttatagaaaggtgttagtagactggttatcttaacgtccaatcccaatcatctttgtagcaaagtaatatttttatatgaacatgtcagaggcatttgaaccagagcaactccatcttgaataggggctgggtaaaatgaggctgaggcctactgggctgcattcccaggaggctaatgcattcttggtcacaggatgagataggaggttgacacaagatacaggtaataaagaccttgctgataaaacaggttgcagtaaagaagcctgctaaaatccaccaaaaccaagatggcgacaagagtgacctctggtcatccttattgctacactcccaccagtgccacgacagtttacaaataccatggcaatgtcaggaagttaccctatctaaaaaggggaggcatgaataatctaccccttgtttagcatataatcaagaaataaccataaaaatgggcaatcagcagccctcaaggatgctctgtctatggagtagccatacttttattcctctagtttcttaataaactttctttcactttactatatggactcaccctgaattctttcttgcgtgagatccaagaaccctctcttagggtctggattgggacccctttccagcaacaaagagatgtgtattttatttctgaaaatacttttttgctttgttatcattctcatgttaggccagcagctcaggaagtcctggtctccttcctatattggaaaagggagttcacaatgaacacaaaagaagaaaggataaatttgaaaattcctctggagacaatagaatggaaaaaaggggttttgagtttgggttacgacttttgagtttaaaaataaatctatgcctcaaaaagttctcttagaatatatctgaatacaaaaaccaattatgcaaccctagatttaatgcaaatttcttagtttctgggaatttctggggtgatggagacaaaagcaagaaagtaagacatcagtgaagatctctgcccatctccacataccctcccagcagtggggtgggaggaggcaatttttagcccccaaataggatgttaggaatctgaaactagaggagattgacaactaattcctctcagaaagactgagtgacagtatcctgcaaatttccaccagggcagagacagctgtgcagtagtgccaataggcccagagagcccaagacagccccattctgccagactggaattagagtagttgaatttttgcatgcacacaaaaagcatagaaattaacagagagagacttagtggacctggatgggtgtcaatattataataaaaaggatgcagagcatatagattaacagccagagacctacagggactcagacatcaggacattagaaacaataatgtcccagactggaccctaagcactgcaccccaacagatgccagtatgggccaggtgtccccaaccaatgccagaccaccagttaaggcctctacattccaccccaaggatggcgaggaggaaatctgaactgatggaagacatcctgaattgacttagaaagtcatgattttactgagaaaaccctgtatttacttaaagcaagctttctgacaccacgcaaagtggttaccagagttagaaattaggctgttatagaaaataaagctatcctggattgaacatctgagtaaattacaaaacatttacccgctacatctctattcaccagatagcgaactcaagcattcctctgcccctacataaatgacaaatgacattcacgtgtattacatatcccctcaggcctaactagggctgtgtgctgtttccaagaccaaaatgtcacaactgtaaaccactcacctggatacttgctataagaaatagcttggattagtatggaacttggtgtaaccctcaaatatgggagtttgtcactagaggtaccagaggaccacattctctgttaggggacctcgatgacagtatattacaatgaaggcagtgactggcaaacagcagcttcaaataggcatgcaaacaaacattgagaaacagtaagcacataagataactcatttagacacttttatatgcagcatgtataggatttaaaataacattcccaagttaaactgaaaccattactatgtaaatgccacagccaagtcaaatgaaatagtaaataccagccttgcaaattggtctccctcaagggcactcaaaagagttagactgcgtgctgctgccttaggaaatgtcctcctctctatcaatcatttctgctttgacatcaaacccattgaccagcatatgttttggaatttctgaacaactgactttcaaggattcacattcattctgcactttcttagaaacctcacaggagccactgttgccaataaaataaaataaaaaaacacaaacattataaatctaaccccaaaatgggattgcttcaaaagagaatggacaccccactccctacattgcttgtacacatctgtgttgattctcttggtgaactggcccatgcaagcaggagctcatcaatcagcagttgtcaccaagtgcaagtcagaattgctcaacagaaaaattgagtctttttttattccctattgtcacctactaaaatgtaagttgcttgttgatctcatcacactgagctatgtttcagggaagtgttgaaaaggcccagcctgcgcatattcttgaaattttgaaataatggctcagtgaacagatgtatactttctcccaatggctctttgtggaaatgaattttttatgagcccaaagtatctttgattcatccctgattaaaagtcaggttaaaactaaataccatatactttttgaaagacattttaggaagttattgacacaaggacttttgagactgaaaatcatgggttaacaataaacctttgtttggtgaaacaaaagaacagtacaggacagaggtgaaaagcacaggctccagggccagagtccctgggctcagattcttcacatttcagctctgtaaccttgaacaaactactccagttaatcataacttcagtcttttttaaaaaatgggatattaaataatgggtattaaataatagggttgccatagaggaaaatataaggtaatatttatatgcacataaaacagtgcctggcacagagccagtgttcaattagtactagctattttttggatacatgtagataaaagaagcatttaatgaatagttacatgcccattaacataaaatgtaagccacttccatattctgtagcttatggtgacaaagttttctgctcacgtattaactaaaaggagcgaagagcttccctataatattgaaaattttatcctaatggttccaaaggactgttttctaggaatgtttgctacagaaacctcactggttagatgtttgttggagcacactgtgattattcattgtcactgcaaactgtgtttaccacgggaggctgttctgactcaccactttgtgactcaccgattagtaaacagctaaatgtcgcattgctgatttaggtgtaatttactgcgtcaatataaaaggactctgcagattctactaaaatcaagaacatagctaaaggcattcttcatcgtaaaaacgaattttagaaaacaagatgactctaacagagttactttaaaatacaatgcaatatgtctattttaaatgacaacaatatctcctgtctgacagcattcaacttactttcagatttattcggtgttttctcaacttcacgagaaattgaaaatccataaaggagggaaatatgtcttgtttcattttcaatagttatatcaagaatacttttcaaaagtatttcatatttaccatgttttcagcaagtaactcttaacaatactctgagagtatgatcgtgatgataggtaaaaatcaggatcactcccttttcatctttacctgtgtagagcaatgtaatgtgcccttttcccaaaccctctgactccatgagggatgagacacagagggtgtggctgagggctcctaggaccgggactccttggctgatgtcctgtggcctgcagtccagggcttgcaggtgatcaaacaggaaaggagaaatgagggaggcacagtgctacgagcaggcctgtgttttcactgggaatggtggttagcagatgctcagatgtgtctcttctccctcacactcacctttggcttggctcttaactcctgcccacccctccctaaactctctgtggaggtccggaactaagcgagtcacagacacccagcaagcagtctccagagaggcctctgtgcatgaagacttccccagaaggatgcccactcttcctacctggcctgggaactcaaaatggacacaaaaactgaagactgtgagagagggtcagcttacaggccagaaactgacaataagattgatgttcaaatagctgaattattgattcttatcctgagatccactcctcattttcagtcttgcgataaaccttagtgaggggtgttttgtcttgtgttctatctattggtggatggattccaacttttctgaatatggggacgtaatttttaaagccaaaaattttgcagatagtaatggatttttaacatccattgattaacaaagtactatgaaaacagtaacacttttaaataaatttgctttcagtttttttaactaaacataatacatgcatgtatatatttaaacttatcacactgcctggcacagtgaaagcactcaaaaaatattagctataattactcctattgctgttgtttactcaatcataggtaatgcctggtatacatgtggattcttagagtccttatagaacacagcagcacataaactatactaggctctaaatcttctctcccaagaacttcatctgatgcatatttcaccagcaacagcagcatttagcactgtcttgctgtagaaaaattcttgataaattaattgaattaaatttatgtcacataaaatgtcatgaagagatggaagtgtcttggtcctgtatcttagcattttcaaacctctccattgtttttttttaatgtatagatttcacctgtgtaaaaattaaaaataagaaaactgatcctaatgctcttcatgaaaggcaagaaaagccttcttggaaagcaatagttatgggagagttctgccagaatttgttctcagaatgacatgagaacaattttattctaggaaatagaggtgctgaggactcagcttctgacctaccctagatcataaacatcactgcactaacagccaattaagaataatctaagctcttgtccttttataacagacctggttatgtcctaaaaaataagagcatttataaataaagaagaaagtttaacagttcaatagatcaacgtgactttccagctcctctctgaacaggtgacatctatttccccatcccttgaatctcagttggccttgtaacttatgtggatcaatagaatgtggccgaagtgacagctgtgcaagttctgagccctcacctcaagagcctttgcactctgtcacctgctctctcagacctcggcttttttccacgtgaataaaccgaggctaaccttctggaagaaaagagaccatatgaaacagaaccacatcagcctgaggccctggacatgtgcgaaaactgaagatcagcaaagctgacctgaaactgagtcacagttgacctcagatgcatgagaatctaaccaaggctgaaaacatttggttgaatcccacctcaatttctgacccagagatagcaactaatgtacaatatcatgattgttatgcagtcattagaaagaatatattagataaatgtgtattggcctggaaaaggtatcatctaagtatgcttaatgattatccatcttaaaaaaaaaaatacagaaatagggttgtagaacaagggtcctggtcatactgagcttacacttctgttgatgaaataaaacacatatgagatgatgaggaaataattcaaccaacaagaaaatactttacaaccaagagacttattaaataaaatgggtgcaccttttataataccaataagtataatagtaccctaacacagtagacacatttctgttgtctgtagttatctttcagaaagccgtcttgggagaacctttaaatgacctcagagagcgaaggtttatgtaaataaagaattaagtcagtgtgggtagaggttcagcaccagggtgcaggaagttatgtgaagattgtggtatggggctcatgtctagaaacagagagtggccccatgtcagcctatgagggaggagccaggccccacctcaagggtctccttcaggaagatctctgtgggaaaggagcaggggttccaggttttcagcaaagcctgtgcttgggcaatccatcaacacggttagtccagggcccacatataacctctgacccttctcacatttattttctctgtctggtacttcctctaaggagcatcctgccactcaccagcccctaccaaacacacacacacacacacacacacacacacacactcatactctatttgctcataatctcataatcatccatcaggttttaactgagatagtacttcttctgggaactttctctggtgagagatcctcttatgtggctcttgacctaccaaaccagaagcagttgtgcaattagtgatcattattctcttatttattatagtatctccagcacttagcacaatatctgcagacagtgggcacgcactgaaaaaaaaatactttttgaatcaatgaattaaatagctagttttcattcaccctaagaaaataccaaacattggtcttaagaatgtcacaggcctgaaggtataaaggaggaagcaaggaaacaaaatcaacagacagagccttggcaaaatctgctgttcaccagtcctcccagcaaatccatttcccattctggggaagcaatgccaaacagctccaggaactctgtacatggtctgtcaagtatccaagacagaagggagacttttcaagagtggaagcccagcctgcttgctccagtctggactgtgctggtctgtattttcctagtcagggatggccccaacctgggactgtgtctcctctcaggctctgaggccttgggaatggaggaatgtcgtatctgccagtggtttaggtctgtattgtgaagaattaactttcccaaacagagatctggccttcaccctcagctgctgggtggtgattcctaggctcctggattgtcctgccagataggagaatctttgtttgcctgagggctttggccaccagtcagtctaataacgtgatatatgatggggctttggaacatgccatgtgaattctgacctctggaggaaccagagatcattagctagaacctccaggaggggctggaggttaaaggtcagccacgtgggcagcgtgtgataaagctccaggaaaaactctggacaccaaaggctcagttgagctcctatcttctgcaacactccatgagttctgtcacacaacatggctgggaggaggtaacacacccaggtctccctgggagaggacaaccagaagcttcatgtttagaaccctcccagatttcacccaatgcttctctccctttggttggttctgatttgtacccttttgctctaataaactatgatcatgatcactttcctgagttttgtgtgttgtttcatggaactatcaagcctgagggagcatgggaactcccagatttgtagccagctagccaggagtaaaggcagcctggggacccggaacttgtggctgatgtttgcattgagggcagtcctgtggaggactgtgcccttaacctgtgaagcatggccacctcccggcagttgctgtgagaactcattgcagggccactcagggaagtgtgggaaattgaaccaatgatgcctgacaccacggcttcctgactatcctctaggaagtctatcaggagatgcccctgttcacttccctgtaggttccagcgaggctcagagggtcatcagttctaccaacaatatctgcgcagaagagagtagctgtgattttattttagtctgaaagaacactgtttgttgttgattaacacctaaatattacaaacagtctctcagtgtgagaagatttatcttattctcctgtgtaattagaatgattattcaacaaatggatgttatctagcgaacttccagaaagaagccaaatttatcaacctcaccaactcacacatacagccagggatctatattcttgtgctctcagagaaggcatggagcttggactgacagcaaaagaccaacaaaacacccagaagccagtcaaaaatggcccaggctgcaggatccttgaaagacctgaaaacacacgaggaaaaggctgggaaatagtaatggtgagtggacctctgcggtctggagaggaaactactggttattttaggaaaaacattcccataatggggctcagggaaaaaagaaagtaatggtatccaggccttattctcagaagcattctcctccctgaatccagtatctgaggtaactgagcagcagataaaaatagcattttctcgaaacaaagcaaaacattaaaaaaaaaatagcctactgtctaagcttgtctcccagtggaactcaggaaccaagccagcttctccagctgtgcaccttggctgtgtgtctcagatggaacatttctgacttcattccctcctcctcccacgtcactcggtaaggagggtgggccaggacaagcagctcagacagctgttcctacagctggccttaccacaatcccccaggcctcacatacatgcacctctgggccctgcctgcctgcactaaaccatccggcccagtgcaacagaccattctttcaagctgtctctctcctactcacaaccatcccaggagtcctcttaaaactattttttcggagaacacattgtgctttgccacactgttccatttatctcttggtggccattccatttgcctcagcaactctctatcccattttttagtactacccctgaacgagaaggcaatcttgttcatcttgccaactctaaatccttatcgcaatcgtgttgctttagattgcattcatgtgtgaataggtgtggataggtgtttggcactgtgttagatgccaaagatacagtgctaaggaaaaaacatacctgacaacagattttattatattccaacgggaaagataggataaacagatacataaacaatgtatatgcagattaggatgagtatcatgaaagcaataaataagaggctgacgggttcaatttaagtggggtggccagaaaatgcttttccttcttctgagagaagtgagcgaggggcacagagaagtccgaattgttacactaatgaatatttctgagcttgaaaacacaaaacaaggggagatgaggttccactcaacagaggtatatacacatcaattacatgacccagaaaacctgattcagacacaccttgctgacactactccatagggaaggtcattttcacttgtccacatctaccacacctccattttcactctccctgagataaaaggatgtgcatttacactgtgtctgcctagcgaaattgtaccccccgctgaataaagcacagttagttgagattcacgaacaccaagcctctctttataatgactttagagagctgtgctaactgaccagcactctggatacttatgagcagatgtctggtagcaatggaacctctcatgaccacccaggctctaaatgactgttcagctcagcagctcattatcaccttcctggagttagagctccaacataagaataaatatctccatctagtattatcactttttaaatcaaaatctatattcagcttgagagtataaatatcaaaatttcagggcattttttctaacttttcttgggagattttagtaaaattccagggcagattgctgaaagtacaatctgggaacagaaactaatatagtgtcacatcatatgaagttaacctctttttcttatgcaattctatcaaacttcaaggaaattctttggaaatctgagccccactacatttaaaacaaaataggtctatcatgaaatgcctaataaaggttgatcttacagtgtgatcgaggtgctatgcagatctgagacaggtggattattccagaatgagaaagaaacacaggatgaataagtcgcactaatggcaatagcaacttctgggaaacaccaatttctggcagctgttgctttcgtcaacactttctcagcaaaattgccacagccatttctgagagcttagaagcactgctaggaatctctaataggagtctgtttaatgggaattcctattgactacagccgcttttgcatataggagataatgttgagctaagggaatctttcaatgattcattcaaaacatgtttatccaccatgtgataaacattatagtcagtgccatagtataaacttgaataatgcataatccctgcccccagggaactcacatccttctcgacatgcctagcacaaacacacagaattataataaaagttgtcaagaagaagatatgggtggcgcattatgcaagcagagaaaaagggactgccttattcatttagaagctactggccctctctagagattgttggtcttccagtacatctaaatattcttcaatcgtaaaatgccatgaagctagaagtacaaaatgctgtattatcagttaagccccctatttttttctttttttttttttttttgagacagagtctcattctgtcacccaggctggagtgcagtggcacgatctcacctcactgcaacctccacctcccaggttcaagcagttctcctgtcttagcctcccgagtagctaggtttacaggtgcatgccaccatacccagctaatttttgtatgattagtagagactgggtttcaccatgttggccaggctggtcttgaggtcttgaactcctgacctcaggtgatccgcccaccttggcctcccaaagtgctgggattatgggattacaggtgtgagccaccatgcccagccagttaagcctcttaaagaatgtcttgaattataacaaacacatgatgcctatcttcccccatatctttatactgacaaaattaggttcaaaatcaaggcatggtcaccagaaatcaggtcagagggatcaagaaaacatggacagtgaagtgatttcacttccatacaggtgataaatatttcctaaaatacaggtagatgtgtggcacaaaacctccagactctgagcatcaaagtccctcctaataccagaaaggaaggacccagcatttgtcatctcagtctcagacaaatacatactcagagggcctcaggaacatatgtaaactaaaaaaaaaaacatgagaaattgagcaggagcctgagtttgggcttccttgggtgggtactgtattaatttcccataacaaaatactatggaatagtacacagatgtttctttcctcacatttttggaggcaggaagtccatgattgaggtgtcagcaggcttggattctcctgaggcttctctccttggcttgtgaatggtcatcttctctctctctctcttcacttggtcttttctctgtgcacaggcatcctttgtatttctccctcttcttataaggacataaatcctactggattaggaccttacccttatgacctcatttaacctcagttaccactttaaaagccatatcttcaaatacagtcacattgggggctagggcttcagcatatgaattttaggaggacagaattcaatccataatagatggggacagggcaattctcttcctaggtaagccttcccttagggccatttacggggagataaacaaaccccaatttctactgagcaaaagctcagagaccctgaagtaactgcagttagtaaatgagaaagacagaatattttcaatatcttcaagtctaatacctagaagtgatagaggtttattcacattttctcccagtcattttcttattctgtgtttatacagcatttctgttaatgacaccattattttcagaaatcaaaatgaaatcttaatgttatcattgactctccccccttccttgccttcacttcaatcataattttccatgtctatgtaagtattcttttggctatttacatattcatcagaaacctatttcagctcttattaattttcatgaagatcactaatggaagccacctattgttcatgcttctagttcaggtgctcctaatatgggaactgtatagtttcagttgatctataacctttcaccccccaggttttgtggttgtttttatatacactttcacacatataagtggtaatgtgttcattgctattatcagttgttcaaagtgggtccctcacccacgaacaggttaaaagccagagctctcctctctcctactacacttgctccttgtaaaaaaaatttaatctttgtgattaacacaattgtttatattcttccccctactcaaatactcccagttacaaacattttaacttgtagtttaaaatcgttcctggtcagcaatcccttctgtagactcttccaaaaattaccatggttcttataatcaatctcacacccaaaagaggagattttagaaaggcatagacaccagaaggcagggatatatctgtctaccacagtccaccgtctggccaccaatgactcacattaccctcacttgcaaaaatacattcacatacatccccaaaggtctcaagaatcttatctcacagagcttcagctcaaagtcaaacttttatgctttaaatcatggctaagttcaaacacagctcctgggcataatatatgaagtacagctcctggggtataacttctctccttctgtcaacctgtaaaactaaagaggcaagtgatctgcccccagtacacccgtcatacaattttgaaacaggcataactggtaggcatgggataacagctatagacatattggttcaaagggaggaggggaaaaagataacaaagagtcgttggtccatagcagttctaaaatctagctgggcaaatgttgggagttcaatgattaggttttagagcctaagattaatctcggctattggggaaaccagcccccagtatttcaacgtaggttcttttctattttccctaagtgtcggccagtctgagaaataaagagaaagagaacaaaaaaaagaaattttacagctgggtctccggggttgacatcacatgtcggcaggttccatgatgccccctgagcctcaaaaccagcacgtttttattatggatttcaaaaggaggggggggtgtatgaatagggtgtgtgtcacagagatcacatatgatcacatgcttcaagggcaataaaatagcacaaggcaaatgggcaggacaaggtcacaaggccagggcaaaattagaattacagatgaggttccctgtcccactgtgcacgtattgtcattgataaacatcttaacaggaaacggggttcaagagcagagaacaggtctgactagaatttcatcaggctggaatttcccaatcctaacaagcctaggggcgctgcaggagaccagggcttatttcataccttatctacaactgcataagacagacactcccagagcagccattttagaggcctccccctgggagtgcattcttttcccagggctgttccttgctgagaaaaagaattcagtgatatttctcttatttgcttttgcaagaagagaaatatgactctgttccacctggccccgcaggcagtcagactttatggttatcttccttgtttcctgaaaatcactgttatcctgttccttttctaggtgcccagatttcatatttttcaaacacacatgctctacaaacaagctgggcagataacacaatcattacaggatcctgaggcgacatacatcctcagtttatgaagatgatgggattaagagattaaagtaaagacaggcataggaaattgtaagagtattgattggggaagtgaaaaatgtccttgaaattgtcaccatttatgttcttctgccatggcttcagccggtccctccgtctggggtccctgacttcccacaacacttggctctaccctcttgcctcttagcaccaccctctatcatccttcttctttaatgtttgcagttgagtagttttatcagcctgcttcctgccagtagaaatgttggggtctgacagcctcctttcatttcattttgtagtctttctatccctttcagtccaagccagtagtgtttctgctgaaataattttctcaagatctttgtgcatctaccatagatttcaatgatgttctgaccatcagaaaaaaacacacccacagatcttttccagacagcatatatttttggctcctgctcggatggctgaggggctacagtttgattgagtggatctaaaaggcacattcttaatctccttaaggagtcctttgtgccattgaatattctcaccttttagtctttgaggtttttttaacttttattttgagttcaggagtacatgtgtaggtttgttataaaggtaaacttgtgtcatggggtttgttgttcagattttttcatcacccaggtattaagcctgggtgtacacattagttatttttcacgatcctctccctcctctcaccctccaccctcaagtaggctccagtgtctgttgttcccctctatgtccatgtgttctgtgttatcatttcgctcccacatataagtgagaaaatgctgtatttggttttctctttctgtgttaatttgctaaggataatgacctccagcttcatcaatgtccctgcaaagggcatgatctcattattttttatggctgtatagtatttcatggtttatatctatcacattttctttatccaatctgccattcctggccatttaggttgattccatgtctttgctattgtgaatagtgctgcaatgaacatatgcatacatgtgtctttatgatagaacgattattattcctttgggtatatacccagtaatgggattgctaagtcaaatggtagttctgtttttaggtctttgaggaacagccatgctgttgctcctaatggttgaactaacttacactcccaccaacagtgtaagtgttcctttttctccacaacctcaccagcacattattttttgactttttaacaatagccattctgactggtgtgagatggtagctcattgtggtttttatttgcatttctctaataatcaggaatgttgagctttttttcatatgcttggtggctgtatgtgtgtcttcttttgaaaagtgtctgttcgtgtcctttgcccactttttaatggatttttttcttgtaaatttgtttaagttccttatagatgctgcatattagacctttgtcagatgcatagtttgcaaatattttctcccattctgtaagttgtctttttagtctgctgatagtttcttttgctgtgcagaagttctttagtttaattagatcccatttgtcaaattttgcttttgttgcaattgcttttgatgtctttgccataaaatctttgcctattcctatgtacagagtggtattgcctaggttgtcttccagggttttttttataattttgggtctttaatccagcttgagttgattttttttgtacatgatgtaaggaaggagtccagtttcaatcatctgtatatggctagccagttatcccagcaccatttattgaatagagagtcttccccattgcttgtttttgccagctttgttgaagatcaggtagttgtagccttatttctgggctctctattctgtttcattggtctatgtgtctgtttctgtaccagtaccacgctgtttttgttagtgtagccctgcagtatactttgaagtcaggtagcatgatgcctccagctttgttctttttgcttaggattgccttggctatttgggctctttttttttccatatcagttttaaaatagtttttctctaattctgtgaagagtgtcattggtagtttgataggaatagcattgaatctataaattgctttgggccgtatggccattttaacaatattgattcttcctgtccctgagcacgggatatttttccatttgtctgtgtcatctctcgtttctttgagcagtgttttgcagttctgcttggagagatctttcacctccctggttagttgcattcctaggtattttattctttttgtggccattgtgaatgggattgggttcctgatttggctctcagcttgactgttattgctgtatagaaatggcagtgatttttttatgttgattttgtatcctgagattttgctgaagttgtttatcagttgaaggagctttggggccaagtctatgggtttttctagatatagaatcatgtcgtctgcaaagaaggataatttgactttctctcttcctatttggatgcaatttaatactttctcttgcttgattgctctagcaatctctttggcctgaaagccccctgaggacaaatacatcagtcaactgtttctttgtttgttgtttgttgtttcttttaaattattctcattacttagcacagatcatgtacaccatgagtgtttaataatatcaatagaatatttgggagcaggaggttattttgcttagttttatgctttcactgttgttatagaacagctgggctagaagacattattaaacataaatacaactggtaaaatatcccagcagaagaaatgctttaaaaatatctccaatcactgcaggagtgcagagaggcaacaactcctccagcttttgcacatcgaataattggtttagttcactccttccacatcacttggagcagcggggagggtggggaaagcttaatgaccaggaaagcctttcataaagtcatcatcaatgttctttataacctaatgtcacttcaatagtccatggttttcaaataaatgtcctacctgcccacagactgaaattttagccaaataaatccataaatttaaacatattgacaatcaaaatggtaaaaagaacttttatttttaacttgtaaaaatggttttagaggtcatcaggaagaataaatgagatacatagccaaaaaaaatttaaatacttgccacatcagatattagaatgtgttctaaagctacgctaattaaaataatgaggtaccaatacaggaataggtaggtagagcaatagaagcattaagtataaacttataagagactcaagttataagttacaagaatttgacatatgttaaagttagcatctcaagccagaacagcatgtcaataaattgttgaaagacacctggataaccatcaggaaaacaattaaattagatccctacctcaacaactaaattccaaaggaaaaagactcataacatttttaattaaaaagcactggaagaatatatagatgaccttttacataactttgaaaaaggagaattatgttataaaaatcacaacaaaggcagaaattataaaagataaaattgacagatttgactaaatacatctttaaacatgtgaatattaaaacgctgtaaaaaattaaaagacaaataaagtagaaattatctaaaatatatatcaaagcaaaaactgcatttctatatgccactggtatataaaaatacttccaaatcagtaaatacaaattgcacacaaatagaaaatgatagaagaagctaacaggcatttcacaaaagaagattataaatgactgataaacacattaaaatgtctattactacataattaaagtaattctgaaaccaataaagtacttttttctgcataattctagggatttatgcttaggaaagaatttgtaataaagatccacacacaaggatatctatcagaatgtagtatataacaccacaaatcataaatgagtcaggtatggtggctcatgcctgtaatcctagaactttgggaggccgaggtgggaggaccacttgcagacaggagcgcaagacctgcctgggcaacataatgagatgctgtctcaaaaattttttaaaaagaaacaatttaggggggcggttccaagatggccaaataggaacagctccagtctgcagctcccagcatgagcgatgcagaagacaggtgatttctgcatttccaactgaggtatcgggttcatctcactggggcttgtaggacactgggtgcaggacagtgggtgcagcctatcgagcatgagccaaagaagggcgaggcattgcctcacccaggaagtgcaaggggtcagggaattcccgttcctagccaagggaagatgtgacagatggcacctggaaaattgggtcactcccaccctaatactgcacttctccaatggtctcagcaaatggcaccccaggagattacatcccgcacctggctcagagggtcccacgcccacggagccttgctcattgctagcacagcagtctgagatcaaactgcaaggctgcagtgaggctgggggaggggtgcctgccattgctgaggcttgagtaggtaaacaaagcagccaggaagcttgatctgggtggagcccaccccagctcaaggaggcctgcctgcctctgtagactccaccttggggggcagggcatagcaaaacaaaaggcagcagaaacctctgcagacttaaatgtccctgtctgacagctttgaagaggatagtggttctcccagcaaggagtttcagatccgagaatggacagactgcctcctcaagtgggtccctgacccccgagtagcctaactgggaggcatccaccagtaggggcagactgacacctcacatggccgggtacccctctgagatgaagcttccagaggaacaagcagcagcaacatttgctgttcagcaatattcactgttctgcagcctccgctgcagatacccaggaaaacagagtatggaatggacctccagcaaagtccaacagacctgcagctgaggatcctcacgttagaaggaaaactaacaaacagaaaggacgtccacaccaaaaccccatctgtacatcaccatcatcaaagaccaaaggtagataaaaccacaaagatggggaaaaaacagagtagaaaagctgaaaattctaaaaatcggagggcctctccccctccaaaggaatgcagctccttgccagcaacagagcaaagctggatggagaatgactttgacgagttgagagaagaaggtttcagatgatcaaacttctctgagctaaaggaggaagtgtgaacccattgtaaagaagctaaaaaccttgaaaaaagattagatgaatggctaactagaataaccagtgtagagaagtccttaaatgacctgatggaactgaaaaccatagcacgagaactacgtgacaaatgcactagcttcagtagccaatttgatcaagtggaagaaagggtatcagtgattgaagatcatgaagtgaagcaagaagagaagtttagagaaaaaagagtaaaaagaaatgaacaaagcctccaagaaatatgggactatgtgaaaagacaaaatctacgtctgattggtgtacgtgaaagtgacagggagaatggaaccaagttggaaaacactctgcaggatactatccaggagaacttccccaacctagcaaggcaggccaacattcaaattcaggaaatacagagaatgccacagagatactcctcaagaagagcaactccaagacacataattgtcagattcaccaaattgaaatgaaggaaaaaatattaagggcagccagagagaaacgtcaggttacccacaaagggaagcccatcagactaacagcagatctctcagcagcaactctacaagccagaagagagtgggggccaatattcaacattcttaaagaaaggaattttcaacccagaatttcatatccagacaaaccaagcttcacaagtgaaggagaaataaaatcctttacagacaagcaaatgctgagagattttgtcaccactagtcctgccctacaagagctcctgaaggaagcactaaacatggaaaggaacaaccagtaccagccactacaaaaacatgccaaatcgtaaagaccatagatgctaggaagaaactgcatcaactaatgagcaaaataaccagctaagaacataatgacaggatcaaattcacacaatattaaccttaaatgtaaatggactaaatgctcaaattaaaagacacagactgtattcaggagacccatgtcacgtgcagagacacacataggctcaaaataaaggaatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcagccagattcataaagcaagtccttagagacctacaaagagacttggattcccacccaataataatgggagactttaacaccccactgtcaacattagactgatcaatgagacagaaagttaacaaggatatccaggaattgaactcagctctgcaccaagtggacctaatagacatctacagaactctccaccccaaatcaacagaatatacattcttctcagcaacacattgcacttattccaaaattgaccacatagttggaagtaaagcactcctcagcaaatgtaaaagaacagaaattatagcaaactgtctcttagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacatgccagaatctttgggacacacttaaagcagtgtaaagcagtgtgtagagggaaatttatagcaataaatgtccacaagaaaaagcagaaagatctaaaattgacaccctaacatcacaattaaaagaactagaaaagcaagagcaaacacattcaaaagctagcagaaggcaagaaataactaagatcagagcaaaactgaaggagatagagacacaaaaaacccttcaaaaaatcaatgaatccaggagctggttttttgaaaagatcaacaaaattgatagactgctagcaagactaataaagaaaaaaagagagaagaatcaaatagatgcaataaaaaatgataaagaggataccaccaccaatcccacagaaatacaaactaccgtcagagaatactataaacacctctacgcaaataaactagaaaatctagaagaaattgataaattccttgacacatacaccctcccaagactaaaccaggaagaagttgaatccctgaatagaccaataacaggctctgaaattgaggcaataattaatagcctaccaaccaaaaaaagtccaggaccagatggattcacagccaaattctaccagaggcacaaggaggaactggtaccattccttctgaaactattccaataaatagaaaaagaaggaatcctccctaactcattttatgaggccagcgtcatcctgataccaaagcctgacagagacacaacaaaaaaagagaattttagaccaatatccctgatgaacatcgatgcaaaaatcctcaataaaatactggcaaaccgaatccagcagcacatcaaaagcttatccaccatgatcaagtgggcttcatccctgggatgcaaggctggttcaacatacacaaatcaataaatgtaatccagcatataaacagaaccaaagacaaaaaccacatgatttttgtctcaatagatgcagaaaaggcccttgacaaaattcaacagcgcttcatgctaaaaactctcagtaaattaggtattgatgggacatatctcaaaataataagagctatttatgacaaacccacagccagtatcatactgaatgggcaaaaactggaagcattccctttgaaaactggcacaagacagggatgccctctctcaccactcctattcaacacagtgttggaagttctggccagggcaatcaggcaggagaaagaaataaagcatattcaattagaacaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaaacattcttatacaccaataacagacaaacagagagccaaatcatgagtggactcccattcacaattgcttcaaagagaataaaatacctaggaatccaacttacaagggatgtgaaggacctctgcaaggacaactacaaaccactgctcaatgaaataaaagaggacacaaacaaatggaagaacattccgtgctcatggataggaagaatcaatattgtgaaaatggccatactgcccaaggtaatttatagatataatgccattcacatcaagctaccaatgactttcttcacagaattggaaaaaactactttaaagttcatatggaaccaaaaaagagcccacattgccaagacaatcctaagccaaaagaacaaagctggaggcatcacgctacctgacttgaaactatactacaaggctacagtaaccaaaacagcatggtactggtactaaaacagagatatagaccaataacagaacagagccctcagaaataataccacatatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatattagatctaaaaccataaaaaccctagaagaaaacctaggcaataccattcagggcataggcatgggcaaggacttcatgtctaaaatgccaaaagcaatggcaacaaaaggcaaaattgacaaatgggatctaattaaactaaagagcttctgcacagcaaaagaaactaccatcagagtgaacaggcaacctacagaatgggagaaaatttttgcaatctactcatctgacaaggtctaatatccagaatctacaatgaactcaaacaaatttacaagaaaaaagaacaaacaaccccatcaaaaagtgggcaaaggatatgaacagacatttctcaaaagaagacatttatgcagccaatagacacatgaaagaatgctcatcatcactggccatctgagaaatgcaaatcaaaaccacaatgagataccatctcacaccaattagaatggcgatcattaaaaagtcaggaaaaaacaggtgctggagaggatgtgcactgttggcgggactgtaaactgattcaaccattggggaagacagtgtggcgattcctcaaggatctagaactagaaataccatttgactcagtcatcccattactgggtatatacccaaagcattataaatcatgatgctataaagacacatgcacatgtatgtttattgtggcactattcacaatagcaaaggtttggaaccaacccaaatgtccatcaatgatagactggattaagaaaatgtggcacatatacaccatggaatactatgcagccataaaaaacgatgagttcgtgtgctttttagggacatggatgaagctggaaaccatcattctcagcaaactatcgcagggacaaaaaaccaaagaccgcatgtcctcactcataggtgggaattgaacaatgagaacacttggacacaggaaggggaaggggaacatcacacactgtggcctgttgtggggtggggggaggggagagggatagcattaggagatatacctaatgtaaatgatgagttaatgggtgcagcacaccaacatggcacatgtattcatatgtaacaaacctgcacattgtgcacatgtaccctagaacttaaagtataaaaaaaaatgaaggaaggaaaacaaaaaacgcaaataaataaataaataaataaacagtttaggccgggcacagttgctcacacctgtaatcccagcactctgggaggccgaggtggccagatctcctgaggtcaagagttggagaccagcctggacaacatggcgaaacgctgtctctactaaaaaatacaaaaattagctgggcatggtgtcatgtgcctgtaatcccagctattcaggaggctgaggctggagaatcacttgaactctggaggtagaggttgcagtgagctgagatcatgccactgcactccagcttgggtgacagagcaggaatccatctcaaaaaattaaaatagaaaaataaaaataaaattaaaattaaaaataaacagtttaaacgtccaacactagtgacttggtaaaataaaatttagtacatccacataatgtaatgctattgtcaaatgaagttatttatggatatttgttgacatgaagaaatgtttgtgaatcataatatattagtcagttgaaagaaagttgctgacattataaactgatgtttggctaaattataagtacagatgcacgcatatagtactatgggtatataacagggttagtatatatatatggatatatgtgtatgtgtgtgtgtatatatatatatagtgtgtgtgtatatgtatatatatagtgtatatatatacacacatatatgtgtgtatatatagtgtatatatatagtgtatatatgtgtatatatagtgtatatatatacacacatatgtgtatatatatgtgtatatatatacacatatatgagtgtgtgtgtgtgtgtgtgtgtgtatatatatatatatgctttcttgctctgccagctgaaaagcaataacaccccagtagcaacaagcatggctaggtaccagaactagctttgtaatcccattttccaagaaaataaatcagagctctctggagaaatgtctgattctagggctgggacaaggaatatacaagataggtctggagaaagttacagtgccagaaagtaagcaagtgctcaaaaacaaaggaaaaaactcacaatgatgggagtatgtaaaaaggaggtaagagccaattggaaacgttccgtttggctaaagccaggacaattggagcaataaaataaagtagtactgagtaataatccaaggtgtaaaacaaatatcgtgtgtcaatactgatataaataaatgattgaataaataaatggggagaatagacaaatctcccatgcagaagaattccaaataatttacttggagcataaagtgatagaatgtaactccctcctcaagtgtgggccatacacagtgatgtccttccaaagagcacagtatggaaaggggtaagaaagagcaactttacagtggtaaaatctgacaaacatggcctcagtcaagtgatcaaggttgacgtcaacagtagtaagtcacgttgacagtatgaaccttgatatggtgtgaggagaaatggcatgctacctatggcgtcttcttcccaaaaatgtataacctcagtgtaatcatgaggacatcatcagacaaatcccaattgagggaaattctacaaaatactgaaagggagctctttaaactgttaaggtcatcaaaaacaaggaaactctgagaaattgttacaaccaaaaggagtctaaaaagacaggattaaatgtaatgtggtatcctggctagaattctggaacaaaaaaaaaattaggtaaaattgaagtaaatctaataaagtatgaactttagttaataacaatgtatcgatattggtccattaactatggcatgtgctgctgtaagaagttaataagaagccacactggatagggatttatgagaactctgtgtactctcttcacaacctgcccacaaatccaaactattccaaaattaaatttcttcttttaaaactaagtttcatatgacttgatttttgttaagggaggattacaattttatgtatagctgtgtcattatagatatagctatagacatggatatagatatatagatatatagaaatatagaaaagcatttagctgtgctgtctaatacacagccattacctagatatagctattgaacacttggattgtggctaatccaaattgagaagtgctgtaagtgtgaaatgtacaacagatttcaaagacgtaatatgaagaaaagaatataaacaatatcattaatgttgtgttttgagacagggtctcattcttttgtccaggctgaagtgaagtagtgcgatcacagatcactacagcctcgacctcccaggctcaagcaatcctcccacctcagtctcccaagtagatggaactaaaagtgtgcactgccacacctaatttttccatttttatttattttttatttctaggtttactcaaaaacattattactcaattcataaaatagtaattcagttagctggtgcctaaagactgaaaaaattgtaattttccaggcatttacagtttggggaacaaaaaacatgagacctacttgaaaaaatagaggctaataaataattaaggataaggctctaaaaaataacagtattgcaagctatttttaaagagaaaaatttgatagcaaaatgtttctctgactttgtaaatgcacaagaaagatcaacagttttatcacttgcagaaaaggcaattaatgtaatagaaaatgtgatgataaacttctaagaaactaagtgcttatgtctatttaacaatagaagttttacctattaccatttactattcatgtgtcgacagcaatccccttctctcccaactaggcctttcacaattatggaatatagacataaaatattattcctagatacattttacaaaataaaaatgagtaaatggaaaaaaggcaagttaaagtagttatatatatatattgaaaagtgggtgaataaactgaattactttcactaaaatgactatacaatagttaatgaatttcttatttatacaaggggaaaactggatataatatatctttaacattacacagtcatagaaaaatgttaactttaacctgataaaatcctttccccacatgttttacactttggattttctttcaatgtttattttggatccagagggtacatgttcatgtttgttacatggatgtattgcatggtgctgaggattggggtatggataatcccatcacccaggtagtgagcatagtacccaatgagtaaattgttaccccatgacccaccccaccctctaggagtccccaatgtctattattcccatctttttatccatatgtactcagtgtgtagctctcacttgtaggtgagaacatgtggtatttggttttccattcctgcatatattcacttaggatgataacctccagctgcatccatgttactgattttgttctttttaatggatgtgtagtattccatggtgtatatgtaccacttttttctatccagtgtaccattgatgggcccctaggttgattccatgtcttagctattgtgaacagtgctgcaataagcatatgagtacatgtctctttttggtataatggtttcttttccttggggcatgtacctaggaatgggactgctgggtggaatggtagttctgttacaaattatccaagcagagatctccagactgctttccacagtggctgaactaacttgcattcccaccaacagtgtataaacataccattttctatgtagccttaccagcagttgttatttcttgactttttaataatagccattctgactggtgtgagatggtatctcattgtggttttgatttgtgtttctcttatgattagcaatgatgagcattttttcacatgtttgttgactgcttgtatgtcttcttctaagaggtgtctgttcatgtcttttgcccatttcttaattggattgtttgggttttccttgctgatttgtttaagttatttttcctattcagatgccttttaatttctttctctagcctgattgctctggctaagacattcagtactgaatgttgaataggagtggcaagagtaggcacccttatcttgttccagttctcaaggggaatggttccagcttttaaacattgagtatattgctggctataagtttgtcatagatggctcttgttattttgaagtatgtaccttcaacgcttagttttttgaggatttttatcatgaagcaatgttggattttatcaaaagcttcttctgcatcaactgagatgacatatggttcttgtttttaattatgtttatgtggtgaatcacatttattatttatatatgttgaatgttgaaccaaccttgcagcccatcaataaagcctacttgatcatagcgaattaacttttttatgtcacgctggcttcggtttgctattaacagtattttttttttagatggagtctcactctgttggccaggctggagtgcagtgttgcaatctcagctcactacaacctcagcctcctgggttcaagagattctcctgcctcatggagtacagtggtgcaatctcagctcactacaacctctgcctcctgggttcaagcaattctcccacctcagcctcctgggtagctgggattacaggtgcacaccaccctgcatggctaacttttgtatttttaatagagacagggtttcaccatgttggccaggctagtctcgaacatctgacctcatatgatccacccatctcagcctcccaaagtgctgagattacaggtgtgagccacctcacccagccagcagtttgctagtattttgttcaggatttttgtgtctattttcatcagggatattggcccgaagttttctttttttgttatgtctctgccagattttgttatcaaattaatgctaccttcatagaatgagttaaggagaagcccttcctccttggttttttggaataacttcagtgggattggtaccagttctttatatatctggtagaattcaggggtgaatccatctaatcaagggctttttttgttggtggtggtggttttttttttattactaattcaattttggtacttgttattggtctattcaggctttcactttcttcctggttcaatcttgggagtttgtgtgtttccaggaatttatcgatttcctctaaattttctaatttgtgggcatagaggtgtttgtaatagtctctaaagatcttttgtatttctgtgggatgagctgtaatgtcatctttgtcatttctgattgcacttatttggatcttcacccttttacaaatttcttaatctacctagaagtttatcaatctttgtttattctttcagaaaatcaactctcagtttcattgttcttttgtatagattgtatgtctcaatttccttatgttcttctcagattttagttatttctattcttctgctagctttactgttggtttgttcttatttttccagttcctctaggtgcaatgttagattgtaaatttgggatatttctagcttcttgatgaagacgtttagcactagaaactttcctcttaacactgctttagccgcatcccaaagattttggtaagttgtatctcttattttcactaatttcaaagattttttaaatttctgtcttaatttcatttttcacccaagagttattcaggaaaaagttgtttgattttcatgtttatgtgtagttttaagagatcttcttggtattgatttctatttttattgcattgcaatctaagagtgtgctcggtatgattttgatttttttaaatttattgagactcgctttgcaaccaagcatgtggttgatcttagaatatgtacctgtgtggatgagaagaatgtctattctgtggttgttaggtggagcattctatagatgtctactaggtccaattggtttagtgtcacgtttaaatccagaatttctttatcagttttctgccttgatgatctgtctagtggtgtcagtaaggtgttaaaataccccactattagggtgtagctgtctacaccttgatcttttcatagatcaagaagaacttgttttatgaatttgggtgctccaatgatgagtgcttatatatatttaagatagctaagtattcttgtttaattgaaccttttatcattatgtaatgcccttctttatctttcctgaatgtttttggtttaaactctgttttatctgatataagaatagtgactcctgctcttttctgttctccatttgtgtggtacattttttcccatccctttactttgagcatgtgagtgtagttacacgtgagcttggtctcttgaagacatcagaaaattgggtcttgagtttttatctagcttgtcactctgtgtctattaagtggggcacttagaccattttacatactgaattagtattgatatgtgggattttaatcctgtcattgggttgataattggttgttttataaacttgattgtgtaattcctttatattgtctgtgagctatgtgcttagtatgtttttgtcataacaggtattaatctctcatttccatgtttagcattcccttaaggacttctcataaggttggtctggtggtaacaaattcccttagagtttccttctgtgttaaggattttacttcttcttcacttatgaagcttagtttggtgagatatgaaattcttggttggaatttatttgctttgaggatgctgaaaataggtctccaatttcttttggcttgtaaactttctgctgaaaagtctgctgatagtgttgtgggattccagttataagtgacctgacctttctctctagttgtctataatatttttccttttgcattgaccttggtgaatctgatgactatgtgccttggggatgatcatcttgtatagtattttgctgggttctctgtgtttcttgaatttgtatgtcaatctctctaacaagattggggaaattttcatagattatgtcctcaaatatgttttccaagttgcttactctctctctttctctctcaagaatgccaataaattgtagacttgatctctttacacaatcccatatctctcagaggttttgttctttttttaacattcttttttctttatttttttctgactgagttgatttaaagaacaagtcttcaaactctgagattctctactcagtttggtctattctgctgttaatgcttctgattgtatgtggaaactcttgtagtaaatttttcaattccaggagttcagtttagttctttcttaaaatggctattttgtctttcagctcttagatcattttaccggattctttggatttcttggattgcatttcaactttttcctggatctcagtgagcttctcaccatccaggttctaaattctatacctatcacttcagtcatttcagtctggttaagaaccattgctgggggctactgtgctcatttggaggtaaggagacatcctggctttttgaattgccagagttcttatgctgattctttctcatctgagagggctagtgtttctttaagttgagtatagtcagttggcttcatttctgggtgctttcagagggccaaggctctgtacaggatctttatttgtagctgaattcttgtcttaggtttcacaggcactgtacattggcaaaatattttggcagttgtaatttggactgtgatgcagtagatggtgtttaagagtgatgaccaacagataggctcttattcagccatgcagctcttttgtatttcaccatgttctcaatagtgctctgtggtggggtaaggcagagagataactccctcaccaggttcactcctgggccttggaggagccccctccaatcactggggtcatgcccaagtttcctttgttaggtgttctgggctgtggggctccctcagatagaggtcatggctggcagacaggccacttccttcccagaccagccctgtggagagaggcaccccactttcatgctggtccatgaaccagggcatctcaaccctctcagtgttttgagagtgagaacatttcccccactcaggcaccaccaagccagtgagtcttgcctatctaagtacagaaggaccatggaggtcgcatggtcagccatcagggtctccattttttgtggggacagaatcttactatggtgctcaggctgactgtatgttgaaatgacaatattttaggtatattgggttaagtgaaaataattttatatatttatttatgatttcctttaatgtagtcactaaacattgttaaattatatatgtggttcatattgtatttctactgatagcagttgtttaaaaggatagacatgagaatgttaacaatagctattcctagtagtaaagtgtaatttttagcttttcttttttctaatttttcttgaataaatatgtgttccttgtgtaattttaaaagtaataaaggtaaaaatacacaatgaactactgctgtgaaatataccactaacagaagtactaagcagaaatgtcaagtcttagagtcctaattatttattcatttaaatacatatatattaagtgtctcatgtgcaaggcatttggacagttgctaggaaaataaacacaaaaaaagatgagctataattattttcttcaaggggttcacagtccattttggaagttaggctcatgaatagaatattagagtacaatgcggtcagtgatactatggtgatttgtattaactctcctccccttctgctttaaatgttgctgtttttctggctctaaccttagtctacttctctgcccacaacacaattgcaactaacacctatatactaatggctatggctttaactttgactttgcttcagatctctacatccaactgtcttttggtcagatggccattgggcaacctaaactgtatgcctaaaacccatcatctcttcacctcccctgctccagactcttctacctccgtaattcttgtctttgttaatgatgccaccatttaaccagttgcctcatgactctgtaaaaaggaaatttagttactttacttcacttctcaaaattcttcaggcttggcagtgcacaagcctacatatgcccttagctaccaatccaacttcatctcctggaacacttctcatcagcattgacactctagaaataccaaactaccaaactcaggaaacatcacaagttatcacctctcttcctttcattgttgcgtgtgtccttccctctgcttgaagtgtccaacctcatcaccacctcttcttcatggttcctagacattcctctctgttacctcccttgatcttccaggcaaattaggctctcttctctctggctccccttgaactttgtacatacctccaacatagtgattttcccattatattataataccagctttctgtatgatactctattccctaaggacagagattgtatctcattaaccttggtatcctcagcgtcacacggaatgtgacagacagaaaactttcaagtttactgaatatttcctatctttctttaccttttccactctattgtggtcactcttaccctagaataatgtagatgttccttgaataccaaccaggcttcacttctgggtctttgttcttgaatggccttaccccagatggttccctctgataaaccaattagtcactgctcagaagtcacctcatcagagaggtttttccttcaatcctgtataatatagtgcctggcaagaaaaggatgccctctctcaccactcctattcaacatagtattggaagttctcaatcaggcaagagaaagaataaagggtattcaaacaggaaaagagtaagtcaaattgtctctgtttgcagatgacatgattgtatatttagaaaaccccatcgtctcagcccaaaatctccttaagctgataagcaacttcagcaaagactcaggatagaaaatcaatgtgcaaaaatcacaagaattcctatacaccaattatagacaaacagagagccaaatcatgagtgaactcccattcacaattgctacaaagagaataaaatacctaggaatacaacttacaagggatgtgaaggacctcttcaaggagaactacaaaccactgctcaaagaaataagagaggacacaaacaaatggaaaaacattccatgctcatggataggaagaatcaatatcataaaaatgaccatactgcccaaagtaatttatagattcaatgctattcccatcaagctaccattgactttcttcacagaattagaaaaaactactttaaatttcatatagaaccaaaacagagcccatatagccaagacaatcctaagcaaaaaaaaaaaaaaaaaaaaagaaacaaagctggaggcatcacactacctgacttcaaactacactacaagcccacagttaccaaaacagcatggtactggtacaaaaacagatatagagaccaatggaacagaacggaggcctcagaaataacaccacacatctgcaaacatctttgacaaacctgacaagaacaagcaatggggaaaggattccctatttaataaatggtgttgggaaaactggctagccatatgtagaaagctgaaactggaccccttccttacaacttatacaaaaattaactcaagatggattaaagacttaaatgtaagacctaaaaccataaaaccctagaagaaaacctaggcaataccattcaggacataggcatgggcaaagacttcatgactaaaacaccaaaagcaagggcaacagaagccaaaattgacaaatgggatctaactaagctaaagagcttctgcacagcaaaagaaactatcatcagagtgaacaggcaacctacagaatgggagaaagtttttgcaatctatccatctgacaaagggctaatatccagaatctacaaagaacttaaacaaatttacaagaaaaaaacaaccccatcaaaaagtggacgaaggatataaacagacacttttcaaaataagacatctatgcagccaacaaacatgaaaaaaagctcatcatcactggtcattagagaaatgcaaatcagccagagtgagataccatctcccacaagttagaatggtgatcattaaaaagtcaggaaacaacagatgctggagaggatgtggagaaacaggaatgcttttacactgttggtaggagtgtaaattagttcaaccattgtggaagacagtgtggcaactcctcaaggatctagaactagaagtaccatttgacccagcaatcccattactgggtatacacccaaaggattataaatcattctactataaagacacatgaacacatatgtgtattgtggcactattcacaatagcaaagatttggaaccaacccaaatgtccatccatgatagactggataaagaaaatttgcacatatacacgatggaatactgcgcagctataaaaaaggatgagctcatgtcctttgcagggacatgaatgaagctggaaaccatcattctcagcaaattatcacaagaacagaaaaccaaatactacatgttctcactcataagtgggagttgaacaaggagaacacatggacacagggagcggaacatcacacaccggggcctgtctgggggtcagtggactaggggagggatggcattaggagaaatacctaatgtaggtgacgggttgatgggtgcagcaaacaatcatggcacgtgtatacctatgtaacaaaactgcacgttctgcacacgtaccccagaacttaaagtatatatatatatatatatatatatatatatatatatatatatatatatatatatatatagtgtgtgtgtgtgtgtgtgtgtgtgtgtatttaaaaaaagatactttcctaattaaagatagtttcctaccttgaaaaatctctaatgccagctactaaagtaacaatttctcacttatccacaggggttatttctggccagtgagatgatgaatgactgttttatgttaatttttaattttatagtattctcatgggattaaaataattccgctaacctcaaaaaaaaaaaatcaggaaacaacagatgctggagagaatgtggagaaacaggaacagttttacactgttggtgggagtgtaaattagttcaaccattgtggaagacggtgtggcaattcttcaaggatctagaaccagaaataccatttgacccagtaatcccattattgggtagatatccaaaggattataaatcattgtactataaagacacatgcacgcgtaagtttattacagcactattcacaatagcaaagacttggaaccaactcaaatgcccatcagtgatagactggataaagataatgtgccatatatacatcatggaatactatgcagccataaaaaggaatgagttaatgtcctttgcagggacatggatgaagctggaaaccatcattctcagcaaactaacacaagaacagaaaaccaaacaccacatgttctcactcataagtgagagttgaacaatgagaatatattggcacacggagggaatatcacacaccagggcctgtcggggggttgggggctggggagggatagcattaggagaaatacctaatgtagacaaggggttgatgggtgcagcaaaccaccgtggcacacctatacctatgtaacaaacctgcatgttctgcacatgtatccaataacaaagtataatataaaaataaattaaaatgtatattttatatatattgaaattatttatatattttgaaatatattatatatatttatatataaatatatattatatatatttatatataaatatatattatatatatttatatataaaatatatattttatatattccaccagaatataagcatcaactgggatctaattaaactaaaaacttctgcacagccaaagaaataatcagcagagtaaacagacaacccacagagtgggagaaaatatttacaaactatgcatctgacaaaggactaacatccaaaatctacagggaactcaaacaaatcagcaagaaaaaacaaataattccaaccaaaagtgggttaaggacatgaatagacaattctcaaaagaagatatacaaatggccaacaaacatatgaaaaaaaatgctcaatataactaattatcagggaaatgcaaatcaaaaccataatgtgataccaccttactcctcctacaatatggctataatttttttaaaaatccaaaaatcaaagatgttggcatggatgtggtgaaagagaacaattttacactgttggtgggaatggaaacctatggaaaacagtgtggagattcctcaaagaactaaaagtagatctaccatttgatccagcaagcctgctcctcagtatctacccagaggaaaacaggtcattatacaaaaaatacacttgtgcatgcatgtttatagcagcacaattcacaactgcaaaaatatgggaccagcctaaatgcccatcaaccaacgagtggataaagaaaatgtatacacacatataccatggaatactactcagccataaaaaagaatgaaataatggcattcacagcaacctggatgaagctggagaccatcattctaagtgaattaactcaggaatggaaaaccaaatattgtatattctcacctataaaagtgggatttaagctatgaggatacaaaggcataaaaatgatataatggactctggagactcaggggagaacgggtgcaccaaaatctcagaaatcaccctaaagaatggacccatgtaacaaaaacctcttgttccccaaaaaattattgaactaaaataaaataaaagtcattttttataaaagaatctaagtatcaaaaagcccaggactttgtctgaattattcaacaaatgaataaagatctgatacatgtataaataagtaaatgatgttatttatcacctaaatatgacactgtctctctgactttaattttcctttcatctgcttatttttcttcccaagccatgaatatgggacaaaaaaaagggattaagacacaaacaccaagaattggcaagtataatgaggctgaacttgaaaaataacaatagttcaggtaaccatatattaaatttgtctcaagaatttattttattttctcattcatttattcaacaaatatttacatcacgcctattatgagttctttttgaaaatgcaataactgtctcttacatttgtaccattgtttatagtttacaaggtcctttctgatacttattttaacgtatcctcataaacaattctttgaggtaagcaggtcttatgaggaatgagtcttatgaggaatgagttaccagattaaggatcattgggttgtaaaaatcttgagctagaaagcattccatcgttttattgttgatacaactatatacagaagcccattatcaatctatttatttcaccacagagagctataatacacccattgaccatcagtaccagtatattaattttcacttctgggatttccagcctactcttagcttcaatgttagtgtgaatatttcatggtagaatgcacaaactttgaggaaggtgcaatgctttccctgtttcttccacttatgttcaggttctgcacatactgtatgttctccataaatatttattggtgaagagaacagttattaatgtaagaatctctctattcagaaaatatccaaggaaactgtgatagctgctggtttccaaagatggtcttccaatgaactatgtctctcagtattcggaattttgcataattccttccccttgatctggactggctctgtgacttggttataaccaacagaacatggtggtgggttaagcaatactcatttcatagggggcatttctggtcacatgatacttaatggtccatggtcaaatactaggatccagcaaagagccaagagctgtttctcaaaaaaaaaaaaaaaaaaaaagaaaaagaaaaagaaaaaaaaagaaaaaagaaaaaaaaagttatctgcagagtatggcatggctttgctcccagattctaaaagtctgttctggaatttacctaagaggcctgccaaaagctcagtaggcactttaagcaccactgaatcagatgtgtcatatgaccaaagtggcagggaagcttgccaccctctcacaagggcttgtctttcgccaggccttattcaaaactggaagcctttcagattactcattcagcaaataggtttagactataacaacacacccaaataagatatgttgcctccaaaatccaatgaggcacaccagaaattgggactctttctttatggtaggagagaccagatgtagcattgaacttcaccttgaaagagatatctcaactttccccagaccatgaaaccccaagaaagttcctgaaggagcaaacttctaaatttttctgggatttatttcacaacctcttgcctctatgggtcttaccaaggtgtctaaagtagttgcgatttcctggtccaccagtgtagaggatccatgtggtgtgttgtgaaatgaagaggcaatcaatttcctgtggaatagaataggccagggttggagagttgatataaccctgaggtgaaacaaggagggtaccttgtttcacccttccagatgaaagaaaaatgcttctgatagtctctactaacatgtatatagaggaaaaaatgacttcccatatcagtattcatatattagatgtacatatattgatttactatagcaatgaaaccacatctggaacagcagctgtgattgtactcaccacctgattaagtttacaataatcctttgtcattcttcaagatccatctgtcttctgcacaggccagatagttgagttgaatggaggtgtggtgaaaatcaccagccctgcatcttttaaatcttttatagaggcactaatctctacaagtctctacagaatgcagtgctgctgtggatttactagtttggaatacaaaggcagttctaatgccttctacttgtcctcactcctcagatcagataatcaatgtagttattctgcctttcctgagtgtgcctccttcagttaagcattctagaacttgggaaataaccatggggtaagttcagagctaactggatgcaatatgagatggacctgagccaaaataccattaatcattcagcttcaataaacccctactctggtaaataggcaatagtagcatattgtgtctccaaggactggtatcatttcagagccaatgtccagaaatcccccaaaggtctggttatttacccttcccaaatgcactatgaccttggcaaatggctttaggtcttttcagggaaggaaagaaagagaaattacagtctaaacttttggaatgtaaatataaattagaaaaaatcctgcagtccttttggcaggcagggtacctcatcattttgttcctgccctgatatgggttgccaggagttgagtctagctataggcatacaaacagtgaaagatgttgggggtgagtcttgaggggtctcagcaattttccacagagtaagtccttacagccttttcaatcaagggaggactaaactcctcagagggaaaggctgcttctgctgggaaaggagacagggctttcaaggttctcagcttccaaagaatctgcctacatgttgccatctcaattttcaggggaggaaagaaggagaaattacagtctaaacttttggaatgtaaatataaattagaaaaatcctgcagcccttttggcaggcatggtacctcatcattttgttcctgccctgatacagcctgccagctctgtcccaatcaaagccctaattttaactgtaagaccttcaattgaattgatgttctaatctagctagctgcaggatcagtctttgggcttggttttttgaaatatcagatcttgcagctatgagagataagagtttctttcagagtagtcacaaagacttttcagtcccttgcctgcatcttgaactgaacattcaacactctgagtttatttctttttctccatattctctgtgacactttgaagcaacccacaaactccagtcctcatactccttacttccactacattggtctatggcagcatctacctggtaatctaacaccttgccttctataagcacttgatatcaaggactactgtgtcccatttaccattggcagtatagtcactaatgcttcatcgaatcagagaatcaacaccaaattcccatccttaaaattctatctctggattcacttccaacaccaatagttgtatcagttaagagtcagtcagggaagcagaaccactgtgaatgatacagaatataggaatagtggattcgttgtggaatcagaccttacaaatgtgagagaagctagagaaggaaaggtctggaagaaggagtcagaagatcagaaaaagggtcattaacctgtctatcttatgcagtagcacagatggaccagacaggctggggcttgggggaaatctaggaagctaaacactttcaaccaccaaagtgggactgtgaaggggagctcatgaagaactgtatggagagtggttacctgtctgtagcaaccacttctgtgggtccacagccaagtagttggtgatgggtctcgagtcactgttgttcagcagagccaagagtcagaaagattcgctggatgcagagtgaaggaaagcaaggactatatgggacctaccaagcatctctccctctgtccatcactgtatgtgaccacagtgacttcctaagagtaatagttaccacttctgtgttctaactcttttcccatttcatctcttagccaatgctaatacagagcgatacatgaaaggggattctgagaaatgcagttgtctgcttaagcaagttgaccagcataatccagcacaacttctaaatctcagaagatagcaaatgtgggcagaaagaaaagtacagatgctccacgggttcactggtgatctttatggctgcaactgacctaggatttgggagatgcttggagagggacagaggggcacacaggaactttcctctcaaatatgaggatatcaatctagatctacgaggagtccttttggagataaaaagaaatttataggagatgatgaacaaaaggcccaatttctatattagactgtctccctgaatgagggtgaataccaagaggagactgagccaaggcctcagccctctgaattctaaaatgtagagaatttcattctgatctattttatacaaatggtgctggtctctcagacagtaccttttccgatgaaagaaagagagaaacgaagtagaagattcgtaacccagctcagtaaagaggcttacctttgctctttgctcaccatcattcccccgctcaaagtctcagctacctgcctctgtgcaatagctacacagtgctcctcaagtatctgcctcctgaacacagaattataactaacaagtatttaaaatttatgtatttggtgcacatctttcagtatgagctttttggcaccaactcttactgaatgccaatataaaagtaaacaatttgaaattattttaagtgattatcaaaaataacagcataaattctatgatgtggacttcagccacagtcccttccagggactcttccaggcagaccaaaagagaaaagctgtctgcaaaagaaactcaaagttcccaggaccaatagcatacttgagtcagatacagctccttaaaagacaagtaattttcagaggccctagggtaaactaaattagttttaacataatactatttaaacatgtagaaacataatatgatttataaactctatatgcttattgctcttatgccaacaatttaaaaatataaattaaacattcacaaagcttcaaaaccactacaacttcaataaataattttaatttaatgtaatgataatacttggctaaaactaaatcaccaggtttttttctttccaccttttatattaggtttaggtggtacaggtgcaggtttgtggaatgggtaaatatatgtcatgggggtttgacaagatacagattatttcgtcacccaagtaataagcatagtacccaataggtaatttttcaatcttcactctcctcctaccttccaccctcaactgggccctggtgtctattgttcccttctttgtgtccatgtgtactcaatgtttaactcccacttataagtaagaacatgcagcctttggttttctgttcctgcattaattcacttaggataagaacttccagctccatccatgttgctgcaaaggatgtgacttttttcttttttatggctgagtagtatttcatggtgtatatgtaccacatttcctttatccagttcatcatttaagtcaccagttttgagtttaatagatgaaagatatatacgtggtgctgggttttgcttattaacttgattcttctcattttgtacataattttcatgcttgttttcctttgtttgaaacaaattcatattgaattgttaattaattcacttgatgggccaatcaatttactgtgcaccaatagtacaatactgaaagaaatatttttaacttttaatgaagcattctttactattgctaatcaactgtagtacagtgatttatacaaaagatgagctctacacagtacagccatgtgaatggggaatttagcaccaatcattcattgagttccccatgcttacagcatctaacttgttatgattctattttccaatgactgttttatattcaaattacttgacattattaggccttcacttagtattaaagtaactattagtattagcaaagcagggcatcaaaatattgtgacagtgtttgcttatagttgttcagccccaacgtgagttagttgtgttttatgaggggtatgtactccttataattttgcataatttaaggcttatgtttccgtggggaactggttcacagagcccaaatacctacaactttgtagcacatttctgttttaatgccgctctttattttcttagcattatctaccatatttagcaactgctcttttctaaattagtggtaaaacacatcaagggagttgtttggctttttctgtgggagtgaattatagctaacatctgtgaaaagttatgtatctgaatgcacattttccagcatgagctttagtaccaactcctaatgaatgctactataaaaagaagtaaaacaatttgaaattatttaagtgattattaaacataatagcataaaataaccaagatctcttatagaaattctcataaagcaacaggtggaacataccatactaacaatggctggttctttccattaaagctgaagtagctccaccatgtggcaggagtaaaaacaatctacgattcctttagcttgttcaccaactgaaattacacaaatctcatttaagtttgatgagaaccacaaaattacccattcttctcagaatatatgggctattaatttttatatcacattacttaaatttcacataatttatgctgcccaactacatgttttagactaccattccattgaaaacacatttttaactccataaaattatgaagacccatgaaaattctagagatgcatatattccaagtataataaatatcacaaataacttttaaattcaatttttaaataattcttgttactattataatttccatacaggtctcagaagcatcttaaaagtaatgataactttttgtctctgtaaaaagaatactattcaaaaaaggacaaaaagttcataaatgtggaatactaactttgtaactaatatataaaatacatgagttttttgattcctaaattcttccaacagaaattcaaataatgtaaaatattggtatctttaagccgtaacttattaccttgttaatttcaaaacagcatactagtaacctgatctttaacattagttgttaccaaattatagtttttaaaaaatttcctaggaaagtacgccattttttgggtatcgaacatctcacctcataggaatacggggattgttttccttccactcttttgtattttccaaattttcaatgtaataagcacatattaattttatgatgaaatgaaatttgtaaaagaataaatgttaacattagaagataattaacaagttatctatctcgagtcaatatacaatacaaggaaattaatataccactttacctggtggcaaggaaaataggtgagatatctttcccatcacaacataaaaatatatgttagtaaatattcatattggaaggaatgtattctatgacctagcaattacctgcgtcccagtcttggcattactcttattgtaaaagaaagcatgaacaagcagcaattttggggccataacaagttggaaataacataatcatatagtaaaaagtgatatcacaggttataataagtctatgttccatatattaaaaataatgacacgaatctacatataatgaaaagagaagattgccaaaatgcattattgattgagaatgcaagttgcagaataatatatacagtattatgctatttatgttgataaaaatattgtacagtataaaccctaaatattgcacagcaaaaggactgtaagtacattgatgaattccctgttattagtacctgtggaagagggaattatattgtgggatgggagaacagtcagtggagagtttggttttaattgcaatgcttttatttttataataaggatgtattagcatattacttgcataattaaactttgttttttaggttttcttcttcaccatcgtatatttgcatgcatatacctatgcaaataacaaagtccacctttattggggatttgtgactggcatttttctaagcactttgtcatgtgtcatatattgtatcatgtaaacttattattaaccttatgatgctaataatatttttcccatttcacagatgacgaaaccaagcctcagaggaactgagtacattgcccaaattcaccaagcccgtaagggttacaatcaaactttgaatccagatatctgtctcagagtccacaatcttaaccaaaattttttttacaaattcccatgtagaagtgtgtacatccacatacagacgtgcacacacacacatccctgctgtccagccttttctccccctgacacttgagtgcacaggtcattggcatcttctctccataactttccaccattgacagaaatgtgtttgctcaagggatgaattgaggtgaaaaccttacaacattagctcttttgtaaaaaatctgagcagattttttattttgtattttgttttcctggttacgcctctccttttaaagttttgaaaggtggcattaatatctatttctttcctgactgctccatttattagtttcattaggattagtgaattctacttggtctttccccaatccattaatattttttcccttcacttaaaaacaaacaaacaaaaaaaaaaaacacttgttttccaaatggctttggggtggtagtaggatttcctgatggctagaggaaactcctcatggcagtatcttggttgagtaattggtcctcgtctgtatgttcaagaaggtgaatgttcttagtaaacccagaggggatcagcccatcagaggtaagcttctgctatgtaaattgagacgagattcaggcttaacctcaaataccaatgcatttgctcttctggtctctcccttctcctccttattatcatgatactttaaaagccaaattactgataagaaatttgcttgctgagaacatagaaaggtaaacggctcgagagagggggttgtacatttttctttaaatctaaaaaaccactatgaagaatcccaacctcccaacaaaaattgcctctctgttaactggattttacctgcatccagttttaacacctctctcctctggacagtgctgacactgtcctcctgggaattatgacttccttagacacataatgctagagtcaagttggaacttagattctttttcttgcggaagtgggaggcattgtgtcttctcccttcatgcattaatttaattagaaaaacattcactgtctctcactatcagcctacagattctctatcttctcagcccggtaagagccttatcacactgagataaatggttctctttgttgtaccaaggtggttcctgaagcatggtaatggggaggagacacctagagatcaaagcaactaatacaatcaactccaatccagccccaaaccaagtctttccaccagctattcctttcatatctaaatgttgtcctcttcctctgcagcaggatagaaaatcaatttctaagtgtaaaggcagtaaacaaaatttcagagatatatagtatatgtaagtttgagtgcataaagttaaaagattcccaaatatctaaaaatgtttgaattaaaaaatcagtatcaaattagtaaaaaaaaaaaaaattaaaaaggtacgtgagctgtataacagtcaaatgttaatatgcttaatatattaaaagtgtatataaaaggataaggacaacactagcctgatggatatataggcaaaattcggatacaaaaattgtgtataaattactaatgaatatttgaaaaaaaacactgaaaattttaaaatgcaatgaagacagctataattcatatcaagttaacaactatttttaaacaatcacaatctaatgctgatgaaattcggcatattaagagcaattacatttttactgctatgattgcaaattgatacagtataacagtagattatttggcattaggtatcaacagcttttaaaatagtcatcctcttgacccaaatattggaaatctatcattaaaagggtcttctgagcagattttatataaggaaaatgttcattaaatatttttcatactttcacgtaatttgaaataacataactatccaacactagagaaacagttaagcaaattgagcaacatctacccagtagaatactatgccaccattaaaaattagattttcaagagttttaaattacatgggggaaaataaagttaacagaaaattgaatgtacaaaacggcctcaacaatgtcagaaaatatacttaagaccaaagactaaaaggaaatatgccaaaatgatgtagttattgtctctgggtagtgagataatagattatttccttcttcctcttctttttataattgtatgtaaaccacaatttcttcttcaatgaaaacatatttttataatgagaaaaaatgatctaataacagtatcttttaaatacaaggttatgtgccctgaaaacattcctagtttcccttaaagtcatttgtctaacataagtgaatttgtctgaatctctctagaatacacattcatatgctctaccccaggagcaaggagttcctaaaatctactccctactatgtaaaataaaactgcctttaattttttcctgaatttgtttcagacttcaagtagagttctttattatttctgttcaacagcacaaactacaaacataatctgtttggcaaaccatttttattcaaaagtataataatgccttgtttttcatccttccagaggacctagtggaagaaaatgcctaacatcagggaacagtaggagcagcctaaattgaccacagaattgtatttggccactgtcctcaaaaaattcaagtggattcagtaatcctgaatacttatgtacaacaagcattcctactataatagatcatgaggattaaaatgaggtgagttcattggtgagcatgacatgtagccatagcaattaatcttaggttccttctcccttaaaaatggctaataaaacagaagaaatgctgtatgaataatttcagaataacatggaataattgtagatatttctataagatttgtaccagatccactagaacaaatctaccagtagctaaacactgtagagtctctaaaaatggacaaggaggagatgtgacaaagatactctttaggggaataaagtcatcctaaaaactgaagatattttctgctctgccaatcaaggaatcactgttctttccccagcaagaaggagagtgaaaagaggaccaaattggaggccccaaatttgcattttaatcataacctttcatagctaattatgagatttgagcattctctggatctcagtttgccacccataaaatgatgggtggactgaaagatttctaagttttccagttctgacattgcatgggtctataaggagctccatcttggttggcccctgaaggcacctggagactttggttttagggaaccaaggagtctcagtgctgaatgaggatatagttccccggtgtagaattttagaaactatgcaagcacttggatctttaaaaaaaaaatagttggtccctgggctgtctcttacaactttaatatttacactatgacaaagtgaaagtgctcattcgtgttcgagccaaagtaataccattctctttattcattccaatgagctaattttacatgagcaagaaagcactggagaggtacagacccatgggatatttgcctagcctaagtgagtctcagatggaaataaatatgaaaagcgttagcatgggacctgtgagaaattgattcttacatctggcctccaaagggtcaagccacaaataagtgacctttgacatgccccttctctagttcagcctggagctgcccacatttcccagtggtgcccagtcaactcattctcctgatgcaggatcatcagagagaatctggagtaatggcagctgcgggtaaggggctgccaaataatagtggaacaaagatctcttccaagtttctatttcctccgaatagctcaaatacttcaacagtccaggtccccctaaagactgcattttcttagctgcattctctctagttgtgatgagtgtctcaaaaaggaacacctctcctcctgagtttatgatagtttatgacctgccacttcatttccagcagtgtgtcccagttcctcttgcaatccacaaaggacactttttctttcagtagcctggtgtgagctcttgcctctcaggattagctgtgatcttactgctggggtgggagcacacttagccacagggcccaaaagaaatactgtcactgaaaagagcactttcctgtatttgagggctcttcctctcttctggtacacccggggaaaaacctggcagagtccacccacagtctttgaggattaattctgtaagaacttcttacactgaagggaatcctcctccaggggatgattctgctctgtgcttctgagctctgatggcaatcacatcaacatcgctggggactgtggcagaagaggaacatcacccactggaaaccggggcaagttgctcctctgtagttccaggaaatggccagaggcacagctctgctgttccaatttgcagttttctctaacatcaaaaataaaatgtgatttgcatttgaaattttacagaattcctcattttaggtcaagactggccttacccataggttagtgacttatgtggtaggatttaacacacacacacacatacacacacaaatattatccataaaaagaattatattcccaccaacctgctgtggcattcatcagtgaccctttgaagttcagccattgaaggggcaggttaaaatgcaaatttgtttcttggagaggtagcacatagagctattatcaactgttaatgctccggtattgctggaatgtcagactaagaagtttgggttaaaaattaacatatcagtaagtgaagactggctttatatattacatatttaatttataaaaatggtgacattaaaaggtggcaccaaaatgtaaatagaatcaagatcactttggataaattaacgcatgacacaagcctttgacatgttattaatggaaatgagtttgggggatctaatttagcctttgagattagtgtcaacaaagaaaggtatctcctctggtgcccatggcagaagcagaacattagtacaattcaccatagatcagtttcactttgtaattcagtgtaagtggtttatatgatagagagggcaggaagatctggttttgactctgtctctactacttacaagatgcatgaagctgctcaagtcacttaagcaaggtgagcctcaggttcttcatctacaaaagtgggatgtagaaaagaagagtaaatgtaaaattcctgttcagtagttgtctattaaagaatctctccttccttcctctattcacatccatcagggagaggagtaggctgatggtgccagctaaggacctcggcactcctagacctattcctgaaccattaatggctctgaatttgggacaggaatgttactctcatggttaattccttgctcacttgtctgctggtgcttgttcacaatgtcaaagatatggcaacttcatgggaaggcaggtttaactttttggtgtttttgcactagcctgtatatctgtctacctttcatttgagaaccaccttgctgattcagactggaagcttcaagagagaagtttctttccatttaatgcactggggatggtgctcaacagagaaccacactcaaatcggggctaaataatatggcaatatcatggttgcaaaagaaacacctccctttctcaccaaatcactgaatcccttattctataaaaatgaaattgaactgcaaacatcaccaccatgacaagaggatttaggcacactgatcaactgattaaattctatttgtcatccagagtgatcctggaggccttcagagcctggaggaaacctctctgtgactctactcacatctttacacacggaaaatccaattaggctgagtatctacagcagcttccagaagtaaactgattgcagaagggcagcctgctgcctgaggactgcaggggacgaggaaggggtgggccacctggaagggacctctgccttctcagcacctagagttggtttccagatgatcacatagtttaacccttttcttttatagacaaggaaattgaggcccagaaaggttaacagtcttgcccaagacctaagattagaaggcagagtcggggttgagaattgcttatgtgagactcagacccaaagcagacgaccatattttcaaattcagtgaaaactggaaaactcgtatgggcctacccagcccggaaaatccccatgtattaccaatacatagtaaacgaatcaaagattgaaaagtttacttgaaaaccaatcagaagtcctctcccacatgcaaaaatcccaccctaatagaacactcatcacccgtcagactgtcttaacacttcttcctttttctttctttgcaaacccctttgagcctgtgccagaagtgacggtgcctgccaccctctctgcagtcagtcctgaccagttctctggggtttacacctgtcctctggccactcgtcagctgcacttcctgcatctgcttgtttcaccttggccccagctttacctgaggggtgcttggcctgtgccttgagttccagggcctatgtttacttcaaaaatattaatgtcaattccttcaacttgttccaaagacaacagagcctctcacaagcaggcaagccctgccacttgttacgtagttgaggctgaggagcctgcaggtcccagccaactttatcacctccctcttctgaggggtggaagtccccaacatctcagggtcccctgagagtatggggattcccacatcggcaagtacctgcttcagagaagcccatgagaaactggcccagagcaagcgggtccaccctcccattgtgggaaagtgaagggcagaaggagtctggctggaggtcactcctgccactgatcttcctcactcgggtccagcctgtcagaggataaagcacagtggtgggtgggggtatctggctctcccccaccctccttctcaggggttcagtagtccctgggaacaagattcagctcaggaatttctgggatgctggtcagttctggccctaaggacactgggagtgacagcgggctgctaaggatgtgacagtgactgggctgttcccttcacatgactaccagggcaagccctggccaaatcccagcacctgctgaaagttgaagctgaccactggagtgattagattcatgacatgtggtggaggcctggggagtggagctactgggaaaggacacagctaaggaatctcctccctcccagcattgcttgaccctttcacaaagacagtggtaggtagaggaagaaggagaattggcctactccttccttttcgctgtatatggtcatagaaattgtcagaactttatatctagattcaagttctatctctagcacaattagctctaaaactttgcgaacgttacttaacctcctaggtcctctttgttcataaaacgagaacgtaatacataccttggttggctgtgaaagttatatgagtcagtgttgtggggaagttgaaggcatgcagtagatgcacaaggaaaattaaattccgttccccagttcctggcttgcaagttgggggttaaactcagttaagctcagagaagacatgacatgacgggggatcaagggagatgtgggaagctcacgggctgtggttcccactgatccacattagactccaaatgacaacaccctcacaatcccatgaaattgagcagaatttctcttctttcttgtgatgtttccagaaatgaagagagagggaaggaagacacagactctgatctttggcttcactttggttccaagacctggagctgatagtgtatggagggttgcctgtttgtccaggcactatgaataagaccaaggtaatccagcccaactctacgacacagctaagccaacaagcagctggatcttgtgtctcagcactcacagaaatgtataaatcatctgataccaactgctccccggaagcctctgtctccagaatataaatgtccaactacaggactggcaaagaaaccaagccctgggcaatgcctactatggacccttatttcttgtggtttgctaagaaaaaagtaggcccaagggagaggagggggaaaaccaggagggtctaaagttcttctgactgaaagaaaagaccacatcagagagaaagaaaggaatcagttaagtaataaaaggttgtgagttgatttatcattcaactaaacaaattatcttcctacacaaacattctgaggattaagtgaacaatataatacttttctgagctctttttgatcaaatgctttgctgttaaaggttatattcctagggagttgatactgaagcttcttgttccttgtcagtaaacacaaggagaggccaaccctctgtaaatttaaattacataaaacctttccccaaactgtctggtctcctaacagccccttttcactgaactctgtggttatggaatgtaagtatctttatcacagcagcacagacttttgaaaatttgacataatagaatttcttcctcacaaggcatatcaaacaccattgcaaactagtgggatttttaatcaagactaaagcagaggtcttttatttgtttgtttgtgcttagattatttccacatgaccaataaaatgttctctctgaccatcatccctgctgactagaagtaccaggaaccttgtctcaccctcacctccagaggtaagggtatgaacggactgtgaaaaaacacagcagaacactggggtcagcagagagaaagcgaaagaaccccatgggcagataatctaaaagcagcagagaatcaacgggaaactaacacaagtgcctgaagatggagacagcaatttttagtgattttggcttgtctctgttctatgaagctccaactcagtggcaacctagtgtgaaaatttatgaaatacttttggatttatctctgtaattccaggtctggcacaatataggtttcttgaatgaataaatggatgaacatgtcaatcaatgaatgaacagtaatattaaggaggggaagaaaaccattacaggtcaatgaatgggttcctagaagattcccctgtctcccattgtcttccgactcagggagacaacagctggagcagagtgcctagacttcgggggcttaggaggccacacatcttagagagcatttcaccatcaactgcaattcctttggcagtttgaattataatatttacttccatgatacagtcttcagctgttgtaactgctagtgacccttctctgaatccctacttcgtatgttagacattttttatatggagaattaatacagccttgactgctatgcttcttttttacttccatctctaataataagatcctcaagggtcgagactgtcatactcttgttttttgtgtttacttcactgcatatcctagagctgagtacatatggaagaatgaatcaattgatgaaatttatgaacacatgctgaggtttaaagagaatatcaactgcttggtttgatgacaaaaagcaacatcactctgtgtctagcacgtagcccagaggtgcgggccccatcctctcgtgtgaggagcccacggtgatgcataggcacctgcaccccgtgcctaaaccctgcagctggcacgggccctgtctgctcttcattcaccgttctcacgagttgcaataagttcagccctccatgtcacactgtgttttccatcctggggagtgtttcacagctatcccaagccccacgctgacgaatcacggccgaaaacacactctgatgccagcacagaccacggagcaaatgtcagacaagatcagcctcggaaaagtgagtcctgaattgcgatggaagtgggcttcctctcacaaggactttgtgtggagatgcgcaggtgggctgttggaaaagacccatggaattcccttcctctgggtgccttttctgtcccaacctctggggattcctcaagaatcggggggatttcagcacggagtgtgggactctgtctgccccaagatcagaggattcaccttggcttttggaaagaactgcccagtgtatcaggtttttatgagtcagttttagagttgggaatgcggacagatttgtaagaaagtccacagagcatatctctccacagcggagaaggctctcgagccccagaaggcaatatcacggtggcctaggtggatgtcacggggtgagaatcaaccctcagttgccacgaggaatctgaggagatccaggattacggtttttatgtaactgtcttacctctgtttcacaagggccaaaacttcagccccgttataaaatcaacagatgcagaaaagagacaagtggccactagatggcagcagatggtaagaaacgtgagttgcaggcgggctgggcaagagttaggctggaagcccctccattttgctttacatctttaatgagatatgtgaagaaaattagtcccttacatgccagacgcagatgccacagcatatggagagatgccgcacagcaatatttctctggttattaaacaggaggcacctaaccagtcattcactgcatcatcatgcagagttatcctttaggtctccggatactgttgttgacaaggtaataacagaagaaagcagttgagaagactgatgtcgggacgtgggcctctgggctcgtgggacttcaccatgccaggggatggggcacattgccagaaaatgaggagcagcccactggggccacttttccgtggccagggggacactgtggcttctgctgccaggcttagtcccagcaggcgtctgctgctctctggtccccctggcagccctcgggggctcatttattcagaagccccattaccgcgagacaattctgcggtctgacctttcaccacaaatcccaaatgggaaagggagctctgggaattttaaagagcaaaccacacttgcttctccagcaaaattgaaaagatacagcataactagagtgcattcaggtgcacatagatagggaaacacggtttccatgctgccccaaacaaaaggagggagtccagtcctgccgactgcaggaaacagcctcactcggaagacacactttttcttgggagagtgttcccaggtccagagcaggcagggattgcgcccacttccccacttctcacacttttctccaaccccaccactcagtctgactattcctttatttaattcttccacactcccaaacccaggggcttcataaggccttcagggtagctgaggaacagagaacagattattcagtccaggcaactagtccctgtctcaggcccaacaagaaactgttatcttattaacctgaaagcccagaactctcaggacttctcagagtcactcatgaagccccttaacagtcctgaaatgaagataaataatacagccatttttcgtacagagaaactgaggtataaaactgagatcagctgcagctctcctggtccccattgctttcccacagattcaaccctctgaagcatcctccagtgaaaatgtagtagcaagattcaccctaccaggatttctctccccctcttagaaaattacttcctgcgctagaaatcctcacttgtctgtgtgactttagacaactcgcttaacctctctgtgcctcacttatcatctgtaatttgagggactagaaccagatgatgactaaggcccattccagctcacagtcttgtggctaatttcccagtcctctgccagccctcaaagagagtcgtatgggacactttttccagcaacagccaaactcaacaggagcaagcagaatttccttctccaattgagaagcaatggggtggtggttggagtcttgttgatgtcctttgtccttggagtgaggcaaacagtgaggcttcagatgttattggcactaacagcagggcctggaggtggccacactcttgtggaaggaccatgcagagctgtccctgtgggcagtgtaggtgcatagccaagactgagggatgttttaataactacttctcaataagaagacctattttattctgcacaggggtgtggacccaatccaggtctcccaggaggaatctactctcacccataataggggattggttcagctcagctgcgctcacaaagggctatacagcatgcagcagtacaggcagctccccgcagctccatgtgaaaatgactcacagcagttatgaacatcaaacctcctttgatgtgttcccagacatgaagaacagccacgggaggaggagacggactctggttgctagctctgtggggtggcgcacagagggcctggacacatctggtaccatcctgaagctccaggagaaattcaggctgggtaattacctaggacttcctaggataacagagcttcctttcatctatctctctccctccctctcactgtctttctgtctccagctacaagggaattagattctccaaggaattacaacctgtttctgtaccttcacctttcccgaggagataacaattcacatccctgaataaaagttgttttattgagcacaaaatgaatgcacccccctcgctcagcatctgtgccaattgccttaaagctatagacctggcctccatcagccaagtgaaaggattttcctctgtcatggccatttccagactctcagccttttgagtagccacatggtaccttgtcctcctaataggctctcaatgatgattgaatacaaaggctctaattctctgttgcattggcagctcccaagactgggtcgatcacaatcgtccacagcagaagacagcggtgctgacggtcaaatgagcatcagggcacacagcagaaggggagggtcagccactgtcccttcatgcccatttcaacagaaagcttatttatatgcaagaggtgttccccttccagacagggttcaagagcacattggtccctggaaacttgagcaaagtcttcacggttatagaagggagtggcaaaggacatgtaggagagaatcagttccaccccatgcctgcacatttcattttctgaaatgaaaagctctcatacactcacagagatctgcacatacccacacatggaaatagcataaacagctactctttactgagcagtgaccacgtgtcaggcacaatgcctcgggcttcacatgcatcatctctaatcctcatcgacgttctgggtgtgggagtgagggcatccctgttttatggatgaggaacctaaggtcagaaaggctaagaaactttcttaagattgaacaactatggtagaagagctacaattctagatggttggattccaaagcatcatctcttaaccactgtactatggggcaatatgcttataagcaagtgcttactctgttggaggcactggggttatgagatagtgcaggaaagacatagttattcacttcgcaaagcttcatttttaccgcacactcatgcacacagtgctacacacacacatgcagagttactataactgtggtgtcttccaagagccctgtcactaaggtatcctcagtgtcgtactctcagtcctcctgcacttgaaccacagtttgaattgtgcatagggtaaagactgaggtcttctacagaaaggcctaagctgcttgaactttacagacaattatgtgagcaattcaaccttttatacattatgctgtagttacccagctcctgaactagtcatcaggtattttatttgttttttaacgtgatcaggaagtttctctgactcatttctctatctttgcagaggaacaaggtaggagagcaacaggggcaggaacagagaggatgtcaagcttgatgaaggttcagtaagtcaagtcataggtcaactagaagaaataaagcaggggaagatttggggtggggctgaagctccattgtttccatgacaccataagataagtggtgatctaggtgatctaggtgtgcaaaggtgaaacaaaacgaaagacgcaaacattgtactagtttcaggttttgccaagagcagattggctgccaaggctacttcagccttgactcatatagatccatgatctgggaggcaagacagcgtcctgctgtgctggacatctcagtgacattgacccaactgggggaactccctgaggttaagaaaacctccctccaaggctgagttaatgaactacctagatgtaagacaggagactgaaaccatttaagtcccaggaaaaatgcagacttaccttcttatgacctagatctctttgcaaatctaatgaaaaaggtttgttatgcacaaatgtttccctccaattttatttcaggagatttgtgctctttcctggactgcccctgaacctggaggtaataattctagatcaaagtctccctagaaccttgtaaagggtggactgagaagactggatatacagctctaggcaaccagtcctccactgccaccaccatgctttctaatctccaggggagcctggtcatcttgctggacaattgctgtttctcctgacaaaatccaagttaggaaactgacagggtctttgtttctatttctctctatgcctatctctcaaggtgccctgtcattaatgaatcttaatcctcacttttatttctcaactctggctcccaatttctgttttcccacccctcatctgggggagccaccggaaccccctcattaatccacagacagccatctcaggacttcatgctaagaattcattgtttcccactttcctgcatttgaacactggagggcaatgctggaccagccaaagcactctaggtgctccgctccatctttgtctcaaccttgcctgtcatttcaggaagcagcctctggttggaagccaaaaccaaggaccagtggagcgcccataggctagcagaacagctaggtctattacagcatctcccccacacgggatcataggaataaaaggtagctcacggaaaagcacatctggtttcatgggtgacacaatcccctgggaaagaaactgagcggggtgcttgcctaactgtgtcattaaccagaaacaatctgtgtctctgactaggggatgcagattcctacctgtcttcactcactcagatgtaagcccctggagggtaatgtcttagtaaggtctgcattcctgtagcaagcacagtgtttggcaacaaatacttgctggatgaataaatggatgaatgcgtgtatggatacatatgtataaaatggaactggccattttcagatttgttgttgttttctagctcttatgacacccaaagtttaaatcattaatcagttgctgagcattcttagtcttaaagacaactaaggatggtcaggtggttaattaaatcagtggttgtcattgtacaaatgttatttcaaacaccacttcaagagtttcaggtctcttatttttaggaagtccttcattgtgtcatccatgtgtcctcagacctcaccagcctgtggattacaaaatacagacactatttcattaatattcaatttacaagaacctgcgggctcatcatgtggaatattgagtatccgtgatgtccccaagtgatttgtgggcatttcatgtgccacagtgggtccccacggggcttgacagttccatggagccagagctcttcttcaggccatctttcatcatcttgtgagacttttctccaggctgctctcccctctaccttcaccacaatggatcccatgtcaggtggacatggtctactctcttaatcattcaaagcactgctaaatgtttgaggaagaaagaagagcacattttgagacccaaaacccaacttgagactctttctacctccaggcaggcttacgcatagcaaagaccagctcaaggcgcccggtagaagtctgcaggcatctccatatctccaagtgcagagagcagaggagattttttcttctcagttcaagactagttcttttcctgccctgggatgattgacagtgagaaaaaacatttcctccagggaagcgctctacctgcccctccaccttctcagacggggcccgaccttcatgaccctgacaaagcaaacctggtgctcaactgtcttattagatcttctaacactatgtgtgtgacatcaacagccctaactaaattcacacttgggaaaaatatgcccctcattctaactaaacagacaccatttaattttcctaacagaacacttactattttgacgcacgacacctgttttcagttttatgataacttcataatctccaatacaatgagtgagtgtttatttgaaatgagaataacctcattctcaactagttttctcaacagaagaagagtgctcaaagttcatctagggtctttacctacagaaattcaatgctgtcagcaatcttcaaggagcagctctgccaaaggaaaaagaaagaaagaaaaaaggaaatcctgcttttataagttatccctattattaaaatttctaacaaatctctccctacagttcaaacctaggtccccagagtatatgggcctcatccttctcataaaaatgctgttaaaaaaaaaaggtgtcctttgacacctttcctgagtgcaaacagagattgaaaaaaatcattctaaaataacatttttctgtcactgcccaatgggaggtgagttgatcataggtgaagcatgtcctattagtatgtcttgctcaggatgcctttggtgtgagtaagggatgggtttctagggcaaaatctctgttctatacccgcaaaaaacaatgtacagaaatttccctaagagaggagattggcagtcaatacataagactccataggcaggaagtgtccagggtcagctccctgcattcaaatacagacctgcatcagggctgtgatttccaggtccaaggctcggtgagtggataatgcctaaggcctgatgccaggcctgatgtccaggtttaacactgatggcaggccacagaccctcctgtcttgggattccaaaaagcccagaatctttcccagttcctactgacactaacttttgcccgggcaagaagtgtctgagattgcttcccttgagaccatagtcctttcttataattccaaaactaagcagccctgtttatgctgctgtggcagagcatggaatcttggttagtccttccaaactgcacccattgggttatccctggggaaatgatcacattacgttactttgttgaacactgaggactccaataaggactgtgaatcccaactatttctggtgtgggagccagggctttcaggtcattcaccagaaattatccaaccagaaaactttctttcaagttctgttcaaagtccagcagtttgcatacaggattcagatgagacttctaagaatcatctgtgtcttggatagagcaccctggcagcctcttgaaaatcaattccctaagaaacctatcttttagaagtggaccttcacaaagccagtgagagaatgggaggagtatgtggtttccaatgggagacatatatagacttttatgtcatgaatttctgaagtcagaccgtgacaaatgttggtcagagtacaatgcacagttgcccaaaggaggggaaattagcttggttcaggaggactaggaaatcctccccatggaagttttagttaaagtgacttaaaggatgaatgattttgacaaatgagggattggagaaggacatggcgggcagagggagtacagcttgagcaatgtccaggagggatatagaactgtgcttggggaacagtgatcacttggtgagagttgagtctgcctgagttggggcagtggagtggtgggagtggtgggctgtggcttgactgagaaagcttttgtgaatcacattaagggactagattctgttatatgggaaatgggcagaaatcacaggcatataagaggaaatgtgcttcgaagagtgcttggaaagattactatgggtgggaagactggttccaagaccggaaacaatgagatcagatgtaaagttaatacgaaactgaggtagacattgagaaggatcagaaggacttggaaagagaaaacagatttaagaaacacctcaaaaatagataaatgatatgtgggaatgaaagaaaagggagagattgtctcttcccgacatcctggctatgtactggaagattccctagttcccaagccccaaggtcttaccattagaaatcagtccttactcatttgtccattaaggcttaaggtgtcaatccttccaggaatgcttttatgtttctatggtccaaaggcttaatctccagtggcagaatgccaggtaccaatagaggagatttgggggcagtggtcttctcgggaccctcaaaaatcattacatagttgcccactcctcttatttataaagctgttcgtgtgaataagcacccaactactttgtctgtgcccatttgatcactgattgaataagaaataaaagccaaacatctatattctttttcttctctgaataatcttttcccctgtcttcagatttggaacaaggaaacccagatccagggaaaatattctaaatccttgacctccctatccagttggcactccagcccagtaaaatggcttcaagtacaacattcccccaacagcgaagacagccttcctgggagtcttgggtaggcctgtccagggccaccgtgcagcacacatacatcttcccaaccagctccactgtcacaaacaccatccacactgccatgggcaagcctctggccaccaatgccaccccacctgctctggtgtgggcacacctacagccatgccaccaacactcctcgtgcacatgtctatggtgtatctgtgcagtcacagttgtcaccagctcaattctgtgtaaccctaagtccaggcatcttggggtgaatgtctccttattcctttgtccattgtcctgctctccctttaaaattgttcatgagtgtattttgcagaaagatatgtgatcttgaaagacagagaaggaaagagatgaagtaggagagtggcaggggtgggggtacagattttgagaaaggcaagaaaaaagaaaggttccttgacctccatcagtcccaactcccaaaataagactggccctaaagatagcttattatttatcccaaattaaaattttatggctctgcaatcattgtgtacacagtgaaaagaaaaccatcacacaaaagatgcagttatcctcacagtgggaacaatagcagccaagctgattctgctccaagaatagaataacagtgctaagtcaggaactccaaaactttgtcaacaaatagaataatttcttggtgggaaaatggctatgaaagaaggtgggcaggaaagcaaccttctgactcttgaactgggcatgggttgccagggaaaattccagccttggtccctccatagtgagctcacaaccagctctgctgactggggaaaagtcctgcctgaatatgcacagactccagaaggccctcaccttacccttgcccagaatcatatacagaatctaacaggctgtacctgcttctcttgcctaaagttatgcatcattaccagatttccagctccatgatggcagaaatttcagctgatttttttttccattgtatcctcagcattcagcagaaggtttgtatatacttggcactcaataaacacttgctgaatgaacggttgattgattaatcaattaattgattaatttaaaatgagcaaaatactttctccctgtctggcttctgaagagtgagtctgagtactagaaactgtcagataggcaatagaagccacagtccacttggaaaaatgactgtttctacctttgctcatccttctgggcatcttagattcctgaaattcaggaacaaggacccaagagatcatgacccaccaagtgtctttcaacaaaagactattttcctggctgtttcctttcagagaataagcctcctggggctgataagcgaatggcaccatatgctgaaaacacaggccctgagtggcagagggcaccagagcctcctctgaggagcctgttggattgcagcctttcaacaaatctgagtgtgtcttttgatagcatcagcatcaaccacccccaaggacctctttcttttattgcttcagcaatgaagcaaccacatggctgttgtagataaggtggctcaagtgcattgtgcatgcaatgtaggctgctggtgcacagcactgagaatcgcagacacgccgtgtaccagcttctctacactgcgttgcccttcctctgtaagtggcccccaggtaaacgggtgtgattccccaccacttctcatttctcattttctatcatttttttctttgccagatggctcctgcaagactgaaatcacacagccttccaacatggccacaatgattgggacagatgtcaagttccaacgctaatataacattcctgatgggaattatgattctttgtgctggcatctgcaaagagctaaccaaaggtttacctatatctgctatcctttcaaggcaccctggaatcagagcactgctagttgtctgtggacagaaaattgttctccagaacccgaatccttaagcatgtgcagccaagagactgagccatttactgctgtgcactgtgggcaccattatgcatgctggatatcacactgaacaaacactgtaagcctcaagcagcctcaacacagaaaattcaaaagatccaccaacaacacacagggtgtttagtgtcatcttaaacttgcatcttgaatgcatcatcgattcattcattccaaactaaaagtcccttaaggctttcaaattgatgtactgagtattgtgaaggataccaacatatataacaaacacttctcaaataataaaatgtattcagcaggtacaatctcctcacttttatgttgctaaaccatgagaaattaaaattaaatcctgtataattacttgaatcttccagctgacaaataaaagtagtctttgatacacagaaggacaaatgaattgcacacacatacaaaattaaggccagcaattaacatcttaatgacatacccttaacttaccaacatttctaaaagcctggaaaaatattaaatatctatgtatacatgatatgtacagtaaatttatagatagatgatagatgaatggatacatagacaggcaagctgtaagaagcatcataaaaggactgagctcaagttcagactttaaagccagacttcttgagttttgaattccagaccttccatttactgactcaatagctatgtgaccttgggcaatttactttttgccttgctttcctcatctataaaataatgattacaataacacctacctcaggggattgttgcaggaattaagtgacctatagcacatgttactgtattcagagcaaagcttggaacatgaaaagcactcagtgagtattaactacttttgcttttgagtgtgataatatcctgaggatgattactaaatttcccctgtgttgggctgggttgagcctttaggaagttgttgataagaaatgtcagtctcttgaacaattaaacattattttctacattagtatcctatctagtaagaagtaaatatcaatggaaattcagagaaatacaattcaaaaggccttcaggacctttttcctggatggcaataaattattgagggcttcctatgtagaaaaaaaaaaaacagaggaaagtaatttctgcttgaccatcataaaataagcaaatataggctttgcgagatattaaaatacaacagtaaccccactcattaaatgaatagaatagtggaataatgtataaatttaaagccaaaagtaaaattaaagttgtttatgcacatatttttgaagtaaaatatttgtcctatcaacataaaaggcatagtagatgacctgaaaaagtttccacctccaagaagataacaaatcaagtcaaagtcacagtatgcctgacgttgtgtcatcctcaaaaactgggaagtcaggatcagtccaagactccagaagtgaggaggctctaaaagacacctccacttcagcctctgcttattcaaggccccagccatggaaactcgatggtgtgaactgctgagctgagaactgggggtaagtgaggactgtcttctctgttttcttttctgaagatgcagggtctcctgctaattcggattctgtgttttattcattagtgggaacacaaatcccctgctatcttgctagctttctcatttgcagccaacatatgggtttatcagcacggttagccccccaagaacagcccttcagggacatgggataacacaaaatgggaaattcttcttggaataaagagttggggaaggatcctttgtaaaatttggttttggggtcagatttcaaagtcttaaccctcatgggacaggcagagactcggggatatttggtgagtgactgagtccctattcctcctgagcttgcccttccccagggcacctcagagccagaactgctgaatgttaacatggggcactcaggtttcctacaggacacttacaactctggtaaccctgctgtatactctgccagtaaggaactacttagtaattcctccgagagccaacattcaaagactaatgccacgtcacatgcaatagggaaatgcagctctatctgtcattcacatctctgattctgtcattcattactccatgctaaaagtcccagtgggagaaattgtctttcttctttttcaaaaccagcttctactgaaggtaaagaaaagtttaggggtagaagaacaaagtcattacagaaccatgcattgattggtgagcactgcccaggggcaggttttgtggtaatgatccataagaagcaagcaaaattatggtggagtcgatggaatatttgagagtctctgccccaaccatctcataatcgaactgggagccctccaatctccccatgcaagccttggaggacagtcatagaagaaaaagtgagcaagaaggtttaactagctaacaagtgttcatcaagtatccataaatctcagggtacagaagtggcatttttgtattcaatcatgtatatattagtgtttgctatgtgctgtatcccatgccaagaaccaagccttcttccactgtgtaactcataccgtagcagggcttacagtctaatagaggacccaaatcagatgcttgtggaaacaagagaaatacttggttgtaataattatgggggtgttccaggaggaaagtacagattgaaattagaatatttcaatttcaggatgagttaggtgatgggagccaagaagacatgctaaaggaattaaatcctgagctgagactagatatgaaaaagtttgtttatttacatcccaagttcccaagtcagtaacagaagcagaattacaactcgagaaaggccccacttgcttctatgctgttttgctcagcagctgcttcctttggtggcacacagctgggaaagtgagtcacagatggactattggcagccaaaatttttttagagacaaatgacactgtgatttttcctgacacccattgaaattcctcactaatttccaaaaatatcttatgttgttttaaaacatccagtgaggcccagacatttcagtagaacaaatcagagaaacgaagttaattccagccatctgagcattctgagcccaaatcagctagactgagaagaagaatcgtttacttaccgaaggcagtcccaggacacccagcagctaaggtcctgactcacagcattctaaccaagagaaaacacaaacacagcatcttctcttttcattcacttctgttcctgttcttcagttgcttgtccaaccagctggagacacagcagagaaaccagaaagcaaagaaagcaattaggaacaggagaaacagctgataagcactctgcctaggtagaggtgaatcctgggcacccatcagggaaagactttgccattactaaggctttaggtgaggagtttgagggttacgaataagagataaagcaaggaaagggcttttctttgccaaatttatctttttttcacccataaaactcaaagaggatagggaaagaatgaatgtattctcaaatcaaaggaaaaatagttctaaaacttccaatgagtgagaaaatcagaagttctggcactgactcccatttatattgaagtaatactatgggtaaatattttatatcaaagaccccagagtggcagagaccatcagagaatggcattaaactgggcacgcatagtagccgatatggggttaatttgatttgaccttggcatcttttctcttcttaaagtcctcccatcctttctttatcctgtatagacaaagaagactggggtctaacttttatgtgtcttccatcctaagctgccagagacagtcctttgccaaagggcacagtagattgatactgcccatatgtctctgacacggctccactcagctcattcatttatctacccaagtcctacggcagcctaacatggctcaacagactgctgtttccctcagaggaatgttctgtgccagccttgaaataacaagttctgtgtctctcctggtaactatggctcaggcagggggctatgaccaggtcactaaccccaccatggcaaagaagaaaagacaaggcaaagaagccaatatctgtggagggcttacaaatgagtacctggcacaggaataagcccttcacaagtgttctctcatttcaacctcacagcatccctgcaaggtaactataattaccccatttgcaaataaggaaatcaagactcagagttgtaatttgtcccgctactggtaagtcacaaagcaagattcaaaaccatgggctagtagacctgcaaagtcagtgctccatttacatgtaggtaatatgggcactgataccacctaggcagtgagccacaagctattacaagcaggttctatccaagtgggaggaaccttgctctaggtacctagcaggttctatccaagtgggaggtaccacctgctgcagagtgccccacttctccctgcacctaaaacagtggataaaagacctggatttcccatgttttatcctgagttgctggcaaattctttcctaatctcagtcttcactagataagcaaccaaccctcttggttccttgagagttggggcgtctagaaatcctgcctggactagcaaatatctgtgagttcctaatattgaccagctctgcactggacattaggaatgcaaatataaataaggtactgtttatgttctaagtactcttaaagttcaatgcaggaaacaaacagattatcagagaatagaggtgataagtgtcatggcccaacatggcagggggccaggggaacgcctccctcaggtggagttaaagaagggagaagaaggatggtatggcttttccaggaagaaggagaagccagtgtaaaaactgagcatctggaagtctatgacacatctttgaacctgcaagtattttatgtggctaaagtgttgaacacaacactttcctacatctaaaatgtgcaccacacctgagatgaggctgcccgatcattccaacagtaacatctgataaaagaggccaggagttgaagtgggggcaaggggcttatctttgcagttggcttagaggggccttctttatcagttgaagagggcaggaaaggctgttaggatttttgtggagagatgttgggggtggggggtggggtgctgcacctgtctctcacaggctcctgaagaaaggttgaaaataacagcttttaatactgaataggccctctcattgtggaggcaggctgagataaacaggacttttactatcatgagtgctgtagctcattgcagtctttattgtgaaagtgttcatgtgcataagtcagataaagcaaggatggttttccattaccatcctaatcaaaatttccaaagcttttagagatagctttaattcttactctgtgaagaaggatgaatagagtcattttctgaaatgtttccacaactatttcaggtattgagtgttttatatcttcccttagctgccgaagagtcctggggatccgtaggggtgagcaggaaggggaaatgcacaggcttccttcatgccagttgctgagagagagcttagagacaaatacctgtggtaatgtggaatttctgagttgagcatgggtcaactaaattaaaataaaaatttttattcccaagtctcaagttgaaatgggtaagccaagaaggtctgagaccgcagggagaaaactcctggaggaatccactaaggagacaagtaggcagaggcgcttaaagatacaaacattaaacactcacccagggaatgccttcatcctgttggctctctttgttctgctcaaatatctgtctggcatcctctctccacctaaggttaaaaatcgggcattaggacacagagtagacataacgtaaaaattacaactaaaagtcaaccctcctgatatcttctattcaacatttcttccagtgcactattatcttcatcacatattttttatagggtacttactgttcgtggtattggaatgggtcatgggaatagcaaagttctaaggcaagttctattcaaagttctattctcaccaatgtgttttccatttatttttaaaagacagggcattagaaagtacaattaaagattacaaagaatacaaaaatataacggcacatatgataatgagggttagtgatttcatgtgcagtgctctaggagtttatgaaaggaccaattgctataagaaaatttcttaggttcgagactgcagtgagctatcgtcacatcactgcactctagcctgggtgaaagagtgagaccctgactcaaaaaaaagaagagaaatgttttttaaaaccttttttgcttttgtaaaaaaaatttatttgtatatacttagtgcaagcgcaaatttcttacttgcatatgttgcatagaggtgaagcttgggcttttagtgtacccatcacccaaatagtaaccattgtacccaataggtaatttttcaaccctcactcccctcccacctcccgacctattggagttttcagtgtctattattctactctgcatgtccatgtgtacacatcgtttagcccccacttataagtgagaacacacagtatttaactttctatttctaggaaattttacttaggataatgaccttcagttccatccatgttgctgcaaaatatattatttcattctttttcatagctgtttagtatatataccacattaagaaaattgtcttagaatagctgaagcttaaaagaggcaggagttggataagcaggaaggaaaaggaagggtatttcagggtgggtatactagttatctattgtcacatacaaatcacttcagaacttagaggctcagaacaacatttattatctcagtttccgtgggtcaaaaaatccaagtgtggcttagctgcatcctctggctcaaggtctctcatcaggctgccatcaaagtgttacctagggctgtagtcagctaaaggctcaactggaataagatacacttcgagttcactcatgtggatgttgacaggctgatatggtttgggtgtgtgttccatccagatctcatgtttaaatgtaattcccagtgttggaggtgggacctagttgaaggcactggttcatgggagaagatcccttatgaatggtttagctccatccccttggtgatgaatgagttctcgctctattagttcatgagcgagctgatcatttaaaatgagcctggtacctcctcctctctctctcttgctccctctctcaccatgtgacatgtgcccaggctctcctgccctgactacagagaaatggacattagatgtggtcaaggcatctctagagcaatggttctcaactctatccacatatttgaatcacctggggatatcctttgaaaatactagtgtctgggatacatctccagagattttgattgatttggtgtgggcttgaagctctggcttaccagatgactcaacctccttcccctcctcttgctcttccctccccctggggttgaaagcaactggcttaagaccttgctattccaagtgtagtctagacaaacacaatcagcatcacctggaaggttttgagaatgcagaatctcgtgcaccatcccagatccactgaatcagaatctgcattttaaacaagactccccaggtaaattatatgcatattaatgtttgagaagcactggtctaggcattcgtcattattgaaaacgttcatggaggtaaaaaaaaaaataaatcactctttcccaaatgtcacccaagaatccatacttgtaaaaaatctcctgaagggatactgatgtgccgccagggctcactgataggcagtcagtcatccccagttcagtttacagattatttgtgttactaccaatataataaatattcttattggggtgatagtgagtccttgtatgcttcttagaggaaggtattacataaattctaggttttatcatttctcattcatccacaagcaaataaggaagtggattaatatttactgagtcaatatactttttaccacaccacgatggattatccatggaaacccagaatcttgtgccacataccttcaattcaagatcaagccaaaaaaaaagatccacaaattattggtgtctgattaagtctgattgggaagaagaggaacaggagacacaagaatgtgtgcgtccagtggtccaatcctgcaggatgaatgaggacatgaagttctggcccgtgatggattggggtaatgtagaaccagaggttggcctggggtgagcatgaaaaatagcctagagacaaggaggaggaaatcctgggagaaaatacctggactgcccaacaatctgagggtctgcgcacaatgaaaaaagaaaccagacaaaaattaaagtaaaaaacctggagaaatttaaataattcctgtgcttactagcaggtaattaaggaagcattttatgtaacatctgaagcctcagatttagggggagacagggccactgaaggccctagcatagtaagggcatggaccaagtttctctgcagaaatcccgaagccaaatgagcgatatgaacacccactattatttttgtattattcattttctttttttctttctttctttttttttttgaaacggagtctcattctgtcacccaggctggagtgcagtggcgtgttctcagcctaccataccctcctccttccaggttcaagcaattcttctgactcagcctcccgaatagctggaattacaggcacccactaccacgcctggctaatttttgtatttttagtagagacggggtttcgccatgttggccagtctggtctcgaactcctgacctcaggcgaatcgcctgcctcagcctcccaaagtgctgggataacaggcgtgagccaccgtgaccagcctgtattgttaattttcttccccctccactggtaaggacaattgagagttgactaaattcttattattgttgcctccactgttctgctttctgtgattcttatccatcatgagaagggctgacttggaagagttcagagcagtgaagagaaatcccagagagtgtctgccaacactcaaaaagactttgaatttgatgtcagaataggaataggcttgccactctcaccagcctcccaagaagagtcattgggcaggctggatggctagaaaaagaagatacctgtctgacgcccaaaggcagctagaaggcatcctggcttcaggaacagtgccatcacctggctgccctcacaaagaggtcatccaacattgtgaaaccatgactatgagtgaaaggcaagagaaaataagggaatctgaaaccatgtgaatatgccacttcctctgcatcacgggacaccagagacgggcaacgaagagaatgttacttctatcatataacacattctcgattcggaaggtgccacagccttgagaaagtcctcattacaccatcttgaaagctctcagggatgatataggtagggtccaaataagaaaatggactcaaggaaatccaaattgtgaccttcactttgaacaattaaaattttaaacagaaaattagaatcgttgaatttgaaatccagaaaggatcttaaaaacaaagtaggaatcccctcattcagtttaaatgttcactaaatattgaatgagtaagtgatcacccagcctcaattcaaatattttcaatgacaattcttgtttcaaaaaatctgtcctataccaaatcaaaatttgcctcccataacttcatatctttatatttgttatgccttccagagcaacgcagactaagttcaccttcgcatattcaaatatttaaagatagctatcctgtataaccattcctcatgactgtctaataaattttaaactccttgagagaagcatccaagttcaatatattttcctgtaccaatgcaattcttaatagagtgactcatctgtagcgggtagtcagcaaatgtgagttgaatacatgaattaatatctatgtgtccacctgaccaacagttctactcgggtgtctcaaaggcacttcagctcaactccaagacttaaatcaagatcttccttgcaaatatggccctagcctaagattccctatctgaaggaataacaccatcatttcaaacccatccactgctctccatccactgccaccagccaggtcaaaactaccattttcttctttggattgtttctatagccttttgagtaagttagccggcctctggtactattcagtatctcctccccacagcagccagagtgatctctccaaaatacaaatatgatcatgtcatgcccctgattaaaaatccttcagtaacttcccattgcagataggcaaatgaccaaaatccctaaaagtcctctaagaccttgcacagtctgactcctcacctcttctgccatacctctcactcttctctccctcattttccaaacatgccttcttccagctattaaatacttgaatgtaccgggtgccttcccaccccagggtctttgcaacacttctcccactcctcatcccctgtttaactcctattgaaaggagttaaacaaaaaagatcaaagcctacacatccgcttttcagaggcatcttgagatctcctaacaagttcaggttgtttattctttaacgctttcatatatcagtttgtaatattttattaatttgattatgcctattttctcatgagtctgtaagctctggagatcaaggactatatctgcatttgcttattcaacctgacaaatcgcataaacatagctgtgtgaataaatgaatgaatttcccacattctgggacttcccagaatttgatcatcatcacagactctgggctgcagtggggcctcaagccttgccatattctcactttttaggggtctcggagactccagtgtcatcctgagctggagtccaaggcttcttagaaaccactgatttctactcattctgtctggcatactcaagagcccattcttgggcacacaggacaactgaacaggattggagggtccttcataggtctgagccagctcccacatagggaccctgaacaggtaagtaaaacctgcccagagagtctagctagacatgaagaaatcagaggggcccaaaatgattattattttctcagtgactactggctgggcttatgatgatccctcttggtgtttttcattttgcatggctattttcagtagctgtatcattaaaatacacaagtctataattatggggatgcatatcctcatccctcaaatatgtactgagcacgcacaatattcctggtcctgtgccacacgctcggttacaaaggcagccaaagctcaattcctgtcctcaaggtgctcttcctagtggaagaaacagacatgaaaatagaaacttactaacagagaaaggagcaaaccaaacacagagaaggaagtgatggcctagagatggggagggcgtctcagaggaggtgacacgggctcataacagaaaaagcacttgtttccccgaggtaaggtgtgcttgcaggttccttaagatgacccaggagggaagatgagcatcctcaacagttacacacaaacacactcaccttcatctctgatgcttgcagtgaaaataaataactgaaaataggcccaacgtgctgtctcatgcctgtaatcccaacactttttttctttgtttgtttgtttgtttgtttgtttttaatcccaacactttgagatgccaatatgggaggattgcttgggcccaggagttcaagaccagcctgggcgacaaagcaagaccccatctctattaaaataaaaagaaaacataaaatattgaaaaacagccaaaaatatgctgaaaaccaccatggcacatgtatacctatgtaacaaacctgcacactctgcacttgtatcctggaacttaaagtaaaataaaaaatttttaaattaaaaaaatgaaactaaataaactgaaattttatggaaaaatacaaaaccccagactagacacaatcagcttctttttgtgggaaaatgaatttatatcaaagctttcataggggttctataaccacagaatgtagttagttccctgccaagtaaaacttagatacttccaaaatgctgctattgtacacaccgcagaacagagcagccaaaatggtagtggtatgggttgggaagataaagaattaagaaaagtaaagtggaaggggagaggaaaaggagaatattatttccttgaatgatgatcactccttttattaataactttctgttcttattaaagagatgtcccaaacctctgggctttcccagaatttggtaccactggtgcactgacctatcctcatcctgccaatgtgaggaaacccagagagactagtcaaatcccctgcagagcagcaaccacgccagtggggctggctgtgaactttcactttggtgtgttctttgatttcatttggtgtgaaatattgagatttctcctcagatatcccagcgccttgtagctgcactggatctataaatctttatctgggctagattgaaccattttcatttatggagttgtttttaatcagagcaagagtaaaacttttgccctgtacaaaagagtcagctgtaaactgagccattctgcttcagctttcagcttctcctctgaagttgtgtctcttctgagagctctggaataaaacagctgccatagtcatctcacccttccatattttcctctttgtattagtcagctctgctatggtaactaacagtgccaggacctcagtggcttacagcaatgaacatttactttttgttcccacttttactaccaattggctgctgagctctgctccctctgtcttcccattccagagcccaagatgaaagataagccactatttgggacacactttttttttctgacaggatctcactctgttgccgagaggctgaagtgcaatggtgcgatctcagctcactgcagcctcaacctcctgggctcaagcgattctcccacctcagcctcccaagtagctgggactacaggtgtgcatgccaccatacctggctaattttttattttattttattttattttgtagagatggggtttttccatgttgcccaggccagtctcgaactactgggctcaagcagtccacctgccttaaccacccaaagtgctgagattataggcatgagccaccatgcccctccacactgtttttatgacagaagaaaaagaacaagagaaatgctagcagaaactccagatacttcttaaaacttctgctcagacacagcagacattatgtccactcacattcatcagccaaagcccttccatggtcaagcacaagatcaactagtcggggactcacacctttcctgcagaaggcactgcaagacacatagcaatgggtaggaagcaataaccctttttcatggaaagaaggatcaaatacttcagaataataattataacctaccataccctttaactccacccatgtaatttgtctccatcctggggagtttctcctgctgtcaacttaaaaggaatttaaaatgattttttttcttcttggaattcttctggggcaagatttgcccaattattcttcagaatgtcaccatccctcaagatgttaacagtggttgcacaatttaaaagaattccaccatcagataattttggcaaatgctacatattaatagcctcctcttaatatttacaattcttattaccatattaaatgctctgagaacccctgctgtaaagatacctatttaacgtgggattggaatcacagaattctttttgtaatggcacagccattaagacttacgaaattctataggcaaataccgtcccaaaggattacgcaggattcagtcagatagattcctgctgtttcctcatttctgtgcatccagactgaaggatacctaatgacgttgagaggagctatgcataaggccaatgggtctgtacaggcctcaaaaagaaggcttgcattttttgctaagaccaaactcaatgtcagaaacctgaaaatgttattcagatactactctttgtctactgaattaagtataaacacttcagactgtcttttgctccttcctttctttctgcaacaaacgtatcttgagtcctactaggtgccaagtactatgccaggcattgagtacacggtatgagcaaaacagacatgcaccctgccctgtggacttgccagtttaaaataagagagacagacagaagacagggatatgagtaaatagccagtgatcatacaacctcccagtggttagctacaccgttggccacccattcctccttgaaatgctttccacacttagcttctgagatgccactcttggctgattttcctcttcatcactggcttctccttctcagtcccccttgctggctcctcctccactacacagcttctaaatactaaagcagccagggtctatcttctctcctctatctctccctagatgatctcattcaccctcatagcattaatttcacatatgtgcccatgactcccaaatttatatctccagtgcaaaactctcctctgaggatataatcttcccccaattgaaccgccttagcacttcccactcttgagttatttcatgtgttttctcttttgccatgattgttttcatacttccttcatcctcttcctgacttataaacccctcgaggcggggatccttggtctgtttcatcttcagtttccgtagtgcattgcagagtaactgtttaatatatgattattgaatttaatgtttgaactgaatttctgctttagggatcactgagacacagatgtaatgaaagggaatattttatttaaagaaataatgcctcatccttctgtatttccaaatgaacaacctcaaatgagagaacacagctacagacattagcatgaggtgaatacttaagtttaaaaatgctaaatcaagccagtatcatcccttgtggtcacagcagctgctgctgcaaaggttttataaattgcctacattcccgcaccccatctggcgatgctggtgtgttacagccatggatgacttactcttcacaatagccttcacttggatctattccctactttaaaataaaaagacaaaaagaaggtgccaaagggcttgcctaaagtgctcccacccaacaagagtacaattcaaccacataatgctgcctcctcagcatttagaagattagattcagggccaaaggggaggtcagaagaggaaggccccctggtttgcagaaaggtgtttcaccatcagttctaataatagcatgtggcagctgcacttctggtccttcctctgcattttaatcccattattttctaagcctctcccaaggcctcctttaccagtcaaaatcagccaaggtttcatatgcccttagaagaaaagaggactgatagaacctaagtatcaactagagaaaagccaagagcttttcgtgctggatgatccgtctgagtccgggttcctgattgccacacagggaggccctgactatagtgtggacattggttcctttgcatagctccctcttgtgtatacacagaggctgctttttctcatcttgtttgccctaaaacattttttgacttagcctccacatacttgaaacttagagtttaacctgtcaaaatcagagggaaattgactgaattgcatctctttcacgaaaacaaacatcttccaactgccatggcattttagactgccctttctgctagtgttgcttccctattgcatttccctggataaacatctagtttgtgccataatatttattaacaaggagtcctctgggcagacggtggcattaggaatttctgcttggcatttggtatgctgtccagctgagtccccaaccatgttgtgagtcaatgcgaacacagcaggtttcaataaaggcaacagttatctaagcaggctgcagccgtgactctcagctcagcctctgggtcaccaatctgggacgtgagctggcacctcgttaaaaaaggtattctgacagagagatggctgtcagtggactcttccaaaaattctctttccctgggttcttctagtccatctccttggcatgtgccattccctatgcatcttttgttagactacatctctggtttctcaccacagcctggacactgctgatgggctagattgataccgtatgctttgtcatgcaccgtgatcccactcacaatgttattccagtgggatagatgctgagatggttcaccatgcaagaggaatcgtgctgcacgtagtattttctttgccctcctttggtaacttcgcaagttcccacagtcactactcagttatgcacgtgtgctaactcaggctcagactactttgcgattagagccctgccaattggatagcttgtatttctattcaataatcttttcattcactcatactaaacattcattccatagctcaatgttaagagccctttaacttgtcatatacatgatgactataacagcactcgcattctaagctaggctttaacacagcgctacagtggtgattatagaacagccactctgaactgcggcttctctagctgtggtgaatgttataaagaaagtgtatttactctagtccttgcccttttaccagtccccacacactaccaaactcaatataaaccccacataaccagcaagaatatctgaggtgtgcaggttatggcaatgggacagcagcagacgcacagtgggtgaggttcctgggacatgaccaggacactggtttatagtggcccaagctgctgtaagtctaagatcccactcaaatactgtactcactttcccacttgatggtttaggaactcttttctagcccccaaagctacattctgagccactttttttttaaacctacacagctgccttcccaaaagtatcctgcagtaattccatgttcctcctccattgtttcctcgttagctctgactccatgttctggcaatctttcagcctcattcctttttcctcccagtctgtaataaaactaagcaaaaggtagtaggtatattagctcaagaattgggatgtacctgtggaactgttgcgtgatgcaagtttttgtcaatgactatgggagcccctggcacggagggccgggcccaccacccctctcccaagggaaagaggacaagtccccatccatctgtcttctcccctcctctggcatcatagacccaccccagtagatagggtcatctcactgtctcccattggaggtggagtgggggagggtctcactcccagaaatgctcctacagctttctcctctcccttggattgaaggatgaaaggtagttatttgcttccccataggggatgaagcagggagtttccctagggttctgggagggcccacccttgtcaccaccctgtggtgccccaggggtaatcggccaactgaaggaatgtaagatctatataataaaatcttaattccacagaagtatgattccagccacaaaatttaagctctctatagacactaaacactctacatttccataagtcccaccaccaaaggaggagaaaagagcatttatattctctctaacactgcgctatcccctcagcctactcccaaccaagaatcttgagcaaaattctttgctccacttcagaggaggaaagtgggaaatgttttttcctgtgtgcagagactactacaaagagggaggggctcctgttcgggcccatttaaactaattttccatctgctcccaatccaggtttttccagttttacctctttattgggatattgttgaatggaagcacataattaccattattttattttttataaatgggcttctacaaacaaaaacacaggattagtctattattagcatgaaaacctgtgccgtggcttctctgagttctacctggggaccagcacacccccactgtcttccagcgagcagaacaaatcaaagaggatttccagagacagcaataactttacattccacccactgctctccctggggcagcaaatcttcactgtgaaatctgcaattccaggagagcagaaagcaatctatctccctccaaaaacaagttgccatttcagggactggacacattttcactcctaatggtaggtctccttggattactatggtctgccatgagcctgggaattgtaagacaaaaacagaggaaggaaggaaggaaggaaggaaggaaggaaggaaggaaggaaggaagggagggagggagggagggagggagggagggagggagggagggagggagggaaaaagaatgcaaagttgaaatatagcaagaacccattactctatgagtccagtgcgctacaggctgggttccatctcaaacacacacacagtgatgtcccaatgtaaggaatcccaactgaattctacctctcagaagggagctggataggacaaaatttctatctgaaaggtcagagcaggattaggaggagaaaccaagaacacagacttagcccatttcaactagcacagaaggacccagaatgccaggtatgatagcacctaacaaatatttactaagcacccactaagtgcccagcactgttgaaagagatcaagggaacagggagatggttggtgctgacctaagtttgtaagaagtgagcaatcaccaggcagcaaaggtgttgggggtccgcgctggtcatagagaaaggacaaggagcagaagactggccgatcccaatgccacagcaggccctatggtcacaggtgacacctcttccttgtcccctcagtacaacagtgtataagcctttactgtcctacaattcttctttttgttacacagtggctttcaaccctggctgcacatcagaattatctaaggaagttattaaaatcctgttgcccaaaacccaccccagactaatgaaatcagactccgtgggggtggcacctaggcttcagtagttcttaaaactcccccggtggtcccagtgtggggccaagattgaaaaccattgcatggaggtaattgtcctaattacctctccagcttttctctgcctctacattcctcttatctaagctgttatattgcctttttatttttagtttgttctactttgtcctttcagtagataattctataatactccattaaaccttttttcatgctttaactttgttttttctcatttaattttcatcgcccactctacttactccctcttcccattatgtttgttttgttttgtgttttctttaattcagcatcaacatttgcagggcacttgatatggacagagtacggcagcaggcatttaactgctgctaaaaattatatttaacgcagtaatattttgtgttagatcctgtgccgtggctacaggctcttgtcttatggaagattggcactttggcttcttccttggaagtagctgcattgctgtataaatttaagatccaaaataagtatattacaataaaaaataaaagaagcatccacaaatatgagggaaagaagcattaacagcagtctgaagctaaatatcaacatcacccctgccaagctcttggcctcattgtaggtggaagacgctgccatgtgcaacaaaaagagaaagggcccaggctgcatgcacaactaacgaggctgttccctgaggaaagggcatttgctgatttagactcatttcctcaaggtcctcaagcaagcccaagagtacataggccagtcgctgagacactgaaagttgagatgtggaagaaagggccaacagactgtcccagaagcagaatgcttcagtcctccagggaagctttgggggagatctgccctcgtgtcctcctacagctcagctgagagcagccctggagcctcagaaccacaggccctgtagttccctgggtctggcaaacccctgggagaacaaatcactgtcctccccacagagccagcccagcactgagaacaccatacaagccagaggatgcttgccaaatagatgcatgaacgaacgaatgaatgaatgaatgactcctctgatgaagttgtcccagggagagtttgtgggaatactgaaaaggagggtggtccccaagctggtaccccagtccttgatactctgatgtggctttttaatttctctgtcttccttttaccttgatgtatttattctctatcaatctatttgtttatttatttatttactttaggaatcaagccagacaccttgttggagcaacaagagctagagatatttgttccttttagaagaagcaaaattttccagtgccaactgacagggaagaagatgaataattacactatgtcctggtaaagaggacccgagacggcttcctgattttcgtacatcaacaaggagacgtctatgaccctggtctccagcacacctttcttggtagagttgagaattcaaccagccagttcttcctggagattctcagagccacattgagagagcagaggacttacaagtgctgccctatccatggtgactccccttggcctctaggtaagtcacacactgaagcctgcccctcccaccttccaccctggtcagctaatctaggttagtgcaggtctaacctagattacaaggcgtgctcgtgtgcataatttcatgaccaccaacaaccacatggggcaacgttatccccattttattgtccaggaaaccgaggcctggtgtggtaagtgacttgcaagtaagaggaggagtgagatgtaaacccagattcctgaatctaaattcagtggtctgtactgcagcatagctgccgcctcttgagaactagagtgggcagtgtggaagtgggaattcccaagttcccaggcctcttccagctcagtcttctatgtaaaatttttcttttccaggcttgtctgagcagaggtagagtgaccctgccgcctgttcctcaacagtctgtgcaaattcaaagaaatagagtgtgaattcaaggaactcatttgaagaacaggaaaagcaactctctccttgaggttatcggggaaatgaaggttgaaacatggatcagaagacttgctgaggtcccttccaccctcagctcttccattctgttcccaaatgaggcccaaaacacagctttctccatcactctttaatctgttggttgatttgtctggtgcacccaaccagcactgtggccctgaaaataaaatgttaattacatcaatcttacagccatccatcgctagccatctgatgctgatagaaaggcaggaagcactcgtggcagtttgcatatcagggtcagcagttcctttcttaaccctcctctgtctggcaaggctaagggagcagacgttcctgtaatgacctggcctgtctttagagctgcagccctaagagctggttttcttcctgtggctatggtcttggcactgagctccttcctgctcttcttttgctcttgtgtgtagcggaccacaacatgctttcagatcagacatcctgtgggcagaagaaattatttcacttcaataagaatttttgaagaccagtatgggttcaacgggtgcttttgggggattacaccagagataagaacagactaaatcacacgcgtgaggcagcatttacaaatcatacaacacaatatgcaatagcagcttctgagtttctgcagaggaaaggctaaggacagcaacctggttggaagatgcctcaggaacttgccttgaggctgtattttcatagcacataagattgggaaagacatcaaagaatgggaaaccttccattctggagagatggagattatgggggagaatggataaagcccccaaaaacactcttgcctctcctactaactgttcaagtctcaggtatcattatttgtatgacaaagagaaaattaacatcgttaagcaatgagccaagtgtttacaagtataatttcatttatttctcacagaaatcctatgagttatcttctcccattttacggagtataaaaaaattagttttttctagaaatcacatgaagggacagacatccccttggcaggaccaaggaagctgtggcctaattgctggccttgacacgaaggaatgactgagcacaaagaacacagcctacacagggccggaggagggttgggtctgagggcagagccctggtggatgtttctgccttccacctgggcaccctgagacaggctgtgttttttttgaagttccatcttgtcctgccacaggcccaggccaagctgactgctcctgacctggtgaagcactagccacactctgccccaagctcccgccgcatcatcacctgtcctctcctgtactgtcttctacctctggctttgatttattgttcataccagctttctctcttagtcaggcctagaggaaggttgtttttggccattaacaataaattcttaaaattccctctaaccggtggaagatataaatcacagtcataaacataatacacattcttgggacttttcaaaatgacttcctgaataatttgagatagttcaacaataattttctaagaaagacaggcttatttgagccctgctaactactcttttgatattaatacagctttaaaccctctatacttctttctgcctcaaggcttttttaatacatgtcctcatttgttacatagaatgttatttccccacccatgccccatacctgtttcaggcagggtccaagcaggagacagggcactctcggagtgattagagagagtttaatgaaagggacttttacaaagctgtggacaggtgttatggattgaaatgtgtcccccaagggacacattaactctcagtaccttagaatgtgatcttatttggaaatagggtcactgcagatgtagttaccttaaatgagttcatactggagtatggtgggcccctaatgcaatatgactggcattctatatgacagccaagtgaagacaaagacacgcagggagagaaaaccatgagacagtgcaggcggagactggagtgatacaggtgcgagccaagccaaagaccatcagagtttccagcaaaccaccaaaatctaggaagaggtgaggaaggattcccctacaggtttcagagggtgcatggccctgctgacaccttgatttcaaactttcagcttccagaactgtgaaacaatacgtttatattgttttaactacccagtttgtggtactttgttaaggcagctacaggaaattaatacagaagggttatgggaaaccaaaaagaaggtggtgaaacacccagggctggcaacaaagaaccgctgccatgccaggcctgaagcgtgtaggggaggagccttcactgaaacctgcagctgtggaagaggagttatagcttccagtgaaggaaggcactctcctccttccctccagtctcctgaaggtgtctccattggccaaaccaaatgggatggagagccggtggatgctgccaattaaggtcaggctcagagtaagaagtagagtggatgtgcagaggcaaacagactcagtctcaactgcaatgccacttcctcttcagggaagccttccctgacctcctgaccaaacctggcctctgtaacatgctcccatagtccttctgcttctgcagaatacttatagctgcaatggagggataaattatgcaaattattaagtgatgactggctctcatgctagaacataagctccatgaaagaaaacactgtgtctgccattcatcaatggcagaccctgaatcctgagggcctggcatatagtaagaatgactaggttttataggatgtgccaagaactaagcagcctgatagaaaaaggtcaagtatttaagtccaaacagattgaccttggcaattttcaaagagctatagacagcagacagcattatgttctgctgggggacagggttgctgatgatataatgtgtaacatcaaagaatgtgaccaccttgaatacttgctaatagtcctccaagagcagtaggcaggatgggcagttgtgcaaagtgaggcgaggcagaggtgggtggggagagcaactactatggggtcaagaaacttcatctgctcctatctgaatttttttcagggcagtctgttcccagtcacactggggaacttaagaaagcttagatgagtctttcctccactaacctgggaatgtaagtcctgcatccaccctccaatatggaagccacctttgctcttgcctttttgcttaccaagtgactctcttcccagcttctgctgcactctctagttctcattattaatttacctgtttgatttcaaaatttcaaagattgacctttaaactcaaaagtggaggtcccaaaaatcctaacctcccctcttttgaagtccatgtaaatttagcccgtcataagttgagatgtagtagtggtttctaagttttttacaatgtttggctttgtgtaatttaacacaggtaacctaagaacccttcagaaaagaagctagatgagctcaataaagatcaggaaactctggctcacatttggaagaccatgtttcattggattgctctttaacacatgggtaaatcacccttatccaactttgcctagagggagtttgcagtgaacacaacaatcattacaacatcttcagtctttgtgcacatgctattgatctcctcatttggtggttcttttgattacagctgtaaatgccaataattcttcttggtatgaactatgaacatcaccacatagtgtctaacatgtacatctaacctgaaactggaacaacaatatcaaatttaacgtctagggaaggaagcagaaaccctgtcaccaattaaataagctgccttaatctcctctcagttggcctaacttacctgaaccgtactattggtcttgaaggtggcactgtcatcccattagcaggcagcaggccctgcgagcctcctgtgatcagctagatttctctggggaatgaaacagctgctgatagggactgacttcctcagtcacaagtgtttcacaagtgtgttggttcagaggagggaccaggcagaaggtggttgagaggcagagctgcccctgagtgagccatgcagaggatctcctccctcatccatctctctctcttctgggcaggtaaggcagaccccagaacttgggccaagcaagactcagcagcaaagaaacatcaaggctcacaggaccttgtactcatggactgtgctccttactcaatgacctcagcccccagccctcactgagcccctctcttgtgtcttttctctcaggagtcatgtcagccattgagttggtgcctgaacaccaaacagtgcctgtgtcaataggggtccctgccaccctcaggtgctccatgaaaggagaagcgatcggtaactactatatcaactggtacaggaagacccaaggtaacacaatgactttcatataccgagaaaaggacatctatggccctggtttcaaagacaatttccaaggtgacattgatattgcaaagaacctggctgtacttaagatacttgcaccatcagagagagatgaagggtcttactactgtgcctgtgacacccaccctgctgcagctctacttctgagcagctcaaaaaccactgaccaggcgcggtggctcacacctgtaatcccagcactttgggaggccgaggtgggtggatcacgaggtcaggagatcgagaccatcctggctaatacggtgaaaccccgtccctactaaaaatacaaaaaaaaaaaattagctggtcgtggtggcgggcacctgcagtccgagctactcaggaggctgaggcaggagaatagcgtgaacctgggaggcggagcttgcagtgagccgaggtcatgccactgcactccagcctgggagacagagcaagagtccatctcaaaaaaaaaaaaaaaagaacattgccatccatgtagagcagcaattccaacaagatcgtgattttctcttgaataaataatttaggaaatagggaccagagaaagctagtgtttctacctttctttcaggctcagccactcagcttgcccgtgccctcccatggtgctcagataggcagcccccagtgggacagaagagaggagagatggagccaaaggaatgaactgtagcatctactgtgacagttttcttggaggctcataaaaggtatgaccacagagccacagtgcttagagtatagcatagattaaggaggcaccttacaatttacaactatgggtgacatccagtttttccccagccacatgcctctgaatttacatgttctagaggaaaaggactggcagtggggggaggctcctctccctccttcagatcaaatatgtacactacctgtcattttgcccaacatggaaggaaaggctacatctctagcatctctagcatgctctgttgttttgatgattactgactggatattttgttttgctttgttttgttttcttcatgagacggggtcttgctgtgtcccccaggctagagtgcagtggcgtgatcatagctcactgcagcctcacactcctgggcccaagctggatatggtgttttgctctccctttcttctctatctctttacttccacatgtgctagaaacaaaacgttgaaaaattgcttccactggcacttccttatccttctttggacagctcaatttaacactgcacttttatcttgaacaatgtgtttttccagatttagatgattgacggggctctctactccaaggctgaacctgtggcagaaatcagccttccttctgtcctcatctagaaaatctaccacttaccttgttaaataacctcataagaacttgtggtgatagacatggtcagtgacttgattgcggtgatagtttcacagatgtacaggcatatcaaactcatcagattagacactctaaatgtgtacagtttatttcacatcaagtatacctcaatacacttgtaaaaatatttgtttaaacccaaaatggattttttaggcttctttggactacttcaggcaacgtctacacaaaatgttcttcaacaaacccctctagtcaaatatcctctagtcaaatatcttccacagaagtacaaagaggctgacagggcttgccacaccttatttggtttcagtcagggcttttcactgttttgccaagtgtcttcccaatcctctctcctctcatgattctgcctgacctttcatatatataatacatgttatatatatatgttataatgtgtcgttgttccatgcattttagtcatgactgcccccatgagctcttatcatttatctccccaaatagctatattctaaaccttcagaaaatctctcttctctactcttcatcccaaactcactcactttgacctgatgcatgatcccaacataggcctggaacctgccttctacctttctgccccaccccattgggcaacttctttggttgaacggtctgcaaggccctggatactggctctgcccttggacaaaatcgggttcccaaatccccatccagatacagcactctgagctccacgatcttggaaggggtttggacccagccttccccagatgtatttaaacagagggcctgtcatgattcatcaagcccactgcctgccactcagatctaattctccttctttgaacaaatgataggcaagaaggtggagtgcatctccaacatggagaggatacaattattctcctagtttgaaatcatgatttggaaaaagaatgacatctggaaaactggttatgcagatgtcaaagttgtggagccatggttttataacgcctgcaagatggattcctagtaagaccccaagtgactccctctaacagagactgggaagagtgtctctaaggagaaggaggggaaaaaatatctggacaaatccataagactgtatgtcttccgtattaataactaatatctgttgagtgcttactatgtgccaggcagcattctaagcacttaacgtgtgttatatgattaatcttcacaacaaccttagtatttactttctattcttgtcctcattttacaaatgagaaccccaaggcacagaaaacctaaaatacttgcccaaagtagcatagctagtaagggagggtgacagatttcagactcttgatgctgcaccagaggacacagcatgtaatttggggagatgggggacccatagagaaagccaccttcaggatgtgtcagaaccaagggacaacaggggctgtgccctcaccaccaaacctgttccaattgatactcccgtgaccatctgtcaaaaaactgggacaacagaacaatggtcccaaatgacctctcaagtgttttctaactgagattttgtgatcctgacacaagcttcacactgtcttctaaaatcatctgcatctcttcatctgtgaaatggggataataagagttctaccttcactgtgttataaaatatataattatagaaagtaaataaattgcatagcttatagtagctatttaataaatgttacctattataagaaaaagcaaactgcaaggaagaataattgagaagaaagtgaactaaattactgagcaccaacgaaatgcagccactttacaggtatggactcacttatcctatgacaactcagtgaggtcattatcatcctttctgttttgcaagtgaggatactgagactcagacaggctggacagcttgcttacagaagcagagccaggatccggatctgacttgaagcctgattgtcctggctgggatactgggctgggagctgcggaatgtcctaaagaaataccttacctatagcaacatctcatgtaaaggatggctgggaacaggtatgtgaagtctggtcatctttgctcatgcaaagattgctcttgactccttggccagtttccagaagaagggatagtaggaggtcttcaactccttccccctgcctcctctcccctgctttaaaacaccaattgtaatttcagcttccaggttgttctcccgagatggctcactcccctgactgaaggaagacagctactccccagcccactgccactcacactcctgagcaccacccctaggtcagcagcttttctcccagggtacaccatgagaaacatgagagactggcccacatattccctccttctgatgcttgtcaaaggtagtctcttgttggactcccttagatcctcggggtgctcatggattcactgccttttcctctccttttcaggggcttgcctggagcgaaaaccataggggtccaaggccggcataatgagagctagaaaaattccctgggtttctgtcaggtccatagagttggtgactttaccacccacatatatctttgctgtcaagcaaagtgtgcaagtttgtctcttccgttgtcatcgacttatcacttatacagaggcagcaatggggcttgagatctgacaaccacaattctctgcattcaaaagtgagcacacgggtaccagaaaacactgcggtggatgaaggtgcaggagccaccgtgtaaagaatagaaattaatttctaactaaatgtctctgctttagttagggtcttagtccactgcagtatcttaaacaatacatattcaatgataaattttccataatgacaaggtgaacaaactcagaatcaaagctcctttcctactcttcaattcaacacattaccctaaaatattaattgaaatgataggattatacagctttttttttttgtcagagcactttattcattctttcagtaaataccatctctcatatctgcttaatttttctccacagcatttatcactatttggcatgctacatattttacttgtttatattttgttgtctggctctccactggaatacaaggtccttgatggcagagatgagtttttgtctgttttgttcactgctttaactccagcacttagaataactttggcccataacagacactcaataaatgtattaaatgaatgagggaatgaaatacatatgagtgagtgctacgtaccctgcactgagctggatgccagggacacagtggtgcacaaggctggtgcggactctgccttctgagatgttctccccaagcctcatctacccactaaaaaaatgctactgaccgtaacaagattttctgaagagttgattatagagtactctggaacaccaaataacttactcttggagagcagacatcgaggctcctaagtgcattggatgttagcaggggcaaaatgaagaaaatagtagctttctcttttctccaccttttctctcttttgagtcccaagggccccagccctgagtctgaggctgtcaaagaaaaagcgaaacacttctgttttatttcacaaaggaatttcgcaacgcttctctccaaacagactggctggggcatgctatttcacaatgaaaagccacgataacacagtttcctaaacaaaggggcgattcctaactccctctcactttatcaccactgccaccaaatgattttggtattcttcaagaatacagaatccactgggtctttttgggctttttagcaatttacacatccacaaacacataggtttatgagcggtaacagcgtacattccagtgcatgaaacactgcagggattctctgaaggcgtgccctggatgctgcaaggctccaaggcaacagtcagccagtggaacagtgtgccacccagcatgctcgacttgatagaaaaaagacccagtgacagggcaaaggaagtcaagccaacatgcaattgcttgtattaatttaaataaagccaggttctcaaactccatgtttaaataagaaatctaacagtcataagttttctttttacctgcatgcatatgggagaatagggaaagtttaaattatctttctggcttaaggacaaaattgcatgagtatttataactttcagaaaaagaaatgtcagtctaaatatattactagggcaacaaattattaagaaaaaaaacccaaagtacagtcttttggaaattaaagttgctttcatagaatatagcagcattcactcagtaacaattcattaagtacctcgtatgtgccagacgcttttctagacacaatggaagcacagctctcagaatctcaggagcttatatttcagtggaaataaacacaaaataaaataagtaaaatatatgtcagatggagataattgccatggagaggagtaaaacaggcggggagagagagagtgttgtcagcaggcttgcagaaattacaattttaaatcaggttgtcaagaagggatacaataagaaggtgacatttcagcaaaggcctgcgtgtaggcagggagcccagtatttggagtgtggatgtttgctggactccctctgttagaaataacattttcatgcacattcttaagacataatcataccagcttttctgtaggttagggagataaggagtcattttttctttcttatcttgctaagagctctttcacaagtagttcacactttcatttttcaaaatcaagcgatgaaatgccattaattagcacaaagtgtgttggggagtggacgcgagggtttggcaaggaagcagtcctgaaaagatcaaaacttacaacatgaacaggaagatgacagcactgattattgacaaacggaaaatggggcatggcattttgagccctttgccttgagtctctccctagtcacgtgaccacattctgtggactggtgagtgtttcttccccaaccacagggataagaatacaaagtgagtgatgcatttctctcactggtccccagatgactccactctagcagccccggaaaagaacctgcagcctcatctatacctgcaggttgatgtgcctcccaaaaactgtctcactcagttgtggagctgaaatcaatcatgtgttcacctcagtggggttcttggtttttcttttctggcttctccaaaaagccaatcatagagaaacctgaggactgtggagccactatggagaaggctggagtgcctttaccatccctagctcagctttagggattcaccctccaggacctctgagtgtgctgggatcacacggcctaaggtaggccctagagtcagtttctgtctttacctgccacctgacaggagtgagaagttttacttagaggcagtgagaagggaagtcagcagccccagggacagtacaaaggagacacagcctgagtgtgtgttgtcagaagctctgtcacagcgaaggcctcctcgggcataaagacctcactgtgtttgcataacacctgtgttataatcgtgagtgatcaataaaggattaactgcctcagtcatctaaggaaatgaagaagggttttatgcaccaagttcataaataaggacacagaaaaaaaccacgaaggccagtgtagctgcctctgtacgttgaaattagagaactggtacaataacaataacccacctctgtagtaagaatcaatgtaaaatctttgagttcatagctagtccatttctcagcatcaaaaccatcattttgctttctgtatggaggacgtccacccccacatatgcacactcagagtgtcagagcaatgagaaaccaattaccatcaggctccacctctttggttgaagacatagaaactgatgaatgaagaaattaagtgacttttccaacatcacacatatagtgcagacaggtaaagtgatatactgtacttctgtctctttcctccaatatcctagaagtcaagggctaagaaaagacagaaagggtaaaccatgtgatcatgccaaagtgaaagaaaaatggcagcggagtgttctccacattccagacaactacctcctgccaccttctaggtggcaatgcagtccaggtaggtaaagcgatatacaaaaataaatagccttaatcattcacaaaaatattaatgtgtgtcaaatttaaaaacaatgaattgcaaattgcccctaactttggcaagatcctttcacctaccttaaaatggacaagtttacaaatttgggctataaactgcatataagtttttgttggttttttttcttccttgagacggagtatcactcttgttgcccaggctggagtgcaatggcacaatctcagctcactgcaacctctgcctcccaggttcaagtgattctcctgcctcagcctcccgagtagctgggattacaggcaggcacaaccacgctcagctattttttgtatttttagtagagacgaggtttcaccacgttggccaggctggtctcgaactcctgacctcaggtgatccacctgccttggccttccaaagtgctacgattacagatgtgagccaccatgcccggacacatatgagtttttataagtaagttcttttagtagtgaaaaaagcataggctctggaatcagagaaaaatagaatcacaacccctcacttcatagttctgtgaccttgaaaaatgttgctttaacttttctaaccctctattccctcatccacaaaataaggataataattgcatagagttatcataatgatcaaattaaataattgcaagtaagtacctgagtgactacaaagcagaggtgctcaataatactaactccattcctttcagcacccgatggtctgcagtagagcggttcaccctctactccagacagaaggagacagaaaagacagaaaagctagaatgggagagaacatggccaatgaccaccagcatttttccaaaccaagaaatctaaagtgcctatcagcacattttttataaaaatacctcctcaggaatgttcttcccacacaacctctctaaatcctttccctgcactaatgatagtgaaggtcccaaaggcaagaccatcactgggagggtctagctccccaacaagagatgatgccctcattgcccttcatttgcagagatgaaggtgacacaggtcaatgtcagcttcaccaatagtaacagggagagtaattttttttttttgagaccgggtctcgctctattgcccaggtcggagtgcagaggcatgaccatggctcattgcagcctcaacctcccgggctgaagtgatcctctcgcctcagcctcctaagtagctgggactacaggtgtgcagcaccatgcctgggtcattttttaattttttgtagagacaaggtcttcctatattactcaggctggtcttaaattcttgagctcaagtgatgcccctgcctcggccccccagagtgccaggattacaggcatgagacctcacgccctgcatgaatgaattttttacatcaaaccttctccaacaaacttggttcagatgtctgagacaagagttgcacaaaggagtctcagtcttcagaaagttcatccttacccagctttatggatgctctaggacacatttaattcttgcatccatttaggaacagagatcttctcccatccttaaaagggaaactataatattaattactgacctgtgatgagtcagctgtccatcctcatttggcccatgctgtctacatgaagttagttttcactgtagtgcttggccaagaaaaaccaagtttttctaaatgaattccaaggataaatagcctaattcctgttctttggcttcttccactaaagaattatagggacctgatctagggaaactggggggaaaagccagggaatgagagccactgtcttgccagaaatgcatgttctgatgaggaaagatagttcaggatatctgcgccaaatcacacattggaaagaagctttctgagatctgaggaaacttccacctgctaaaaagagctagcagtctgctggaaagaaaaaaattcattcaggtgtcagaactcttactcttcactttgtgtgtgactgtagacaagtcagttaacctctttgcacctcagattctcatctgtacagtaaagagttcacattagattgtctctaagtttccttcagcactaacaagccgtgggacataggagaacaaatttgaaagattcctgagatacaggagtatggattcctgcagctgattcctttatgtgacccagtaaggataaaatcgaaaaaaggaactaaacgaaatacactcttgattaatcaaaggggattgaaagtcgtggctaacctcacacctaccttgcatcacctccagctcacctcccttgagacactcctcctcttctttaatgcctcatcatgattctcaaaaactgtgatcactcaaggttgaagcttttaatctcccatgtataaaaggatatgcaaatagagttcagtttcctgttgagtctctgccaaggtcttagcctggcagttctgggaaaagagccaaagacctcatatttcttggctgttaacattctcccatctgtgctcaagtcagcagcctaggcttcaggctgtggtttgtctttagtcttacactttcccaagttttctgaaggaaccctttagaatgttcctgcaagaaagtaagatacaagtggctcccaagaaaccagacagaggattatctggttatatttggaggcagtaagaaaaagaccaggaagtctatattcctatagtatatagccacagaatccaatcttgcaagctacttgaaatgctgatattaattaagtcttaggcagggctttcaataagtcatctgtgtctccaatatgggatgtcccacatcatgcatatgcacagtgaaaaaaagcgaggtccttgggtacagtacagcattcaaaaattaaagatctgaaaaacacaagacatctcagtgtgcttccgggctggaggctctgctaaacaacagaagcagagaccggactaattgtcccccatgtctctttgactgaactcacacaaaatagaatctaccatttttactcagtgcggggtacccagactcaagtttactgcaatgttgttaccaatattctaatggaaaattatatattcagagctatgttaaatttgaccatttattaaacatgaaatttctactttttctgtaagtgccttgtcttacttgtatttcccggtatttcccttctaaagctaactccccaaagggctttcctgtatgttctcacttccattacaaagtcaatgtacaagttaatttttttaatttctttagaaacctttataaagagatttcctccttcatttctctgttatcccaggcagctgtcaggagcaaagagctcaagcctgcactgccttggaacaggacatcagcaaaagacactctcaatctactcagaaggctgaggtgggaggattgcttgagccaggggttcaagaccagcctggacaactaagtgaggctcagtctcaaaaaaaaaaaaaaaagatctcaatattattgttccatacccagtcattcacttggtgttttctgcagcatttatttataaatatctcagtctgttcttaatccttgagcctatattttttaaaatcatactttgatatctactcagagtattgattctcttcaaatttcccacctcttagttctcctcccactctctcccaccctgagccttacacctccaacaatgatcattctaagaccatttatatctcaataggaaagtgatgtaaaacgggtctccttactctgttttggagggtttttttgttgttgctgttgcttgcttctctgtcccaccccaaactcatgtgtgtctgaaatttagcaccaccttgcgacgtttgtgagcatttttctcagagcagcattttgagactgagcctgaactccactgatgttatgacccttaaaagtgtctggctccaaaagactaaggagttcctgcgtaaatccaggtccagctacttcatcactgtgacttgttattggaaaaggttgagctatcaacatattgctcctgtaaaggctcagaactgaatcttagattcttcaggatatttgagtcctctgaggctcctgggtaaagactccaatgtagcagttctgtggactataaatgggagatatccagatcatacaccttcaatggaagaaaaagcactgtcaccttagacgactccaactctgtagtctacttttgtcttcctaatatcatacctcattctccagtgggtttatggcaagcctcatctactcagaagtaaccaagtacaagccaacacactcttgtgttagtgtggaggcccaaagtggcataagtgaatgtgactccagatgaaaaccttcccctctccaacacaaagatgccaaagactatgtataaagcaagtcttaaatcactctatatttccatttgaatatatttccccagttcctgtgcattgcttctgcatacacagaattcaatgataaaaattgagactgtctcctagatacagtaattaactcagctatcaatgccaattgactgtgtagaggggagacaattttgtaccaagatttactaacctctattttaatggaaaaacaatggaaaagctttcttcctactatgactctctctggataaattgcttgccaggaagcgttaggataattctgccatgactctttgtcttccacacccaaagacatttggtctccatcacatatggaggaaggatctccttgttcagcagtatttacaccatcaccctgacacccgcagtcagatctaactatacagcttggctaataaacctggagaagctcatattctaagaaaaaagtggagagtggtgggacagatggggcctgagtgctgggaaactgcccgtgcccactgctgacttggtcttctcaccagctgcttgatctaacagatgcatcttccttatgaggcaccagagaaccagaatgtccacatcctgtggtcccctgtacccttaacaccccacatttgagttcctttccaattcagaaaacaaaacctgcaggctttgagccaatttacaacagatgtgggtcacaacaaccaactacccaggaagcctccaccagaacgcagcgtgagaatcagcttcttagatattcccatacgtgtgatcccatcaatcatttaacaactgtcaaagagaaagactaggagactttctcccgagcatctccagggatttaattcactatgttggaaattaagagattactactaagccataagaaggctaagacagagttaaaagaattattggaaggttggcattacaactttacgtgtacactaggaaaatctgcagctctacctgtagctttgacataatgccttcctataccctgtccttgcccaactgtgactcccacatcatggtcataccctggataggcccctctctgcatgtagagcaatgtgaatggggattctgcttatcaggatatcatcactagtctgtgccaggccttgcaagaatgtccttgtactgcaactatttgtaccagatggtaccctggccacccctaagtgtgcagactttttaactttttcccccaagaaagtggtccctgatgtgcactgcctactgagtaaggctaagaaagataggaaggaagaggacaaagtgcaaggagagaaacatttttgcaaggagaaaaataatgatgtggatgcagaatatttatcatgtgaattcatattaacctgacttcctcagaaaatgtcaccgttagtattagaatgtgtatttccttcggagctctgaaagaaaatatgagaattcaaggggtgctagtgcagaatacacacacacacacacacacacacacacacacacacactgtgcttcactgtggctggaatgatgcagagtcttggcaatagttcgggaagctgctagctgtccgcccattgtaaacagtgaagtaggtcatctgtggctccccatcctcatctgtctgggccattttcttgggccctcctccacatcccattcctcatatgttctcattctatttccatcaaacctcaatctcaagaaatgacctgaaatcaattcgtactaatgtttgagtcatgaaaacagaggaaggctttagcttctctgagattggcagggagggtcgctagtgagcattgtattttcataaagataatagccataagctaaacactgcagcaaccacagcagaattttccaagcctgaggaacactgcccaaaatgaaagacagaggtttgttctctctttgtttggaggttcagtgtggatcatacacagagagtctggagcctcccacagtggacacttcttttcctctgtccagggagaagtccagctggagcagacaaccagagagaacattagcctgaccatggggaaaggcattgcagcagaattaggcccaatagaggaaaaaagatgcctggaaagaaatttcatttcaatagcaggaatagctttgtaagagctgatagccattcaacagtgaaacaagcatccttgtcagtggatgagttcggtggatgactacactgggaaggttgtctacattggttgggagctaaactcagtgagctctttccctcctagaattcattatatactgtatgtatatgattatatatactctgtgtatgtaatcgtgtattacatatactccatatatgtatattacatatacatatattacatatactctgtatatgtaatcatactccatatacacatttgtatccattacatattcaattttccatgctattggatatttttcctattcaataattttaataagctatgttaatattgtatctagagctacattatagtttactcaatcagttctcttcatggttgagcatttaggcaacttctaaatttttcctactatgaaaattattatgatgaacacacctgtacttacaactttttcattatttaaagtcatcatatatgtatatgatgatttggatccacttccacatcccattccttatatgccctcattctatttccatcacaactcaatctcaagaatatttcagtatgtgacctgaaatcaatgcattctaaagtttaagtaatgaaaacggaggaagactttagcttttctgaggttggcagggagggtcacaggtgagcattgtattttaatagcaataatagccataagctaaacactgcagcaaccacagcagatatacaaatggtatatatacaaatatacaattatatttgtataaatatatataaacatataataaagtaagctcctattttcttaattagaagattcaaagttaagaattttgtccaacttgaatatatgaaactttagggttatagagaaattagccaattctactttagatgttttaatgtattaatacagttaaacacacatattttaaaattacatattatataaaataatatatcaattttgaatactgctatttccttttaataattcataaaataactttaaattcttcacaggcatttcaaatcaatgtatttgttgccactagagccacttttttatcctcaaatatttttccagagtatatgaaactcactttgctaaattgaaaattaagaggcacattagatttagaaacataattttaaattgtttcaatgatggcacattattaatacctactttgagacacaatacatactcacataatattagaatcattgttttgccatttatcctgtaagtgaatattcatgatctccacaacaaaacatttactttgatagatttgtttaaacaatatcaaacacttgcagtcttgaaggcactggaagacccaaaaaatagttactacgtttctgttaaactacttagtcatctttttaactaattctatcagctgactgccataagcatccatgagctagcattgattgagatcattccaatgtgtcctcactaaactgtacttaactgttcaaagccaaataattaagtgaaagtatggtaatactgtttttcataattattgtaaggaatcaaatataagggatttcttcttctctgaggatcatgaaccttactccatgttcaaatagatatagtattttttcacagtaaattccccaaagtggaaatagtcactcaaacgaatacttttactcttttgacattaaccaaatggcttccaataaaaatcaaacaatttatatttttaccaacatcttgcccacattgggagtgtcaacattttgagcaaaagctttaattaaatatccatccaaaaaatggtttgttaatactttacagttttattactagagggttaaaatcctttttcaagtctgataatcaatgattaactttcttcatttgtccttcacccatttgttttttaggttgatggtgttttacttattgatttgtgtaattataataattttgtgtctgagttttacagcatttaaccacaaaaacagcattggtgaaaggagtttcaggggtattgtggatggcagcgggtggtgatggcaaagtgccaaggaaagggaaaaaggaagaagagggtttttatactgatgtgtttcattgtgccttcctaccacacaggttggagtgcattaagcctttgtccaaaaacacccagccgtgacccgctatgtatgtctcagcattgggaagagtcctctgagtgtcatgggaaaataatatatgagttttattgcccctgtgtcccaattattttctgtttactccatgttggtctacagcaatagcttcagaacataaacaaatatcaccaaaaacatcagtgatgaacaattccaaccacacatttcaatgtttactaaatatacccgtggcactgtaaaaaagaatataatggaagagtaaaggaattgggactgatcgtgactgagaacctgtatagtaggctacacactagctatatgatgaaccaagaagttgaacccaaatctaactaacttacataatcccttcctttaaagaacttaatgtccagtgcaaagcaagtgttcaaaaaagtgtttgttgtgaattgaattcatttcattggaatacagcatgcttgcaaagtcccaactttttaaaataatgtgtttctaaagaccactggtctttagaaagaccaatgaccaaagaccttagaccattggtctaaggaccatctggaagcagatccccaaggtgaaattctgacgttgaattcccaaatctaacaggtcatgtgccttgttctgatgagaaaactgtcgaataagggagtagcagtggcatgaaggttgttagtaggtagcataggccaaatggcccagtgatgtgatgaaaagtgcactcctccaaataagaccctagttactagaaagtcacaagtaggtaaacagatgccgggagggacagtttttgttggataaagtcagcagagaaaggcttttggaggagatgaatcctgagctggtgtctacagatagtgacagacttagtgcgactaggaatattatggagaataaaagaatctccctctctaactaatgccaccaagcagtcccttcaccccagagcaaaggcataacctatcttcacccaagtgaactatgtattcttgaaatatatctccttggaactaaaccatttttctgttcacttcaaatcaaccagtgttaatatcatagatctgacagcttagaaggcctgtgttctccttcactcttctcttgaccctatgtgagtttgattcaagagcatggggattagtcccttctcttgaattacaatcaccaatcagcacaccacatccagttgctctttttaagtctaggagagcaaaaacaatgcacaggtgaaggaaactatgcctaggcctcatccctaggttgtacaaagtaactgaatttatggcttcaaggacagaataaatcaaataaaatcaaagaagcccattttcagggaatagaaacaattcacagaaataacaccttgaatgaaattctcatttttagtgcagaaatggaacataacattcttagattacttgctttctaaaagtgaatattctttaggtattactttttcaacattgatgagtttacaacatttctttttgcatagcagacaaaactgtgtaggcattcacagttacagaaagaaaaaatatgactagcttcctgcttcacacaaagaaatcatgcaaaaaaaaaatttcaagccaaaagaaaaaaaaagttttaaaacattttaaagtctcatattacttgctggctgtaatgggaatgtgtaactttgtgaagatgtctgtagccatcttattctaatgatcacttatctttatcaagccattatgtccatcttgacatgatgcaatacacagggcataacattacctacacagtatttctgacataaataaataaactaaaactaatcaaacttttagttctaacaggagacaggaagctagaaaagcaaattaaaggattctacaaagaaacatctagacaaatccagcaggtgagacattccactggacaacaggttcagtcccaccaataatcaatgtcatgaaaaggcaggaaaaaagtgcagtagaggggaagcagtggaaggagaactattaaagattaaagagattttaaagatttaacaacaatgaaatgcacagtctttgaatggatccttgttttaaaaaaaaaaaaaatctgtaacagaggccaggcatggtggctcactcctgtaatcccagcactttgggaggcagagactggaggaccacttgagcccaggagtttaagaccctgtgtctgaaaaaaaaaaaaaaagaaagaaagaaagaaaaaggaaaaaataatctataaaagacatttggagcatttggaggaaaactaggaaaacttgactatgggttggctattaagttattttcgggaatttctgttaactttgttaggtggaaaatggtattgtggttgagtagaaaaatatccttttttgtaatatatactgaagtgaattgtcattttatctgtattttttttaaatactcgagcaaaacaaatagaaaatgtgacaaatgttaacaactgttaaatctaagtgatcattctatagatacttattttattaatctcttctttttggattgtttcaaaaattttataataaaatccttttttaaagtcttcattttgtgggtgggcatggtggttcactcctgtaatcccagcactttggggagccagggcaggtgattgcttgagcccaagagttctaaaccagcctgggcaacatagcaaaactctgtctctacaaaagaatacgaaaatgtcaccaggcgaagtggtgcatgcctgcagtcccagctactagagaggctgaggtgggaggatcacttgaacctgggagatcaaggctcccagtgagccatgagcatgcctctgcactccagcctggataatggagtgagaacctgtctcaaaaaaataaataataaagttttcatttttaaatggccaacaagtctacagcaaatttaaacaatgaaaatatgagatacaatatcttccttaaaaattagcatattttcttaaggaatactgctctgctcgaagaattccctagttctgtaagcgttcgaacaaattaaaatcttgtgtttatataacatatttctaagacaacaatgaattctgtcactaactatatgagtaaaatgaacaagaaaaccactaataatgatggtgcacattttagattccttttattctttttcaagacacagacataactgagatatcttaaaatcactgactttcaagatttgagataatgataataactcaagatcaagtcttccccttgtgttagaagtgggggtgggacagttccagacttccacagttgtaccaatgaaccccaatcagatgattttcaagttacttctccttcaggtgggtgggcatcagagagaagctaagagaaggttttgacaaaatccaaagtgtgtccagacccctcaaataaggtaacctgaccaagtttaatacattcttagggcctaatatggatctcagttaaaaatcctggtctcttttaattcttgtccagttgctaagtgtattatttgacccattaactctgcaagtcatgttggtccattcttcttctttacggttttgcaaaatacatcaggttacagtttcaagtatctgtcacttaaacaagtaagcatttattatttttaatgggagggctaacatattgccacagaaatatagtatgggtactgaagaaaatatacacagactctcaggtcatcactgagccttcccaccatcatcatagatccagcatctgacttccagagtaccaccaagaagaaatcagaggcagatgacatacatatccatggtccttgactctagagagtccagccaaaatgtgtgggtccatttaatcatttctacagaaatgggaggctattgctccaaatgacttctaaccactcactcatccatcactcaaagcatatgatacaattgatttaccagtcattagtaggcaggtagagagtggtgaagcagtggagagagcttggtatttacagctgctattgcaactttggtagcacaaacaacatggaattaggacagggattttcaaagtattgcccacggacttctgagcacctcaagatcttttcagggagtccatgaggtcagaatttttttcataataacagcaaaacattacttgcctttttcgttgtgttgatatttacactgatggtggaaaaacaatgatggataaaactgctggtgccttagcatgaatcaaggcgggggcatcaaatctgtattaataatcatgatattcttcactgccacatattttcaggggaaaaaagttagtttcacttaaaaatgatactgactgtattaccttgctagggctgccataacaaaataccacagactaggcaacttaaacaacagaaatttattttctcatagttctacaggatagaagtccaagatcaaagggctggcagagttggtttcttctaaggacccctcctccatctccaggcagacagcaggcttgccgctgtgccctccagaaaggatggtctttcctctttgtgtggggaacactggtgtctcttctcacagtgtgtccaaatttcctcctcttataaggacatcagtcagattgaattagggccaactttaatgacctcattttaacttaataacttctcaaaaggccctttctgcaaatatagtcacattctgaggttatgggatttagggtttcaacatgaatttggtggaaaacaattcaacccataatactgacaaagcaataacaattattaattttattaaatctcaactttcgagtacatgtctttttagtattctatgtgacaaaatgataagtacacataaagcacttctgttacattccaaattatgattgttatctaagaggaaacacttgtgtggttgtttgagttgcaagctgaactagctactttttccatgaaacacacatttttgcttgaaagaacaattgacaggcaactatggttattcagacttgtagatttgccaggcattttcttaaaaacaaatgaacagagcctgtcatattaaaataaacaacttatagttgttgctaattataaaatcttttttttttttttgacagagtctcactctgtcacccaggggggagtgcagtggtgcaatctcagatcactgcaacctccacctcccgggttcaagtgattctactgcttcagcctctcaagtagctgggattacaggtgctcgccaccacgcccagctaatttttgtacttttagtagagacagggtttcaccatgttggtcaggctggtctcgaactcctgaccttgtgatctgcccaccttggcctcccaaagtactgagattacaggcatgaggcactgcgcctggcctccaccagtactctttagcctctgtcctttgagatgaaaggcgtatatccagggagtcattgccacttcaccctgacctctagaatgaagacacataaaacagacctaaatccaactcacatcttgaagccaagtccaggtggcctgcagaccagtgagcaaaagtgatacatgtttgttgctgtaagcaattgaaattttggggttgttatagatcacaattacaacaaaaatagctgattaatacagatggtgggtcttgagaggattctaccttcatatgcttttaactctatgtctctagcaattatgaaatggcatacctaaaatttttggtggtttcctattatcctcaggacaaaacagtatagcttacttgctcccttaaatgcagttgcattgaactacttacttcctgaatgctctgtgttctttcatatttctttgcttgagatgccctttccttcttctatcccccaattggtccgtagtccctctgtattttcagggtcttagctcagttgtttgcttccctgcgaattcctaaatgactaccccagtgatctgggttaagtgctcacccttttcggaattttcatagcatccagtacttatctctattttcgcactcaaaaccctttttctttcttcttcattaggttgagacccttgagagaagtgatctgtcttgttcatccctgtataccatgtaccagcacagagcctaacccagtgagtgctcagaaagtgccttctgaacccattttaaggatgaggtatctcaggttcagggaagataagctagtaagtgacagagccatggccagatcttcccaactcccaggttctggctcagtgcctggtactaggctgccttatggaatactgccttaacatttgtttagtggtattaaaacacattggtttttaatattagcctgagttaaacatggttggtaagtttaatttgttgtgatttactccataccatatactatattctaaagctgtatagaaatgagtttcacattgtctacatatttggagtattcaagtcatgttctcttccactaagatcaattgcatctctggagaggaatcctcgaatgccacagctgggagatgtttcaaagatcatgtattcactctcctaggttttcagatgagagagtctagaaagatccagagaggtttcacaacttggccaagtcacccaatttcaaaagaacttacaagaaattgggtatctctatcccagtgcagtgatctttttggtacactaggcgaatgtcttctttggtctttcattctggcatttatggtttgagactgtttcagcctgtcagtggatacccttccctggagtggccctaggatagtctgggcaacctggtcctttctttctctgtgtagattttaatcgttatgtgagatgctcttctgcaggaatggggaagagcaggcacaaggtggatgaatcctgaagttcaactattcctggaaggagactgtgtcatgttcttttttccaggcaaactcattttcagaggaaagggacagtgttggaggctgagttgactgtggtacagttcagtcctggctgggttgaggtctcatgcttgggagcaaatatatgggatattaagccaagaaatgaaacagggattaaacaggggcatcctccaggcttagaatatttgggattgtgaactttgagctagtgttatttatctctaccccctgcttctggtattaacacacacggtttgagagttgtagacagactacggcgtgttttaaaaaggataccaggttgtttaacagacttcaaaccatgtcctgggaggaatagctaaaacatatgggagactgtagaccaaaggaagggaggtatcatagtgatcacagtcttcagatatctgtcagagaagagctggcatatcagaagacagttggattctcatgtctgcttatgcactctacctattgcagtatgttggtttggttgaaatatatgaggaaaatctggcctcacatagatatgtagtatgaaaacaaaggagtattttaatagcttgttcaaaatattgtggacatgatattctttatattgcaccataattatttgacaagaggtagtttctttgaaggttagttgcaatgtgaaatctgataccatcttagtgaacttatcatattctgttacattaaaacattggtttatcctgaaatttggatagaacgttcacccatgcatgcttcttaacccatccattagtcacttgagaaaattggttcgctgttaagcagcttccacctgttagcacacattttattattcaataccaaaatattacagtagctaacatcatcactggtctctttaagtcaggaaaaatttttaaatattggtgagctatctacttcacagtgacaaacataaatttcctaaaactctaatttttcctggaagcttagattttctaattagcaggctgggcacggtggcacatacctgtaatcccagcactttgggaggccaaggtgggcagatcacttgaggtcgggcgttcgagaccagcctgaccaacatggtgaaaccccgtctctactaaaaatacaaaaattatctgggtgtggtgggagtggctataatcccagctacttgtgaggctgaagcagtagaatcacttgaacccaggaggtagaggtcgcagtgatctgagatcgcaccactgcactccagtctgagcgacagagtgagactctgtcaaaaaaaaaaaaaaaagattttataattagcaacaacttagcttaggaggctgaggcaggagaatcatttgaacctgggagacaaaggttgcagtgagatgagatcgcaccactgcattccagcctgggcaacagggaaagactccgtctcaaaaaaaaaaaaaaaaaaaaaagagagagtgctggtggaaacccattatgtgacgtgtcttgaagcctcagcttagaactggcacaccgtcacttccactcatattctatgaatcaaaacataatgaagccccaatgtcaatagagcctgtagtaggaagccctgcaaagtcccatggcaaagaacctggaggtacacttctattacagggaggaagtgaagagttgggaagctgcattctcatcaggattcccaacttctgtttcctctaactaatcctattcacaccagtttctgatggctgcttcttgggaaagtcaccagcactagaaggagctcaatgagtctcatatgggtgagtcagaagcttatttcatcaatcagctacctcttgccatttcaaagactagtacctaaggccagctacactcaagagtccaagtgacagttctttattctcacctggttctccccatgaggccttttgctgtatgccatcccattacatcgtctgttattgaagccataacatttcttatttttctcttttcctatttgcttttttttaatcagcaaaagaatgttagactttatatagagagataacgttccttggagtttatggggcaggcatgcagctgtatgtagggtggaaagtcattacaaaggtcataggtaaaatagtcataattaaatcaaaccatggatttggataagactccagggaaagtgtgaagagtaacctttttaaattcctgctccctgttgataaatagcaacaacaacaaaattcctactcttctttcatggttaaagtttaataaggtcactttcgatgagcctatcacctatcatattgctttgttttgacagcactagaacagagatcaaaggcaaacaagaccagtgtcttgtgagccctgaggagaggttttgagaaggcaatgactgggtcaaaactctgaggtcaaacaagattaaaactgaaaatcatccgttgaatttggccagagctgctgcctctgattgctcaggttgtgccttcacaagggcatctggcagagaggagaagtggggctaaaattcaatgcgtgctctgccgccagccaaggccctgatgtggcgttgcatcttccggaaagggaaggccttttataaaccacacaaaagtgcaatctgttcgccaagcttgaacccaaggggctatctctacattcacccagcagggctgccttttctaaatcgcacaaagcaccatatgggctactggcctgaatttagcaactgggaggaggtcaatggaggggacacaattttaaatttacatgaaaaccctttgtaaactgtataacactattcaagtgtaaagcaggaagaggtgattcagaagcttagcaggtgacaggagaaattacactgaccacaagccttttctgcctaacccacagcatgtagaatctccatgagacgtttaagtacccgacaaactcctcagtgggaaaccatttgagggcagactggccagaaagcacagatgggaatggatgtgattatttctaaaagtccattctagtcacaaaccccaaggcagatctagccagtggggcagaagagccccagacagaagcacctgagccagcttggcctgacctaactgtcaggaccctttgatcttgctggagcttgacttggagaaaacatctggttctggggattctcaggggccatatagtgtgaaaccgaggggaagtttttgtaaagctctgtagcactgtgactgggggatacgcacagtgctacaaaacctacagagacctgtacaaaaactgcaggggcaaaagtgccatttccctgggatatcctcaccctgggtcccatgcctcaggagacaaacacagcaagcagcttccctccctgctttggggcctggaagggatagcaggaagttgactggaccagggagatgaccacagctgctgacctctcactcactgctgttcttccttgggtgaaactggcatttctacattttcttacagcacatttggggaatacaaaaaggcctttcttaaaaactattcttgtcttgttttcatgttgattctattgcaaaagagagttatatgagccacctcatacggaatttctaaattcaaacctctagagagatttacccaagtgctttgctttgcagtttgggaggatggatttgaagagagattgatttttttgtaggcaatcaccggccacagttgctcattctaaagctgactgctctgtaaatcacccagtgcttcatgccaccctttctcctcttgctgtgccacacgttatctgcctttaaagcagcagcactggtgtctgtaaaggccttaaccctggagtagtcatggagccaagacccacccctttgacagtgccagctttccaacacagagagctgagtatgggtctaggaagtgagagcaatgtaaaacaatagaaagcaacagttcagagcactgcatcaagtgtactgtgctggaaaggtccgccataggaaatatggtcctccatactcctcagacaacagccttccgaaagcaaacctgtccctacctgcagatgattaaccatctatgaaccggctgggtaagcaacaagtgccatctttcatggagctgagccttaaagatcctccagtcctaaagctgacgggaagaaggtaggtgggagcagcgctgaggtttttggaacgtcctcaagtgctgtgacaccgataaactcatctttggaaaaggaacccgtgtgactgtggaaccaagtaagtaactcatttatttatctgaagtttaaggttaaggcatcctccatctaaggaggcagaaataatcctgaaatgggaaatgggtgaaatagctagcatttaggaggactcctgggaagaggtgaaatatggttaatcctttccataggagaggagcagaaggtgtctgtaaaaaaagagtttggggcatatgaagggacccttctggctcagaggaaacagagaactctgcccagtccatcgaatttgggtcaggctgtagaaaccacagagtcattggcccaactccctgagcagagtcagaatggacacagaatgaagctgacttgagtccaggtggttttaccaacgtgattccaaacgttctgacctcccttatgccaaacacatcctcctggaagagctcagaactgaatccgtctcctgggcatggagggtggggcgagcgcaagtagtccctggtgttgcgatatttctctttagaagaaaataacctgtttcagacatttgtttctaattgtttgagctgcaaatgaaaactaggttactagtgagaaatatgggacattctggttcccactgagaccagattccaagcaggacaaagtgaatgtgtagtgcttccaactaagaaatgctttgaagtctccaggacacagccaggagagttccctaccactcaccagtgttcatcgtttttgcaaagagtatatggtgccagtcacttattaacagttatgcaagaatcaatgctaaggttgttgaaggattgtgctcaacacagaaggcatctttggtgtcctttcaatgacatttgaattcgaccgtgtcttgctaaaaaataaaataaaataagacagtggtctccacctggcagcagattccagttagatagtacatattaatcttaagtaagaaaatgtaataaaccaatacaaaaacccatttcgaaggtcctagggaagtctagcaataggggtcagtggtcccaaatctgcccaaccagctgttggaaaagaaacagcatgccctgccctggctgggactttggcactcagctcaggtttttcaaggtaaaagaaggctctagagagatagggtggtgatggtgggctcttctcagagaccaaatggggacaaagcagttccaggcatatgcaggcaaggaggctgaggaaggggaaggacaggcatgagcaacccaagacctcacacactgcagggagaaaaggggcaggggccctgccgtcagggagaaagacacccaaagttgtgctagtggagtcagtgcagagatgttcagacttttttaaaaaatcaacatcttagtaagattttgaaattttaactaatttgggcctttgcctttagaccttattatccttaaaattttcactaaaataagtttatccacaattccaacaaagctaaagactgattatcctaatttccctttgtttgccaagtaagggatgaattaagttcctctgtttacccatttacttggtccatatttccctaactgcggagtgcacagcacatattttcagatggagagacgttctttttatttgcatggatctatcttttaatggctatcagaatagtacaactaggctatcaaacccatgtgatttcaagtttccttttaattatattttaagttaaaaagtgaataaatttttttaaattattaagcaaattatgacagatgactatgaccaaaaaagcgggggagatgtgcttaattgaagtttgggaagtgctgaacttcatattggtgcatttcatcagcctttgaagtgaaaaagtaaggggtatccagagggggcacaacctagaatatctttgaatggcagcttctatttttaagctaccaacattggattaaagagactgcactgcaaacccagggcctttatcttctcagaagccttttgatgctttttttttccttgggagcttctttcaagttcttacttacggagctcctgggtagcacaaaactaacagaacaggtctatacaaacccacagctgtagatcccacactttagtcctctggatacagtaaacctggagagaccacttagcttcgtaaaacagaacagagaaacaggacaaaacagcatggaataaagtaatggaaacgtgtacttctatggtaacaacagcggcagtggggaaaagaggcatggtcgttgggaacatctgcgtggaagtgggccatgtgatggactttgaatgcaatctattattgtatgtcacaattatgtaactaccactttttgagtgcctaccatttattaggccactgggctaagtcctttaatgattatcacttcactcagtcctcactacgatcatgtggaattgaggtaccatgacttgcgttttatggatcaggaaactgaatcttaaaggggttcctcaagatcacacagcttagtaaagtcatcatttgaatcacctgcttgatgccagcatctgtgctcttaagaagtctgctcttccatcagggctgcagctagactagggcatgtgtggaggtttttcctgcctggcccagcctctgcctcaggtctctaatgagctccttttcaagctgaatcagaaacaacagttatgccacttcccttccagtgccatccccatcacttctctcaccaaggaagaacttctgaacccccgccaaaaccagttacccaaagcagcattccccttccccaggaggagccaggtgaggcccatctctcacattacacccctggagacccagggtccctaaatacagaaaggtccagacgatgatcagagcatcactctttccctcaagaaaaggagtccacataattctggcctcatcaaaatgtttctcagattccaaaagatgaccttcccattcctccaggcccactagcccttggcctggcatctggcactccctctcactcccagtcagcatctcccagaacagagcctttgcacctgcaagtccttccacctggagccattttctcccagggactcacacagttttctccctcccctcctccaggtctccactcaaatgtcatttccagtgaatcctttccctaccacctcatgtcactctgaagacccctttccctgctttatttatagccctcatgtctacttgaatctttatatgctcgtttactgtctgtttcccttgctctgtgagagaaaggactttgagttgtttcttactgcacctataagtacactgaaagcactaaacaaacatttgttgaatgagtgaatgaataaataaaggaatgaatgaatcagagaaaaagtcagctatggtataaagcaaaagaaaagaaaaatgaagggaagctggtaacctacagagccgagcctgagtcctggctctgcaacccatcacaggtctctgccacgaagtgccaggcactgttctgggtgccagggaatcgacatgaacaaagcaggcatgaacttctgccatattggagcttattttctaatggcaaaagacagatggtaaactaaataaataaataaaaaatatatacagtgcgttagggtggtaataagccctgagaagaaaaataaagccgggaaggagaataaagaggactagtgggagggaccagcatgcagttttaaacagaagagtcacagaaggtctcactggaaaggtgacagtggagcagagacccgaggaggtggtaaagtgaggcatgcagacctctggagagagagcacttccaggcagaggggacacagggctgcctggggtgtgtggctggaggaggggagggagtgatggggagagaatgtgaaaatgaggtcagattggtgatgggttggggagagggtggcttgtaggccactgtaaggactactgcttttggattcgaaagggaagattggggagtagaatggaagtcacacgtaacctagagaaaagatctagagagacagaaacctgaataccagtcctaacccacggccctaagaagtgggcaccctcttcatatcacataacaccaaaaaatagcttctgttctttttcagcaacctgtcccaacaatccttcctgcttgggagctctgttcttagtgcaattacattccccacgcttctagtaaaatgtatcttctctgagtttagccctaataaacattctaataattacatcgagtctctctagttcacagatgctgtatctaatcttataacctataatacggaagatgttatcctcacttcgtagagaaaccagataaagctcagtgagtttaaggaacttggccaagattacacacttggaaagggacagagtcaaaactaggttttggatcttctgacatccttctactttacaacgactaggaaccacccttcatgttagtgattctccaactatcatctacagtcttttaaggattgtaaactgatccgaaaaatccatattccctccttggtttttatgagtgacatacaggcaatctcatagattctgatgttcacgtataacagaaattaatttaactgtcacttctaagtgtgagagtgtcattgaagcttgctaaaatttgatatgcatgaatgtgttattaaaatggatggaaaaacttaattctattttgtactaagcagtttggctgctgcacaatacttggcaatgatgcaaaactctcagatatgaaataaatttcccctaaaaggttggaatgcatggtatatataacctgctaggtccctgcctcacctaagtgtagcccgaaggtggagaaccactgctctatgaccaacgttccacccttctttcctcttgatcaaaccaaaaaacatctttccagtctatattcattctctcttatttgagcacaaattctgtcagattgtaatatgggcaaaagcttggatttctatttgatgctagagtcacctcttgttccatcctgaaggacaacctctaagacggaggagaagaggctaggccagatgggacagaaaatcacatgggatgaatatcatgtgacttggcaactggggctagggttgccgtaaagggaaaagcaaggtagtttttggattaggtatgtcagctgtgccagacccctgatctttggcaaaggaacctatctggaggtacaacaacgtaagtaacctacttttccttcttatgaccactatgtttggcaattacatttgttaaatatttttctaagtcaccaggttaggaagcagtgctccagtaggtaatatagcaagggatggcttgaggaacaggaactgagtttccgataaaatccaggatggcgtctgtgcttcagtgagccgtcttgatccattgtccttcctagagagtttctattccctctacctggctccagaaagctaccctcctcaacatctatgcatccaccatgtacagatctaggccaccactgtgatcagactcacatgacagcacttcggggggtggacacaaggtgaaatgaggagcacgctgaaccagtaaatcagaggccaagttccaatctgtccaatgcattaactgacaatgcattagctgacaaactctgtgacttaactgcactgaactatagtttccctatagttagatgaaggatttccaagctgtcttccagcccttgcccactatgatcctgattatccccagaccaattcttatgaacaattgggaggaaaagcaaggaagcccaatggtgtgactgtcctattacccagtaggaattctgtgatttaatggaaaaaaaaaaaaaggcactggaaagggagtgaaaactctccctatgcatcccttaattagcccttgtgtgatcacagaggtttggaaaaatgatgccttgaggctcctttcagtcctaccatctattactctggttcaggggctggaaactggaaattgagtgaagcccaactcagccactcacttaaccacctttacagtgcctttgtctgtgagatggatctaaaaatatcacctcatagagtttatttcaataactttgttgaagtagtataaacaccagctgtttaagtaggaaagtatttatacaaatcatagtcatctgtgattattatagtcctttggatagaccccaagtcttttgcatcaatggctcttgctccaaccattgtgtccttccacctctcgctgaggcacagtcctgttgtgattgatttagttgaggcttgttgttacgtttctgcctacaacggccatttggcaattctcagcaaaatatgtgaaaatgttatcctgaagcaagatctgggagtaagagatggcaggttgaggagataatagcagaaaatctaaggacttgcctaagtgtcaaaactcagaagatagcagacatcaaaaaagctgccaaaatataatgctcagatctcagaaacccttgcaaagctctgtctccagctacacccattctgctccacccacccacttccaaacagatgaattagactgacagggagcaaataggtagcaaggtttttcgtaatgatgcctgtggtagtgctttgacagcacaactcttctttggaaagggaacacaactcatcgtggaaccaggtaagttatgcattttactacagctcagtgtgtatatttctttagggttgttgtagcgtagtcctgaatgaatggggcttcttgggaagtaaagagttccaaattagaaacccattgtttgttgcaaacagtaggggtaaaatttgggagcaaatgcattagatttctcttaagaaaatattctgtatatgcttggaaactccattctgaggcttggtattcataagttttttacaactactgaaaaaaagccctaggtcaggcttttagttttgggctccctagaaccaggaaaaaggcaagctgtggttgaggagggtctctccagtatttatgagggataaaagtcatggtcacagtgtaggaagagggaaggttagaaagaaaaaagtattacgaaagaaggagttttaaaaagaggatctttctctcctctctctctctctctctctctctctctctctggataagaagccaatcttgcccttgtcacttttttctgaacttgcattaaaccaacataaatggttcagattaaatggttctcaaggtcccatcctggcctgggtctgctgagagcagttatgagctcacctctcctgttagccctgaaactgggaactttgcacaatggttcaggagcctgtatccaatgtagaaacacagccaccaactccaggacaatagagaagtcgtggtcccctactggagacattgtctactggtagcctactccaatgtttggaaatccaggggctatattctggtagtttgggtagctgccaacagtcaatcactaagaccagtccagagaatagccttcagacaccttccaaaatgccaagtccattgggagagccattacctcttacatgattaggtattgattttgtttattcagaggaaataaataagtagggaatggtacatgaatgtggctaggctatctgaccaaaagtccaaaaagtgactggtgctgtcaacatggtctctgcctctcagagaataatataaacttatagggattctccactgcctgttgcctccagggaaatggtagaatttggtgagttttcttatctttgaggggagagagactagagcactgaaaaggagggaaacagaatcatgtcgtagctgattgtagtctgattgatgtttagcaaattgcatctgagcaaaaactactgtgtttcattttcccctaaaatcatttccacttgaaatttggaattatctgcagtgttagaatcaaatctttgaggctgtgcctttgggagtcttagggaagaaggaaattgatgaaactgatgcttagcccctctgccaggatgctgaccatgctccccgatgacactccattcgcttctctggttttcttctcctgcagtggtgaaatgtaatatgatgatgtgaagctcaggtaggggatgtgaaaattttcaaatcaaaccccaagtccttaaagctttgacagtgaataatggccctacacaactgtcattctcttttgcctggctctagcccaacgatcttgatttttggtgatgaggcagagtaattcacatggtctttatgttacattgcacatgatgactatatactcctgaaacttatatctggatccagagtcaggagaaattataaaacaaaaataagcaatgcaaagcaagcactggcttctctgacctgtgtccatgacacacagcaccagtgggctccctgagcagtgaccaatttcttgttcaaccctcaggtccttagaaagcctttcgccaagctcagggaattagaaagcaggttcgttattattgtgagactcagtctgagtgatgggggaaattaggtttctaatcaaaattctgtacttgtgacccaagagaatggaaccagagtataataagaatggaaactctttctataaccctcctctcctcaacctaacatttgttgtaagaaaggtcaagttaagtgccccatccctaccctcaagctattgtgttcttcttggatgcccctctcaataaactggaagttagattttccatcatgaaggcagctatttgtcacctgccaccctcttctcttgctctgtctcagccctgccctagtatctcttggatggggatatcaccctcacatctctatcaagcagttcaactattattagcttcaaagggaactgagactctgtgtactcagccccttggtctcatcaagagcagctttgtagttctctgagctgtggggtctctaggctgagaactgaggctggggaggcagggcacagatgttacagctcaggccccagggccagctccaggctagttacctgtgaggcactgtcataatgtgctcctgggacacccgacagatgtttttcggaactggcatcaaactcttcgtggagccccgtgagttgatctttttcctatatttctgggataatttgagtcctggcactggggctgcaatccagtttgcattataaattataactagtaaatgaaattataacaaggagacagagtattacagatgtgaaataggccagagtgaacacactagactgagtcacttaagtagctctgtaactctatttattttaatatatatactctatattaaaacaatagctcccatttatttctgaaatcttcagagcagcccaaaaaacacaaagaaatctagaagaactacactaagagttggagcattcaggtgcaagggagacagtgggagggatacttcagccccaattcctcaggaagctgcttcatctctgcacatccctttggctaagctaactagtatgcgtgcctccttgcaaactgaaaacaagtgtcctacagcttggaagattctggagaaaggtagttagcatggtcagagtaattaggtagaacaaacttttatttcagggtttaagttaaatcccatattggcagaaagtcttgaaattctgagtgacatttattacagttgttgcaattcttaggggatcagtaggactagctatgagaatctaaaacataggtgacttctaagtttataaattaagaaagactgttcaggaatggtacacacttttttggtattgtttaccagcacataaacttagcaatgtattggtgttcataaaaagagaaagtctgacaataaagcaattttccaaagaaataacacttgaaacacatgttgcaatgtaattatatttgtggactaagaaaaaaagactacaagttcttcaaagataaacgattaaatctttaatctaaattctggactacaatttcatacagcttcacgtctgggtttaagtcaaatacaaaatagactaggatgcatatggcaactatattgagtgcactccagtttttaaaaaggtttaattcagtcagacacccatttctttggttaccaagatgccaaacaatggattctataagacactttctttcaaacaatcgttttgaaaatataaacattaatgtagaaagagggattcagaaaaatgttttatcaaatcaatgtattatgctctatctgaaatgctgactaacagagtcagagcacaatatcataagtgcatgaccttcttcagacatctgtcttttcagttatattgtattattcaaattactcaaacccaatctccccagcccaaagtgatgatttgacaactgcctgatgaatttagcttttaaaattctagcaagccttaattatccaactaaatcagaccaggattaagagatactcttaaataaacaaggagatagggtgtttattttatggacaagtttcttttgtaacttgtaactcccttgaaagtcagccagagtatgtctcaaaccaaagtcaagatagtgagcaagaagtgttgcacttatgaagggaggtgagtgagcaatgcatgtggtttccaaccgttaatgctagagttatcactttctgttatcaagtggcttcagctatgcaaggaaaccaaacaggggaagttttctcaagcaggttgaaagcaggttccaagaaagccctttgaaaaatgtctaatcctttcaattgtctagaactaaagccaaaaacataaggaaccagattcttaggaataagtttcctgccctgagtgactgaaacagaatcagtcttttagttgagcttctcagcagaggaaacggggagaatgatgatggtagtgatggggggtttctctgaatagttgattttctaggaaaaccatgatcaactttggtccatttacaaagccgtgatcagcagaaacttcctgactagcaatcgccccctctcaaccagatataaccagttgatctggcagtagctctgctgctgtgaacctcacagctgaagcccaaattcagattcaggataaagcattagaaaaattatttatttttatacagaaaattagccaggtgtggtggtgtgcacctgtggtcccagctactcggaagactgaggctggaggagagtctgagccaggaggcagaggttgcaatgagttgatattgggccacttcactccaacctgggtggaaaagaccctgtctcaaaaaaaaaaaaaaaaaaggaaaaggaaaattacttattttccatttacacattcattaccaactttctgttcagcaacacctaatgtcttgattatagaccatagtaggtaaaagtacactggaattcaatgtatttttcatttgatatcaagaagcaaaattcacctaagtttcaaatactaagggccaaatttacaggagcaattaatattaaaagtcagcattaaatttaggattgaaaaatgtatcttgatcatcattcacaggttggttgtgtttcttggtttcaggtattaacagggctctttctttaacagttatttgaagatagcctaagaatttaagtccccatggacacaacatttatcacaattcaaaaacttcagtgaggcactgtgtgaaagaatcatcactacctctctcaaagcttcaagacttgtggtcttaaggaaagaaaagtatgcatgtacagggtggtagtccaaagtgaggcacaaaagaagagaaggccaggagggaagccaatcctgggaccaacattccacagttcctcttagattaaaacaagaatgaacgggcttcaattggttttatttctttaaggacttcctgaaaatgatcattgttatcctctgattaaagactcaaaggaaactatacagtagtcagtcccctacagaagaatgagtattcacctaaaggcagaaacatgtaccacctaccttcagcagatccctttccaccctttccagcagatctggaagggatggcacccttccgggaccccaacactgccatcctcagaacctctgagccagttatgcagtccttctcagaccctcgattctttaagtgacagaatgcatagcatgagcacctgccctgatctaccatccaagggcccatgcatttacaaaaaaccaactggtgcagagagatattcagcctgacctagattgtccagaggattgattaataaaacacagataatcggctggatgcagtggttcacacctgtaattccagcactttgggaggccaaggtgggcggatcacctgaggtcgggagttcgagaccagcctgaccaacatggagaaaccccatctctactaaaaataaaaaaaattagctgggcatggtgatgcatgcctgtaatcccagctactcgggaggctgaggcaggagaatcacttgaacccgggaggcggaggttgcagtgagccgagattgcaccattgcactccagcctgggcaacaagagtgaaactctatctcaaaaaaaaagaaaaagaaaaaaaagaaagaaaaagaaaaaagccacagataatcgaaacccagatgatccagaaacttctttgtagttgtcattttccatctgtgcttccagccctatctcctagcagctcctaactggaagtcaaacttactgcctttcatttctgctccccttgcctgtcctttcacagaggtggtaataagcccaggtcactaacaggatgcatggaggtctggattgtagtgtttggctccagggtaatcgaggtaatcaccactgtttaacccccacaaagttgtgaataatcatctcacctaataagttgattatatttgcaggaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacaggtaggccatttctagcttcaaggagctggagattatggggaacaagaattgggtgaaagggaagttagagatgtaactgtggacaaatcattctcagtatagcatcatgctggaaataagacttaggcccaactatagcctgccattggcaggggagggaaatgcttgtcatccctaagatggaatctaaaataaagcccatcttatttcttcctcatctctcctctttacctaccactgtccccttcatactagactctgggattgaaagtcctcgtgcattctaatccagtgctaaattccaacaaagggcaatgcggcctattgtggggctaagaatcctagttcttcccgcatattggtgtgcctggatgttgacctcatggtacaatgaaaaaggctagaatgggaagcatgttgtataattagctatgtgaccttcaccaagtcacatcctctggtcctcagttcactcacccaaagtctcctccagttttaaaagcctacaatcctgtgagcctcttcattcccaatgtaaccctgaccactgctgtttgttccagatcacgtaaaaccaaaggaaactgaaaacacaaagcaaccttcaaagagctgccataaacccaaaggttagttcaaatcaaagggccaacttcagaatcaagggttaaagcaaactctgtaattgtccactggggccaaaatgtatcagatttcaaaagaaaacacaaaccatgctgagcccagttggttctgcagagcctctgactctcccagcaaggcttacctggctgtcggcatcggtttcccaagcttgcctggctgggtgtcagcagcagcctaaggtctctgacggctatctggcaccatgctggacttgcaggccagaaagaactaggcagacttggggcaggctaatatcagtgttgcaggcccaatttctggaagggaatttaatctctccctgaagccaccctcttcactctttttcagccatagttcataccgagaaggtgaacatgatgtccctcacagtgcttgggctacgaatgctgtttgcaaagactgttgccgtcaattttctcttgactgccaagttatttttcttgtaaggtaagaattagccgcttcttattcctatctctacccacaccatgctgcacatggggaaaggggatttagaaatggctaagaaaccaagaagcattggaaagggaaaatagagacatacttagaattaataaggtaggctatctcagctactcagcaaaacagcaccccatttcctgttatcctttcattttgagtcagactgaaacccattaggtagtataatgtactatttttctaatataccagagaataaccctcactttcactccagggagaaaactgaagataaataaggagaattcatcttctttactgctattttgttcatcgaccaagagaccatgggttatttgcaaggccataagtaaagctttgcctgaagactatccagaggaagcagaacctatctttgtcctgataaagggaatgccagctcacactccttaatcataggaccagcctgtctatgtgtggatcagcctgtctttgggatgaacctacacacagcattagtagtgaacagctcactattagctactcaggatgcatacacagttaggtttgagatgtcaattatttgcctgttacttgcattccgttctcaggtaatctcatacacgaaattgaaaccagggcctgggtttgcgtgtgaggcttctccccctcactccttctccaatactcacaaatgctcatcaaccccagcttctgttctaggaacaaccctagactcagagtacttgactgatctgacccagacagtaaacatacccagtcatctcaaaaagggggtccagctcacctgttattttactaacagtcccagggacacaggcagtgtggctgggtaaaaagagagctatactaagagtcagaagatctgggttttatcctgattttgacactaacttacatgttaccttagccaggtttcttcatctctctgggcctgggtttttgcatctgcaaaacaaatgagttaaaaaaaataataaccaaaggagaacaaaagagtctcatgacttgtgccaacactgatagctgaactagctgagctattgccatgtgtacatggaaagtgagccacaatagattagtgatgtctgcaatggtacagtatagcaagtaccggccaaccccagactacatgacccctacgattccttctagcactggcagtctattctataacaactttcttcactgcaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaaggatataaaaagatataggactctttttttactcctacaagtgatacactttgaaaatgatgttttgttccttttgactttctttaccttttgaagtagaaagtgggaaccaacaggttcacagcttcattcctcatgaggcaaataggccttgggagaagaagagcgggtgcccttttatctaaacatggaaggctctgctcaactgagcactagatttgctacaaaccagcatcatcttcttcctcctgtcctcacggcttgtcccaccctctatgttcacttcaggagccacactagagattctgcatggcgtggaggaggacaaagtttcagcactttctgcctctcctaatactttacaaatgagattacatttgaatttgctaatactttatgagcaggcaatgaggtttccaaaatctcatctaaatactctccaatctattagcaaaaatcagagtaaaatacagaggaaaggcactgctttctgttaattgatttaacatgcatgaattagctccctctgagttccaggcactatgctgagagtacaaagaagacacaagtctgctttcaagcaactcactgtgaaagtgtttttgaagggaggaacagaaatgagacccctatctttccctataaaaacaacatttttactgtcttttgcctgccaatctgtatttgaaaccattggacactgattctctggcctgggactttggcattgatggttttctgcctttcttctcagcctctgcctctattgcatttattaaactgcattgtgtgcacctcgcctctggctttactctttgcagatcaccacagggggaaactcagctctgtgagctcactattagtcagccaaaagccaaattgaacttatgggtcacactgcactttcctgagccccaagcctacagaggccctgccttggagacccagcctcgggtttcctgctgcctctgctgatgccgctgttacagcaagagcaacagcagcacctgcagcgtggccagtgacctctgctactgccacccaggaaggccacagccttttccaggagcactgctcaggtgcagagccctagcaacccattattgtggttctctcagcacctatgtggagcatcaagtcgggggttatgaggttacaagtgaaagagtgactgtcgccaacaactccacttgccatccccgacagcaaactcccccatcatgtctactacaccttgtatgtgtaaggaatgctgatttccaaaacattcacgagttaccttgtgtaatattagggtgtttcctctgaagttgttaggaacaaaaagatcatattctcatttttcagataaaacaaaaatgccctctcctcaaaaaagtatgtatcatgtccagagtcattcagtgaggcagggatattgctgggagcagaaccaaggtctcaagattttcagcccaaagttcctgctataagaacatactgcatccccaaatgaggacaagatgtcaaagtgagtatcagctagaatgaacttcaggattgtcccatatttagcatataaatgagccaccctctagcccactatgccagaaacaaaaaaaatcctggcatatcacaggaccatgaatttcccacaccaaaaggagcctccagggaagatttaaggcaagagccaggagggattatggctgccttctgatctggggccatgatatgtgaactgtgagatggacatgtgtcacactcagtaggcattagaacagaagccccagaaagccaagccacatgcccaaggtctttggctccctcatcccctgttctttccattgttctatacagtggctactcttgtccactgtttctgaagagcacataaactgctgcccaaaccactcactgatagagccacctagggtacagctgcagaagagagccctggaagtgtaacgctgcatctctgggcctgtcattatccaggtatacgactttgagaatgtccaccatgtctctggactgcagtgtagtttctataaaataacatgtaaggcctcttctatttctaagattatatctaataactctaatagttctattaaggcagataattcaagagaagaggaaggagggactgattcccagggactgagggtgtgtatctatttcaacatcacatagtcagtttgccccagaggaaattttctctgccggagacaccactgagcttcaaactcagggacttggcagctggaattctggaagtcacaactttccaggagtgcctcagtgctctgcagtgaaaaaaaagaaaatgttctccaaataaaataagtaaaatggaggtgtcaaagaacatcaaggagaaggtggctggatataaaaagatgcgggaaaaaaaaagtaaattggtgaaaagtcttttaagtaaataactttgtgtctaacttaattttttttttttttttgagacagaatctcgctctgtcacccaggctggaatgcagtggcaccacctcggctcactgcaacctctgcctcctgggttcaagcgattcttgtgcctcagcctcccgagtagccgggactacgggcgcgagccaccacgcccggctaattcttgtatttttagtagagacgggtcttcgccatgttggccaagctggtcttgaactcctggcctcaagtgatctgcccgcctcagcctcccaaagtgttgcaattattggcatgagccaccacatctggccctaatttaattctgcaatgaaaacagatcaattcataataatggataaatggtggtggtgactaaaataaagacacggctgacggcctcgccttagatgggccctttacctgcacctgaacctgcatcctgaaacactcacagaaaatgcagcacaggcttgtcaagcccctttctgtatcgggacgaccagggcaccaggggcacgaagacagcgctctgtaaacatgcagttctcctttgcctaccaggagtcattcaggtggcaagggccccgtgagtcagaagtggggagatactctgcttctctgaagccagggtgctcccctggatctgaccaggccatttatttctcagaagacactttaggtcacttctaaaggccaggctggaacccaaaatggctaagagaaggatgccaagtcccagacatgacctgccctaagaggcagctctgctgagctgtgccccaggagtttgtgttatgacttcctgggcacctgcatcatagtgctaaaggcacagtagtaagtggcactgtcttcagtccttactggagagatcaccaagtgaaaggctttctgggtcagaatgtgtttcacagaaaaccgtccttgagtaaaatctgcaccttctgatctgctgttatccccataaaagacaaactgaaaggaataatctggccttatccggtaccagaataaatctggatttgaatatacagtgtcgtaagtgcagagcagtaccacctcactgccactcgccaccgtctggtccggggaactctgggttactttgtcacacagcgtgcccctgtctgggaaaaagacaatgaggaaatagtgaattctgcaccccccagacagtgagtacagcacatgcctagcccagaagaactcaatgagcagaggcaagagaaggacacagaaataaagccaaaggcagcaaataaccaaaaaccaagagtgcaagagaaaaagccttcaagagtcagagaaggagaaatggggttatagagcaagtggaatgtaaacaaatgaaactacttacagaaaaacaaaaagctaaagcccacagtaagaatcatcttttcttcatatcagggcagaggatatacaacaaaacagggttcctaagatctcagagactatctgacggttctaatgaaagaagacgggaggaaaacaagaggagactggcagcgctgacggtcatgtgactgattcagctgtgacttctagaggcaaatgcgctcagccaaggaaactgctattgctattatgattttggccccaatccatcttgaactaacacatatgacaatgaaaaatggattacttttaaaaaagaaaagaaaagaaaaacaaaggaagggagagagagaggaagtgagggaggaaagaaaactgcaagactaatgatggcgttcttggatatccaactgctacaaaagtagttcactctccatttctgtatcctctggtcacagactggtgtactagtccattaatcacatgtcgtactttgagtgacactgtctcatagcatctagcacggctccacacactttgttctattcaataaatggaataagtgaaagagtaccttggacaactcccttactcctctgtgtaaagaggaaggaaagggggttggaccagattctttctaaaatctgtcctagacctgaattccagaaatctttgatttcagatgcttgagggagtgtcctgatcctaagtgcttcttgcacttcaccagcttgactttccatctctcactgggcccactgcagcacacacttggctccagctggaaaatcctgaacagagcttcccggcaggtgaactgccataagtgggttataagcttgctgagatagtgttcagagtgcccatgtacctggggtggctggagcccctgagccagcccctcccagtcaggagcactacaaatacagttttccatgtaagccatcaatatgacaacagttgggaggcactgctgtgaaaaacagaacactgactaactcactccccaaaatgcaggagtgttcctaggagtatttctagaaggtccttcatttccctttttccctacatccacttcatcagtaagacctgtcagttctaccatgaaaatatatctccaatccatctacttcttccatctccactgcaaccaccttctataaacaccatcatctcttacagggactgcttcaataacccactaactggcccccttgcttctgctcttgtccctggacaatccattctccagttcttcataaaatgtacatcagatgatgacagctggacctccttcccaggcctgtaacatctgcaaacgatctggcccttgcttcctccccagcctcacctcacatctgctccttctctttcttcccttcagctgcagtggccttccttctcgtcctttctatgtctctcttttctagctacctgaaactctgtctccaatttttcacagttctcagctccaactaaattagtcacccatgccacccataaccaacctcaattacatctctgttcttattttccctcacatcactatctgaaatcatcagattcatacatgtttattttatgtctctcccatctcacctctcccctacacacacacacacacacacacacacacacacacacacacacacacacacacgataatataaactatatgagggcagggagcttatcttttcactgatatgtctccagcccctgggcttgtgttgaccgcatcacagacaatcagtaaatatctgtgtaaaaaaaaggaatgcaatttcttcacttaaaaactcaccattcacctagatttaggaaataaaaatacaagacacccagttaaatgtgcatttcaaataaacaacaaaaatttcagtaatacgggtagctgggacatgccatatttggaacacatttatactaaaaaagtattcattgtttatctgaaattcaaattccactgggcatcctgtgttttatctggcaatgctaggcatgcagaataccaaaagtaagcaccaggcaggccagagtcccaccatgagcatcttcagggcccctggatgtggaagagggatgttgagggcccaggggctgccttgccggtgcattggctgcccaggcctgcactgccgcctgccggcaggggtccagtccacgagacccagctccctgctggcggaagtccatttcagagcttccggttctcccaagtccaaggattatgctcactccccacccacagtctcttagtgtctgtccctgctctaaagatgttgtctgggcttgatattaatatgagagctgactgttcccttcctgatctagaccataaccatcttcaagttaaattgctcctcctcttctaactgcccaacctcacccacgtctgaccatacccaagcacagagaagtgggtttaatggaccttcacacagaaggacacatcctctcctataatgctttacatggaaggttcagacataacctgagtcctgcttggggtagcatcatcatgactctcttgccctggtgtccttgcaatattccttgaaaggcatccctcccccaaggaagggcaggcactgagcacagcaatgcagtataatggctaagagtgggatcccggagccagcctgcttgggttcacatcagctccggcttttaccagttgtgtgaccttaagcatgccctaactctccaagtctcaattgctccatctgcaaaatggagatagtaatagcttttctcacaggactattggaaaatttagtgaggtcacacatgcaatacacccagcagataaatgatctatgaatgtcaggtattgctgttgcatatttaatttaaatgttgccatttttattaaatagacatatgaatagagttcctaagagtgttactctcatcaatgctgctcagggaaaagatgctgagtaaatctaaattttaaagttgcaaaatctagcaaaagattgttgatatgttgtatcaatcaatggttaaaaaaaaaagactgacatctttaatttgctttcagtgctgcaagcatgtcctagagctccgtgatcccctgagacctgtgatcctctgagacatgagccagctgtgctctccccaagtccctaagagcattaggagcatgagaagtgagcattccagccccttgttcttatgtcttccaaacattgtaacaggcttgttcatgagaggccacaatgcatgatcaagtgaccccaccactgaggaataggagaaagcctcaagattcagtggcccactaaggacgtattgccctaagtttctccaacccatcttcctattggcatctggagactatgcctcttcccaaggtgctgagggtgctgcagaccccacttgccctgcaggccccacccgcccaccagcgaagaagggctgcctttcattagcccaaaactgccactcaagaggggtcctcagacaaggtgggagccaagagatttggcgaacgtcacccttgtcccacagcttggatcttgatcactcatatcactcagaagagggacttttctctcttgtttcctttgaggtgggcggctttgtttttgacattgtagcgccctctgctgctactaattatcgcatctccataaataggtcatactggaggttgatagaaaatagatcagggaaggaaaacattctttgttcacaattcaagtcaaagctgctgcttctgtctccattcccttttcaactctgagactggcagctgcttctctgttggcccaaagggactatcctccaccagtcacccaaagaggactgtctttaaggatatgagatagcaccctaagaggataaatggacattttcttgtctacaaaaagcctaatgcaacagtagaggacatagggaaatttctttggatggatagagacaagtgcatctctttcttacgaaagaatagaaatgtgattaaaaaggaaaagcctagaaacatctgaacgtgtggaaatgggggtgagtgggctagagaaaggatttctgcatcactttcttcctgtagcaattccatccgagatccctgggacagacctggcctgatgaatagcaggaagcacaccagggagggacaaggtcctgcagacaaccttcaccaccaggctgggacagcgccatggggacccagggcctctgctttggggaaagaccttgctgagggccccatgggcaagaacaagtgtgaagaaccctactatggttttttgcccaatgccctccacaaagccagcgtttgaaggaaaactgtgaggaagaagggacactccatggtgttgttgttgccaccgctggagcagcctgtagcaagaacagtcttggtccaaccaggtcagtgatactttttatgatggggctgtgtgggacctgacctgactcttgctaaccagatttctaaagccatctgcagggtcttttctcctattattccccagggcagggagggcaaacagattatatctccattatcaagagctaacaattggtagagactatgcggagcatgctggtaagaaagattctgaggccacatctatactcagaggaagagagtgatgtgtttattagcaatatttaccaagggagcagaagcaggaggcaaccccacaccattttgtatttcccattcctgctctcgatgtcattccctgaaatgagtcctgcagagaaagaataatcagagccaattctccattggattgtccttttggtaaagggcaaatttttccatttctgtcttttccatggaccatttcccctgctatcaattgctgttgcctgcagcctaagaaataaaatttttaaataaatgagaacgttctataattctctctaaaatcataaacaatgtgtcaaggccaaacacttccctggtgtgatttattcctatgtggactcatccttgtataattagcaggaataatcacaccctgagccagctggcagagcccctggggacagagaccacccaaagaaggtccttgttctcctgagtcacataaagggagtcacacaaggcgggagtggaactcaggtgtccggagttctagtcccagctctgcttctacctatctacatgaccttgagcaaatttatcccgcagagcttcagcattttcatctctaaaatgagggcattggcccaggcagctgttaaatttccttccaagtctcacattctaggatgctaatgtgtaaaattatagaactgacccaagagttattagttcatatccccctgtgcatgttgcttgaactcctcattgcccagcaggaggaaaagggaaaacatgtttcttcattggggggtagcataatttcctggttgactatgtgtgactcatcagagcctggcggtccaagcccatatgccatttgaaatccggttattattacatctgggagagagaaaagtgctgaaaacagcctttgggacactatcgatttggccaaaaaaaaaagaagaagaagaagaaggctctgtctagtgtgataacattttgttatcttattcattgtcttcatccctgaaatacactctgctctctcctatctctgctctgaaaggcagaaagagggcagccctctccaaggcaaaatggggctcctgtggggaacagaggggtgcctctgtcaacaaaggtgatgccacatccctttcaaccatgctgacacctctggtttttgtaaaggtgcccactcctgtgggtaccgggttaataggaaactgacatttggagccaacactagaggaatcatgaaactcagcaagtaatatttggcagaatttttttttctatctgaaaattatcagtgagagattctaatgtgccttaacaaacaggaacaaaagatgagtgtttaatacaattcaatttaacaaatatttattaagagcctacagttattcccatggatcatctgagtcagtttccgaggaaacattatcgttgccttaagggagctggggggttgtcaacgggccagaggtgggatgaaaaatgacaacagatttacctctgggaccgggacatggttaaccacagcggccctgggtaagtagcttagcttcagaagaaaatgtgcccaacagcatgggtaacctaaaacaccgggcaatccaaatattcttttatgattggctttagcatgtattttattcttttgtagggcaggtttatctcaccaattatatattttcttaactgacctgtaaaatctacaggggaaaagtattttaagaattatatgtttctgcaattaggctcccagcagtcaacaaagaagtggtactttttgtctttccagtgatgaaaaagggaacctggcatccctggtggcccaccagcgtctccttccctggcctaggtcagaacaagccgtaaatcagcaggccgttatcttcttataaatctgtagagcagggtggacaacaaaaggcagcctgctaggttttcagaacatgagttccttgtgtagccagagaacctgggaccatcctgacgtggctggtcctgctgtcctcacagcctgaatcccaggctgtatgaataggagaggttcaagtccagatgactgttcacgatgctggtcccccttgcatccctaatcatgctagagacatgaccagggtctgagaggaggaagttacagcacagcaccaacaggggcttttggtaaagggcctgggcactatgtgaagatcacctagatgctcaactttgggaaggggactgagttaattgtgagcctgggtgagtacctcaactccagaggtagctttagcggaacccctctatacctaacacctggcaatcagagggctgaaacacttggccagataatgaattctcttatccggtgggaaaaggctgtaaagatcaaaccacctttcctatgggtaagcaagagtctgtagtttatgtaaaggcagcagctcctgtgggaaggaaggaaacaggaaatttacatttggaatggggacgcaagtgagagtgaagctatctttaaaccaaaggtgtcaggttatttggtttggtttttgaattatctggaagttccaaagaaagaacacttctccctgaggatttgattgcaaaattctgacttcaaacttctaaaaagatcaaatgttaaatcagatagtaggcttggaaaactctatttctctatgtaaaaagtagagaactacttttcttttgtttgatcattttattttgtttaggaaataagaggattagataccctggtggtgagtggggagggcagggacatttgcacagcatttctggataaattagatccaaataatcaaatcaaagactctcagctcagaaagtaattaaagatctcctcacccacctctttaattttgcaaatgaagacagtgaaactcagagaggttatgaacttgctcaaggtcacacaactgatcctgatatcaaggtccagggcaaagccaagacagctcatagttctcaccagcccagacccaagggagaaaaaaacatcatagtccttggccacggcagcatcatttgcatcccaaacattctttacccaagacttaatgaactcaaaaagaaatcctgagttccaaagggaaataaaatcattctgcgtctgttgaaaaaaaaagcaagctaaagtggaacaataattgaacttgatattaggggaaaggtgcagccatctgcagactgagagaagggtgaaaaaaacaaaatgaaaatgctagtcttgtgttcagacaatgattatgaccatagaacactacctataagttctgtagagctaatttctttcccagtgggttgatattctatgatagattgcatcagcggtgtgattgttttggaccatagaatacgtatacagaattggcttgttgagccttctggtgtcttgaagtgaaaatcatatctctggacatatctgtcaggcctgaagccctaggctactggaaagaaagataccatgacttatccttcctctaaagcttagaagttggagaaaaattctagttcttgggaagctctgcaaagcagggttcgttaagctgatgccacaggtttttgcaaagcccctcagcacagtgtttaagaaaccagtggctctaggttgacctttggggaaggaacacagctcacagtgaatcctggtaagtggaggggagcattgaatcctctgcctgaatgtatccattttatgccaatgaattgagatatggcttcttgccccatctctgccacattcaagtcctgcttggctaaacaatgctcacggatgtgcacgtgtgcagtgggatgcagctttttctaacctctcacaaaatcacgcaaccccttcaccaaactgcttggtggctcttctgtgccctcacagcccttctagtttagcagttagaggaagacaagtgcccaagggctttctcatttttaggtcattgtggaaagaggaacgttggtgatatgtttgcctgcttgggaggaaaataataatgatgatttactcattggtttctatatgctagttgatgtgctgcattctttctcttatcacatttaatccttataccaggtctgtgagttaggtgctattattatcctcattttatagaagagatatatttatattttatatttctatagaagcacagagatgttgaataacttgttcaagccgatgaagtaagaaagagaacctggagtttaattcttggcactcagattccagagctaaaagcttttcagtgaggggattatgtctagagggaatgtccctgatgctctagtctctaaggttgctaagataatcgctaaagaactgcgctctcagcaagtaaagccaggggttggtcaacaggaccacggtgacccagttacatattcttaatccttacaacatcatcaagcagttgctgttttccccactttacaagtgaggaaactgaggtgtagcaagttaggaaacttgtcctgagttttaaactcaagcctacctgccccaaagcctgagctcttttaaattaactgcaactgctgaccagttagattaactaattacttaattaataagataacaacctaacaggctgtaaggtaaaaaagtaatcagatttgttctataggtcccctcccttttcgggaatagctatacaattgtataattttatgcttcccctgggagagtgggtggagccctggctcccagcccgtgatggaagggtcttggcagtatttgtaaagcagtctgtgggggtgtaactcagggcggatctgaaaagctggtctttggaaagggaacgaaactgacagtaaacccatgtaagtctgaataatgcttccaaatttctccctggaaccctgatttccaaattttccattctgttttataacccaggtccaaaccacagcagtcccattaatggattccagtgcaaaacaactgctggtgtattcctactacacgcaggtctctgttgtttgccctcatgtgctattttatctaatagctgagaatgacagtaccaatggagcactgagttaaggagtcagactgttcgaaggcttcattcttcgttataattggtgagattttccatgggactaagagaaaattgattaactctctgagcctctattttcctcctctgtagaatgggggaggcagttcctgttcccattttaccacagccggcgtgctgtgaggggatgttggtacatttccaataaggggacaatgagtgtgaagagaaaggaaggccccaggtggtccgtaaactcttccaccagtcccacactataaacagctggttttatcagggggattcttggatgacaagtaagcacttaagtaaatatcaaggggagtttgggcaactgagtttttgtagatcctcgtgtcattgtgttatactggagccaatagtaagctgacatttggaaaaggaataactctgagtgttagaccaggtatgttttaatgaatgttatttgtttccaaacataagccaccatccttagaaattcagtgaaagataaccgaatctcctgcccagttattagcatctttcaccatgggtctttctggagaaaatgacaatgtgggcagcccctgactgcagcccctttgggactgtttctttaacacctttaagtacttgggaatgttcagtgtgtttttgttaatgttggagatatgtgtctgacaaatggaatctgaattgaagttttagtgtgtaggggcagaaagcatttagaaaggacaaaagaaggacagattagactaaaatacataccaatggctgggagtatgcaatgcaacccaatccaaaaggaaacagtgagatgtagcctgctgattaaacaactgagccagcactccgtgtcagctgacttgtcttcccaaagcttccatgttggtgcaattaggaaaagaattgtctaatccccataactcaaaatcttggagccaagctaaattgggtaaagccgtgtaagattttctggtactgacactgactacaagctgatatttagggaaaagttaagattgaaagcaaatattcaaattagtcagaaagaccacgaacttctgaaaacaagccccagggtgctgttaactgctgcatttctaattgggtcctcatggaacattttcatctctgccttgtctgagctttctgcaccagagaagccccttttgatacccactcacttctgagtccctcattgaaaaggtggcaactaagcttagagaaggattccctaatccaaatgcaatacttgggggaatattttgagtattgctccaccattctcaaaacaaacctaatttcagttaacttgaatgtagctgaaattttgttccatgagggaatctctgctttctatgataatgcaagctcatttcaaacaattgtttgggatttaacttttgctcataattcccaaaagataccaactattcaatgagtatcttaaaataaaactacttttatgaccaaattattatccccattagaatggctagaatcagaatgtcctagtatgtattatgtgaaccccatgcgaccttcctaaagtttcttatgcctaaaacagcataagagagaaaagcatttccacgctaacctgtgtgttcactggttaacaaaggtctaaagagcaggtgagtcagctgctccatttccaaactggactggacatttacagtcctgcagatactaaaaatgataatcaggaaaagcacacacaattctactttttcttataattcccatctttcccaaagaactgttataaattctctcccaaaggtgttatattcatccttcttttgttgcctctatttgtgatgtgtactgaggtgaaatatttgttgagattcaaaaaccccatgagatttaacttaagctttccctgtcagagagattctaagagctaaaagatgggaagctggtatttgggaactagattaaaaagaaaatccaaattaatcccaaggagcaaggctcaatagatagttatttagacataacatgtccaccctgcaagcctagttgctcagttgactgggctgcccctatcttagtcttgcctggaagagaaataagttgtttgccccatacctgtcttgagaaatgtcagcctccagacctgaaagcttcttgtgatttggtttatttctgtagagtttattattatacacagtgttcttgaagtaatagagaagtgcattagaagctcctgcaaatggaaatgaaatgtaaatttagattgtaaatacatgactgcggtaaatagatagcaagaaaaaggatgaagagattagaaatttgccacatttctctaaccctaaagggatgtttctataaatagtttaaaactgtagaagacgaagggggaggaggaaggagaacagaggcaaacagattttctcctaatcctttccatttggcaaaattagaaatggtttttcaattaaatttccctgagcagaggaagaaaccatgtctgtttccacactaaaattcctgtgggtgggagtctctagagttgatttggaggatggatccctgttagtgacaagtgctggtaatgctcctgttggggaaaggggatgagtacaaaaataaatccaagtaagtgtggagggacaagaagatctcacagtgcaggatttcccctggattttctgcattgccttttcacctttcctgtcttagcacgacaaattaggtcccagatgagcaggccctcgcattcaaaccggaaattttaaggaggaagccagattaactttactcgggagacctagtagactctgactttaaagattcttttaatccagctgtttttagggagagctctgtaaaagatgaaagaaatgttttaaaaaaaaattaaaattctgtggggtgaaaacaaagatgttaaatatttgattggcaaggcaactggaaaatctggaccatgtctacaactgctaaaggaggctttgtgaaagagaaaatgagcagcccaaggagatcctgtcctaaacttctctggccagtgaaattcgggccattctctgccacagccctggactgctaggagggcagatcatatgtcttcctcagtggggagaggtgggccctcgctggcagtttctgtaaagcctcgtgctgtggtgtaattcagggagcccagaagctggtatttggccaaggaaccaggctgactatcaacccaagtaagtatgacagggtgaagctacatgcagctgagtacagtcttttcctttctagaccgtgtcctgcaagctctccttgagggacgtatactcattttgcattgtcctttgtagagaagcagaccaggaaagacaggaaagccctcaaatttccacttttaaacacctccctgtaaaaactgtctcgcttccctccccttctacaatcagtttctagtaaatcagaatccggtgaattgatatgcaatttcaacgaaaaaaaaagcagagaaatagttaccccaacaagtgcaaaaagtagaaactatctgagtaccagccaagggaagataattaggaaagaaaaaaaaagaaagaaatggattactggaaccatgatggcagcttagtcacaaagaaaatgataaaaaaaaattaaaattaaatttcaaaaactttaaagatatatacatatatatatatctatatatatatgatatattgtcctctggaactccagcactcacctacagcagctgcattctggacttattatcaaataacctataaacctgtagcttaatgaagagttgagcaatcgtgactatattgacccccaggacccttctgcaaagagcagcttctgttcctgtttctgtaaagccttctgtggctgtgagaatagtggaggtagcaactataaactgacatttggaaaaggaactctcttaaccgtgaatccaagtaagtttgaagggagtgggggaaggggggattcaaacacttctgatttaattacttgcccctccaaaacattccagcttaggttccaaatctaatgtttgtgctggggggatatggtgcccatcagagggattagaactccactgtacaaagactaaattactttcagcccaaaacattcctatcattcatcttaaacaagattattggtgcaaggagaaaaactgaatacagaatcctgagggatccagctaagggtcaggaaatgtttgccgaaaagataaagaggaaattggcatatcgtgactacgcaaatgcagtagaccaaatataaattgtcctgacttagatactaacactcctcttaaatttatcgcctgaaataatggaaccctgcaacttcattaactaatgctgaaaattctataagcaggctccttttcttcttttaccttcactttacctctctgaaaagaactgttctcaatccccagtctggtaactgaggtccagtcagttaactgtctggttaactcaggcagagcatttaaccccactttttccttggttaccaaaatagtggattcagcctccactttacttagttcacctgagaaggggaaaattcatctgtcctctgagtcgtgagaatagagcagtacattctctccttcaaatatacacccacccttccctaatggtaatgtgtgagtacttagaaaagtttttaaatgttagatataaaagtaaggcacagtggttgctaatggcacttcttgaaaatctgcgctgctggtggacttctgaaagtggtgcttataaactaaggctggagaagactgacttgtaaaattcagataaaatgaaaatgggaaaaacttatcaaagggccccggtctcctaagtgccctgatgttgagtaaaggccaaatgccccagttttacttactcagatctgctttctgtgattaagaagagatgcacactagagagaggcactttgaaaaacacagcccaggcaaaattcttaaaaagactggctctggtggcggggcgggtggtgaaggactcagggacaccgtgcatgcagcattgagggagttaatgcagacttgctagcagacagcttggaacgttctgggataggccctgcctgaagaacatgcagtgtggttagccatcaagttcccatgtgcagaagtgccttgctcagcaggggcaaaatcagcacgtctgtggcaacagcaacaatgaataatatatgatgttaaatcccaggggttccgcagtctccactgaggtcttatcaaattaaagcttcaaggggattcatatgaacatcccaggagactcaaggactcagtcgcttttcagagggtgggcagccaatgctagggaccagacagtaggcttttttctttggtttcttaccggaagcacactagggcggggctctgcagtgggttttccagaatgcagagaagctgggagcccctctcagcacttggtcagcctcttaggggactgagaactgtaacaactcctaccctttaaaacattgacgaggtcagggtgtttgacagcctaaccaggcaaagaaaatatctgtgcaaggctagcattcttccagagctctggacagtaatcgtatgccagattttccatgcagtggactctagctgcaggaactatatggcaaggctggagtccaaggaacccatgattaaattctgttttcctgcagtaagtggaacacagagattattgccacagcaacactttgggtgcctgtctgtttgagggcctcagctgagggcaggcatctggttttgcttatgtcctgcggaggctgaagagagggtgggaagccctttagacagtgaatactgtgaaatagtgaagagatgggaagggtcgtttgaatccctgactgctgtccttaaaaaaaatggatacgtcttcttagctaaataatagcctttttctctcacccttttcatgatagtaagcaagctaaaactttaaccctttgtaacaagtggttgcttgaagacatgactaaacaggctagcataaattcagcccaaaaaaagtctgagttaagaaaactaaattctattaaagaggtgtctgtttttcacacccctggggacagggtttgatcatcaccacatcatgaaactgcctggattttgctcttcacattttttgtgacatccagacacagccagggtgactcccaggattcctgtggttgtgtctgttggcaacagaagcattatttggtcaagggatgaaatttacaggaaccccaagtaaatgtgcaaaagcctgcccctaatagagacctcacttaaccctaccactgtggtcaccgggctgctctgtgaggtcagaacacctcaggtgagactgtggagtaaccagatgccctggttttcctgggtttcaggggttttccaggacaaaggtcattctttgctaagcccagaatgatccccaggatagttaatcaccgtaagaaggcacagataaaaacttttttctgtgagctactacttacatttcaccaaattcaagactgacaaaaaaactacgttgtgtgaaagctcagttacatgtgcccatcatttttatttcttatgctagggcatgaagggaagctcaggagatcctgtttcatgaggctacagtctaaatctcatctaattctagtcagtctccaaaaagctgaacactctcctcttgtctccttgtaatcaattcattgtcatcagaaatgtgtgacacctcgaggggaggggaggacgtgtcttgaaaactgatcagagaaattgtcctgaaaatgatgctgtaaaatggaaatgagacctttagaaagagagatgctgaacatgagaaatcagtaagcctcaagacaaaaaccagaggaaatggagagagatgggaggcaggaagccggacctcgggggacgcagcaggtcagtgtcccaggaccagaggtggaaatggtcttccagcctttggtgggatgaaactgagcctcacagacccaggcccctttgggtgagtttattctccccagaattaaaagaggaggaagtctgcgagcttcagaagtccccctagggttcttgtaaaggcctccagtgcagtgctaatgctggtggtactagctatggaaagctgacatttggacaagggaccatcttgactgtccatccaagtaagtgtaacaagacacagcagtatactggaaattctggaatgtcaccccagtgtcaggttttaaagaaccagatattgcttaaagttaagtggtgtcctctgaggtcctttctcttctttaacctcaatattcacagattttcttttggaccctgagttgttaggtctgtctccctgctgcgtgtacagctgaccttgaccctggaaagtcagaatctttcctgctttcagtgtcttctctggaggtgatgccctaacttttttgagggggaggtcatcctttccaaatgactcccctgagtaacctgttctaatgtttagtagcattccctgtcagaagtccttccttacctcaatcttaaattattcttggtatagccgaggccgtttccaccagcatcatccacaataaagaggaaaattgagagcggagtttgaataggtatgtggtatttggttcagaatgggttttaaatgaaagtggagagggaaaaaatgaaacctgaatgggaatctgaggtcttatttcaaatccctctctgtttcctgtctgtcatctccttttgcttctatagatgcaaaactacagagagagaggcggggagagaaaggatagacagaaataaacatccactgtgtccattccctgtcactgaaaccaccaggcaagggattacaattaattccaaagagtttcagatacacggcttaatacctttctccttgtggtgacttgtatcctggctgataattagagcagatagaaagatttggctttggtgtgtttgccgctgcaccccgctgggaagagacagaaacttgactgttttttaagattcataaagttccttctgtcagtcgtcgtaaaactccctgaagcagggagatgcgtgacagctatgagaagctgatatttggaaaggagacatgactaactgtgaagccaagcaagctggaaagacctaaactcacagtgttccttatgtacttttgctcccttccccgtttcaggccttttggctgtttcctgtagggattctaagagagtcaaatggaaatggattgaagagagtctgaagccccgtgggtgctcagaaatgataaatgaaaggaataagagacagaaagggaaacaaagttgaaaagcaggaatatgtctttcactgcagcttgataagactgagatgtgaggtgggtgtcagagaagggcatgatcgctccagctgctattgcagaacactctgttttcctaggatctctatcaagggcagtgtcctcttatgccaaagggatgagtcaagtccctatatttctggagtagctgcccttgtgcaggcatagttggtcaggcagacagcacaatcccagctcagtgtgtatggaggaggccacctgacattgccagctgtatctgctccattcagtggcagcataaatccataccaggtgggtgtggatttggaatatgccagtgccactacaaggctgaatgttgagttgttgtgatcatcttgaatgtgtgagatgcctccaagtgaagtctggttctaatgagcagggtgcaggttggaccaatattgcccattttctgttgagtttctccaagcccagtagtgtgggagccaacattgagagactgacatttgagctagggatcctattgactgaaatatgccaaagggatctgaaaggtcaaaactgccttcagagctcagcctttgttgttatctctctggcagttgtcatttcagcaaaatgcatccacttagaaagctcagctcttcattaggcagacaaatgagaacaacatattgaccagagataaggagttgggagcccagatctcagcctctgagagcctggcatttccagttctttaatcacgtgagccagtgagcatatgctatctcagagaaagcagatcaatggtgcctgaggacctggtgtcaccaagctagggcttagagacagaaatgagatgcagatggggatgttgtgtgaattggggaataatagagaagtgaggaggagacagggagttcaatgatgctttttaaaaccagcagcatgtgagaaattgtaatgacacaaaggtgaagaagtatgtattgcatataatcctagcaagtttcctaccattcccaacagaatctagcctcactgtggctccaactcacagatcctataggtaatgctgaatcgtacctgagatgccttttgaagtggcatcaagactgggctctaaaatctttaagagtcacctgtcagttattgtaaaggtttggatggctgtgtgaaaacctcctacgacaaggtgatatttgggccagggacaagcttatcagtcattccaagtaagtgtccctggggtgctgcctgtggagtgcgctggggctaacagtctcatacattagggcttaaatgactgtgcagatggcatcgtggttgaggacacaaaactgagagaatcgagatacattgactctgatcagaaaaaaaggtcacggaatagcaaacataggtttagtccttaaaaggtagcatagataacatgggacttgaacgtggcaatttgaaaaacaacctgtggtctatcagcacgttctcactgcacacgggggataaacaggggtgggggaataagcaatggacattgcatgataggggtgctagggaaatgaggcaggtcaggaagaaggaaggtgatcagagcctcatacggagttaatctagagaagatgaattgttccataagtttcacaaagaaataaagtccaaagatataataagaagtcctgattaaaatccacttcagaatcatatgatcatcaggagagaaattaagtcttaaaagaaaaagaagtttttaaatgtaggtccataaaacaaatggacctacacctttaattagacagcaagcagcacaagatgcacgttagccttccttttaatcccctctcaggaggaatcagtctctccagctgcacatggtcacagctgctctaagccctggagctccttcccagtaatacccttgctcctgtgcctgcacagggaaaggagatgcctgcctgcctgcctgcctgcctgcctaccggtctgccttttggtccgccgcttggtggggccccaggtgtaacctctggctgtctcttctgcctggtttttgttgagcttcctatcacagtggaacaccggtaaccagttctattttgggacagggacaagtttgacggtcattccaagtaagtcaaagaaaattttccatcaccattgtgttgagcaaaccctttaaactgcagaaagagctgtcaaagtctgctactctatttctctgcttctaggtataactttatctggaccagagtaaagaggcccccgacccaccccgagaatgatttatgcttggacaggtctttatttcattccttgaactatctatctgtctatctatctatccagctatctatgtatctatctatctatcatctatctcagaaatagttgtttttaacagttgattctgtgcctcacccaaattgtcattaactaaatgcagatgtgctgccacactgataaacttcattggaaaaaaagaaaaaaccaaacccagagaatgttccttgaacattcctgaagtgggggggcaggcgatgtcacttgcagtgacagctggcctctctagctcacccccacatctgtgccaaccagagaagctgggccctttgtagcacaagcctcaggagcagagaatggagggacattctcaactgagaggagagggactaggaggctagatgggaaatgaggtgactctacagaaaatcgaatatgggatggtataaaaggatgagaaagatggcagggggtccacgatcgctcttgtatttagacctgggggatgcactgatagataccacctggagagagaaagaggatttctgtttccctctgaagaaaaatgtggcagaaaaatcaaaacagatcgcacatgtcaagcctctcctaattacagcctttcattctggtttctctcagctgttccagcaggaaatggtaggaaagggtcattggtgcctttgatgttgtggaagcattgcaggaaggagatttgcaagaaacggggcaggggcttgcagtagagtctggagagtttagaatgatggtttttgcaatgacttagaacactgtgtatctaactttggaaatgagaaattaacctttgggactggaacaagactcaccatcatacccagtaagttcttcatccttggtcaggaaatcagcctgcataagattctggggatcatagtagacatgcaggcttagagaattttcatctgtccttgttcataactggtagagacaggtggcagccaaatatctgagttttccgggggaactccagtcctgactatttaattcaaaactagaaaatatgattcacaattctgtttttgctgctgccgtcaagtgctaatgtggcatgtgaagagaattcaggcagaatgactgcatcttcactttcatcttgtgtgataattttagctttgagtactgcaagtgtttgggagaaatggtagaaacatagaatatcaaagagacaagcaaaccaagagacccagagaggcaggcagacggaacgtcaggcagtataattttacaaaactaattcagtgttgtgtctctctctgcaaatggcaaggtatcgggaaaggtgctaagagctagtgctccgggtggggcaggattatctaaatagaaaactaagcactgatctcagggggaaagtttaaacttggaaatctctgggtttggttttttgtttttttccaatgaagtttatcagtgtggcagcacatctgcatttaattaatgacaatttgggtgaggcacagaattaactgttaaaaacaactatttctatgcagccataaaaaatgatgagttcatgtcctttgtagggacatggatgaaactagaaatcatcattctcagtaaactatcgcaagaacaaaaaaccaaacaccgcatattctcactcataggtgggaattgaacaatgagatcacatggacacaggaaggggaacatcacactctggggactgttgcggggtggggggagtggggagggatagcattgggagatatacctaatgctaaatgacgagttagtgggtgcagcacaccagcatggcacatgtatacatatgtaactaacctgcacaatgtgcataagtaccctaaaacttaaagtataataataaaaaaaaacaactatttctgagatagataaatgatagagagagggagatactggatatatatacacagttaatgacaatttgggtgaggcacggaattaactgttaaaaacaacatttctgagatagagagaaagagagagatactggatatatatacacagggtagaagaatgtagagagaaacatgggcaaatatattcttttgcacctacaattaaaagctgtggaaaatttgaatatgttcactttgtaaccaaagacaaccacacaaaatggaacggaaagcatgcttgcaacagcgagaactggaagtatggaacctttctgtcttaaccactcagttgcctagaagaatcttttttctattttgctgcattagaaattaaaggcatgagtattgaggatttgggtaggtcagacttttatagtgacaatcacattacaaagcacctcttagctaggttggataaagcacctttaaacatcaaagtctttttcttctttctggatgagatagaaaaatggtctctcctcactctgtatctaaggacagggggctcagagagttccagacttacaaagtgagactgcagcagagctgagccatgggacctggagggacccagtgacggttagtctgctccctcccacgggtgctatagtagccacaaccgttcaggaaaccgtccccaggtgagaacgtaacacacgcagggaaaatcccactgctactaagagcaactcagcataagaatgcattacccagcaagggacagtcagaggggctctaaaccagagccccaaatatttgaaaactttatgtggaagccagctataacaagttcgttttccaagccgtgcttccagaagctgttagtggttggtagttgctaagggttttgaaactggaggacatcatagcagagtggaattatttggcacaaggggctatgattagaattaatgagatgaaagaaaattctggctagaagactagaaaaatccggaaagaaaagatacagtaaaccttgggggagttgtagcatttatcctagtccaagcagcaaagagcagacagaagccaaattccaataaacaattggcctttttacttttacaagtttctgcaattatcacaatgtcttcagcttcttgggcaaatatcaacaggtcctaaatgcaaagtggaacagtcctctgtttccagaaccgagtagcttagccccgccccacacaccacccatgctcaaccactgtttttgtagaggagtttgacgctgtgtggaatatggaaacaaactggtctttggcgcaggaaccattctgagagtcaagtcctgtgagtataaaacacactcaagtcccaacctgggtttcattgcatattaaataaactttttctggctgggaagtatttgattctaaagaaaggaaaagtgaaattccaagcgcaacgcaagcatttcattagtgtgattcattaagaatttccatgggttgccttcgagagcgttaatcacatccattcactggtgagacccacagtttgaaaattgagttaaatttgaaaaaaaattgtcaccatctctgtagaccacagtgcttgctgtttgggtgtctagacttccaaaatggaacctcaatctgtagtttcgagcttggagatttatcccgagcccgtgacttagagatgtgtaagaaaagctgcacactgctgggccttgtagggcatttgtgggatcagtgtcatgaaatagcctgggtagacaggttggtgaggagacactggtgacaggtgtctgccctgtttctgtaaagctgctgacagccgtgagaagaaaagcagcggagacaagctgacttttgggaccgggactcgtttagcagttaggcccagtaagtctgagcagaaagtaagatatttatgccttttcctattatttgttctagcctgacatttgagttgtcctcctttggattccagatcaacaaaccatagtgtcttttcatactccttttaatatttgtggctaagggccctccgttcttcccatctgtcctacatgagggtcctgtggccaggtccacattcataaagaagccaacagtgatgcagttggttggcagtgtgtcaagaaactgcagtcatcatctccagggcccttactctggttatgtgtgtttcaagcttttatgccagcaacagaggagagggagaagtgaccagtagcaatgaccagggctattagctgtacctggtgtctgtgggtttcagagcagctgtggaggttacgggaggttcagggcatgagtttttctggcagaggagtttatgtaaagggttggcccagagtgtgtattcaggaggaggtgctgacggactcacctttggcaaagggactcatctaatcatccagccctgtaagtgcttttgcctgggaggtggggttcaaaatgcagtcctcatggggacatttctaaaccttggctcatgtgcttctggtgccactaccatttttggcactatcctacttacatgggaggttttgagccatgtagacaaggaggtgatgcagtttgtgctttggaggactcctgagatctgccctttggcaactgtgtttgagtaggagtccctcattggaaaatctggatgccagcagacaaaagatatgagcttaggatgggtcacaaacaaatggaggccactttgccagcagcacctttgcaacgaaaattgctttcataggaaatgtggaaatggctgtgtagatagagatttggccatttctccttttctgtctttataccctcttctctgcctgacttagggaccttaaattagagcagttattaatcatttgatttctcggccccatcactcatcaagtatgacaagagggattcattaagataaaacccagaaacagaaaggacaaagaattcaattctcaatgtcttcagagttgaacttgacaactcctcagccttaaccatctagtcagcaccccatgaccaactgaggtcaaagagggcaaccagcaggtaatgttagtcaagtgagtatctggccagagccagctgccctcataggaattaatactgtggagtttgggaaagggaaatgcatctgtgagggctcacccaggctgcccatctgggagagatcatggggagagttctgagtgagggagtgaacaccagatggaaagtcaagcaacaggtttctgttatgaagcatctcacagtgtaaataccggcactgccagtaaactcacctttgggactggaacaagacttcaggtcacgctcggtaggtaacagaaaccgtgaggtaacttaactgtgtgttcctttaaaacaggggatactgcagaggggatatcctggctggatgtagtccttccttccttccagtgggaggtgatctcactgaggacacatacctgcattcagtcagttcttgtgctatttttatacctgttacggaggctttcctttccacctgtgaaaacagaacctctctgctccaagcttcttcagtctttattaccctatgtatttcctttagaacagtggtttgggaattaatttatcatcaggactttgtctctgatgatatcactctgggcaacaaaatgaaagggctctcaaatagagaacagagagtcctgaatactcggataacttctccagagtgatatgtgttatgcgtaatgggatgaagtgggctagaatgaccttccaatgactgttttggagacacactaaggaaacttgcttaacatcctatatccttaacttgttagaacattggtgaagtaaagcaaaatcttgaccctctaagaacataaacaaatgccaactcctctcccccaaagcactgccatgtttcattatgtgcaattatgaaacaaatacatgataatttatatgaaattacatagatgagtagtttgagtattttgacccatgagtaagatgcaaattgtagaagttctcaggtagttcttcataaaaagttgtccctgaagacaaatagtgtacctgggcataatttgtttgcagtgttggtttatgcaccatttgggacctgtttgaaagctgattatgtcccagtgtgccaatttggggtctcaattaactgtgctcagtgccatgataagtgcccatatttacagtctagaagcatgacaaaatgaccccatttctgtaggaaaaggagaatggaactgtgtgtggcgtggtacttgtcagtgctgctcccccttgtccctgccatgctggaggtggctgcaagttttccccaggaggtttttgttagagcatgtattactgtgacaataacaatgacatgcgctttggagcagggaccagactgacagtaaaaccaagtaagttgggggaatgggtcaatcttaaaagctgacctgagtgagcaatggtgctgttctgggcagtttctgtggggttaagacactgccactcccaagaggatctaagtacctggtttctttgtgcctgagaccctgagctggttggaagtctgttagttgatgaattcctggcaatcttaaggattaggtcaacgaagaagtagaaaatttcactggtttcttcattggcttggctctggatatataaaaatgctaaatataagccgggtgcggtagctcactcctgtaatcccagcactttgggaggccgaggcgggaagatcatgaggtcaagagatgcagaccatcctggccaacatggtgaaaccccatctctactaaaaatacaaaaaattagctgggcatggtggcatgcgccggtagtcccagctactcaggaggctgaggcaggagaatcgcttgaacccggaaggcggaggttgccgtgggccgagatcgtgccactgcactccagcctggcgacagagcgagactacatctcaaaaaaagaaagaaaaagaaatatggctgagaaagtggcatggtgctcctggtccctaaagtagcccctgggacctcaatgttgacctcctgtgctgggtgggatgtttctgcccaaccttgctattgtgcctctggcacaagcattctgtcagaacccagtgtcctaggaacaaaacaggggatttacgatcaagttcagatctatctgcacagccagctgttaattttagagaactgtcctgaccttgcaaaggaactggaaacagaggctgcaaggtggggagacttccactagaggggaaggtgatctcacttgctcagccttcccctccatccttcccacctgttgattattgtaaagccccataggactgtgtgaattatggaggaagccaaggaaatctcatctttggaaaaggcactaaactctctgttaaaccaagtaagtgttggggattcaaagtcctgatttatcatcagtactttgtcactctgggcaacagaatgaaagggctctcaaatagagaacagagagtcctgaatactcagataacttttccagagtgatatgtgttatgtgtaatgggatgaagtgggctagaatgaccttccaatgactgttttggagacacactaaggaaacttgcttaacatcctatacccttaacttgttagaacattggtgaagtgaaaacaaaagcagtaagtgcaactaaagtgcaatgcagagtgagtgagaagagacttaccaactcctttctctgtgatatcttccccccaccttcacccttgaaccccacagaattgtttctgtccatgcccctggctgttcccagtccagaccagcacgtcgttctgctggacataggaaaactccagacttcataacatgtcacagggccccctccctcagatggcagatctcaatattgatcacccacatcactgtggggagtggtgaccttgtcagcaatggtctcatggaagagggaagctttatttacaccatcaagggcccatggatgacccacagtctgtgtgactgctgtgtgattggttttcagacattagctttaataggaatcataggagaagggacatggtggctactgcaaggggttttttgtttagggagaacgcactgtggaactcaaattccgggtatgcactcaacttcggcaaaggcacctcgctgttggtcacaccccgtgagtttttgtggtttactaattgtcctctctggaaagaaatccaatgggacctgttgaaacacagctgaatttaattgctatgcttagcatgcagttgttaactatgtctgatgtgtgagcaagatatgaatacatgtttccctggaggctggatttggttatcaggtctcggggcagtttgataaattgtactaatgctgcaatcactgtttttcaaaggtccacaaagcacgttatggctttgggaaaggcagagataagaagcaaagctttgtgatagagacagaaacaaggccatgaaaagggaagctaccaaagcaatggcatagccaaggaagtgtgtcctcaacagataagtggcaaggaccctgttgagttgatgcttgtgttgtctggtagaattaaaaaataagatgagtgggctgggcgcagtggctcatgcctgtaattctatcactttgggaggctgaggcaggtggatagcttgaggtcaagagttcaagaccagcctgatcaacataatgaaaccccatctctactaaaaatacaaaaattagccgggcgtggtggcgggcacctgtaattccagctacttgggaagctaaggcaagagaatcgcttgaacccgggagcagagattgcagtgagcctagatcgtggcactgcattccagcctgggtgatagagcgagactccgtctcaaaaacaaaaagaaagaaaaacagaaaaataaggcgagtggactgaggactccagtgaagggagggcagcaggagttccaagcttggcatggctttcttccctatcgagatagcagaacaatgtaactttctctagagagagaacagagcccttgatttatcacatcaatgcttctgtttaggtagcccccttcctcaccgtagggacaaagcaggcccccacatggacttcacccccttaactaggctggccaagccaaccctatgggagaggcagagaatcccaggactgcagagggcctccccatgtccactagattatctgtaataaaacagaatatttatccaagttgtgaagctgtgagggagagggtaatcgtgatagattataaaaagcaatattgaaaattatacaagctgtctccacacttgcagaattcagtgtgttttttgttgttattgggtttttttctgttagaattacagaaacaggggtgctttcctgcaggcaccctgtttgcaaaaatgtctgccatctcacatttcagtagtatttcatcaacaatcttctgcacacgaaccagctgtgacaataaggtaatggggctgatttgttaacaaatcgagtttatacatttcaatgagtggcctagtcaaaacactcagcttgaagcatccaacactgtccattgctttccccctccctgaaaccaccctcaaaggccaaaacactttctttttgtagcatccatgatggctttatcttttaaaggtggattttactcttgataatcaaaatcctttcagaaccaaggctattaaatagaggagagaatcgactagttactgatactgttttggatccaaaaatagatgtaactataaaataatgtcatgggtttgtttatgtggctcataaactggctctcggggggaatcctagatggaatatttcagagggttcaacagtcatttagatgcttaagtcctcatatgttcactaaatcagactctttaattaataaacatgcataaagatagcatgagattgaagaacttttgcaaactcggacccaatagaagcagtgaagactttctgtatgaattaagatataatccgaaataaattacttgtagaaaaatacgaggtcaaggcctttcaatggggaaagtgcatgtaatgccccttttattcatggagagtaaagctgcttccataaatggtaacattatgttggtttatgtagagacacataacactgtgactacctcaggaacctacaaatacatctttggaacaggcaccaggctgaaggttttagcaagtgagtattacagacaagacaggctgtattttaaaggttgttggtgttcatgtttgagggacaagggaaggtaggacaagggaaatacccatgtaaactgtgcaagctaaaatcactgctatctgaagcggcaattctgggtccctctactctggacaggaggggcgaaggagagctctgaggcttaccatgatggacttactgccgatttcataagaattgtatccatcattagcaaaatgtttatgacttgaaggcctcaagaaactcctgttaacacaacaggagttctgtgttctttattcttttaaaactatattctcactttacatttttcactcatttttctgcctttttttatgcgtctctcctctgtgcaactcaatgcttcatctgggcattcatattttgagaaatcatctcaagaggaaatcatgtccagatcctagcatgtcactcaaagctctctgaaatctgggccctttctattctccaaatttattcccactgattccctttcatgaatgctctgctccaggaaaactaggtatctccctcccttgaatatttacacatgcccacacctgtaccctgtgtccatacatcagacatcctggacccaccacctaaaacaggcttgcacaggtgacaaaatttggcctcatcatctctcagccttgagacccagcacaggcatcaccagatttagtttcataggaagagcatgaaaaatcatatcattttttaattaagcaggccaaggtaagagatccatcagacaaagaagcaaagtaggaaggagagagatggcttctgtaatgggtttgcaaaggagagctctgtccctgaaatagcactaatataatccaagtaggagatttacaggctgcatgtttcttggtttccctttggagtgctccattcctaacaccagttgttaagcccctggtcctgaatgtggccgggggtgaggaagtgggaggagaccatgctggccactcagtggtggtgcccatggagtttcgggctcagattttctgtgagatacctcaaaattgagagaagctcaaaaggatcatgcagcaaaaatgggagaagtcaccttcttagtcataagaggattatttctgattagtccttgagctgtgttatgtcctggggaagggacagtaagagtagaaaagtctctcctaggacaaggataggaagtggtgaaaagtccttttcctggtgactagcaaagcaggggatgaaaagatctggagttggagtccagggtggattccagggcagacaactgcataggactgtctcgagttctgtggattgaaaaggttgggcatcccttcagatgttcctgagctgacctcagtcagaggtgcgtggctccagcacccagaaggtgttgaccagcacaccaacccctcctcccaggtgggccgtgacagcttccctcaatccctcccactctgacaacagtctctctgattgcttttgctttggtgctctggacataaactgttactactttgtccaagtgaggtatataattttcagaacgctggagaattattatctaaaacaccagtggatacgctacaattttggcattcagtattctgggcttgtgcaggaaaactctttctttagaacatgtagaaagactatcctttagttatccagtgtggaaacagtcctgaaatccaaactgatactgcgatcctgtgccaggttattactgtgacaattacttaatattctctgtgctcacgatatcactccttccagaagatctttagggaaaacttagttcagtttctaggaggtttttgctcagccgaagatcactgtgtgaataataatgcaggcaacatgctcacctttggagggggaacaaggttaatggtcaaaccccgtgagtatctctgctgaatccataatgaatgctctaatttcaaaaggaagccgtagcactgagctctgttttctgttttctctacttaattttatcttttatattaattctaatggttacatgttatcgatacatggcatatgtatatatgaaaatggacatacatgtaactgtctggcgtgggaacaaatgtgctggagaaaaacagatttcttgtcctttttgtcttaaccatttgggtcagaaggtctgactgagtagaacatgggctgggtgagcactgcagtgggggaatccttctccagcagctttgtcagaattatgctctttgctggcctggtcagaaggcagctttgtcaggaggtggaaggatgaactagttaacctcagaagagcctttccactccgaccatgctgggaatagaccgccataataaacagtcttttccgctgcctctttagccaacgtcccagctggaggagcacgccggccagatttggggattgaaagggatttcctgatacacattggcctggtcggttttggtaaagctttctatgactgtgtaatgctggcaacaaccgtaagctgatttggggattgggaacaagcctggcagtaaatccgagtgagtcttcgtgttaactctgtcaaacctgtctgtgcagtttgaaatatctcagaaactgcctccttcttttttagccctgaggtttaagatatctagttatggctagtgttttcttcctgtccaccaaagctgaacccttgcctacccctcaatcaaaataactagatagagggatccatatgagcagggtaggaaggccattggagtgttcagctgttttcttagagagcaaatacattcgtgcattccaaaaaggcctgtgtgggagcactgaatattacagaaggtgagtgtgtagcacatttcatggccgctttagtctgcactatgccaacctcaccgtgggccattggtaaatactgttgctttctggccaaagacaggtcaagtgctgggaactctcgggactcacagtcacgctagtgacgtgctagagcacatctccccactgtggattatccagaatgactcaaacttgcgatataactcctgcatctctcagttctctttggcttagagccttattgtggatttgctagaggtaacaggaaaggaactgatttcatcctaattctagcctcttctgagaagttattctctgcaagagtcttcagggagcatcttacagaccacctacactattcagaattttgttccgcacaccacattgtgttcccagcagtgtttgctgtggcttttgctggggccaggtcctgagtcagttctggagctccaggcttggcaaagctggataagggcaaggggagttgtacagcagaaccaaagggcttcaggaaagacatctttgatatagacattaatgaatttctaaatgggcttctatatgctaacctgataagactctctggggagaaggtcatgctttcctttgcagctctaaatataagacacatgcagaaaaaaaaaaaagaatgggaaatgtctgttacagtgccaaaatgaagataatcagtataaatattagatttgtcttaatattaagtttatgaaatgtaagtctttcagaagaactatctcaggatatatttattaggtcaatgaaatattttatccatgtgactggtatacacacttcaaaggagaacccaaaatggcaggcaggggagggtggctaatgaaaggtatggcatagtagttaagaatatgaattttggaataaaactgtttgggtaaatcctaattcagaaggttacttaatctctttatgcctcttttttctcatctgtaaaatggggatggtaatagtacctagctcactgagatgttacgagatttaaagagctaatacctataatggactttgcataatggcagcccgattaaaagttttcagttaatatgtttttattgctactatgtcaggttgctggagggaaggaagaaaaatggaaatgatccccatttatagtttttgtaaagtacagcattagagtgtggctctggcaacacaggcaaactaatctttgggcaagggacaactttaccaagtaaaaccaggtaggtctggatgtttccaagtgaagtgcagttatccactctgttcattttttgtttaatcttctctgtctcaacttctaaccaaaaactcttactcttaggttatattttccttttataaaagtaagtagaatgtgtgtaaagtctggttgatatgatcctttctaactcacttggtttcagctagtggcaaaaagaagggtgtattggatctggaattcttaggttaaggctgagagaatgtgagtttggctgacttggaagaaataaaaacatcaaatgtgggtggttcacacaaaagaaggtgatttttcataataatatactaaagtagaatccacccttgtgaccaccagaattattcaagtacagtcttccaaggacaaaatgggtagcatggaaatgatatgtttttttggggggaaaaaacatggggagagagagagaaaggggactattagttgtctggattgttaggaaacatggaagacagcacttcttgttgtaaggtttggcaaaggttatcaccaagtagaagtccaaatgtgtgtaacatacccctggcaaacgttatagaagaaggaagctggggccgggcacggtggctcacgcctgtaatcccagcactttgggaggccgaggcgggtggatcacgaggtcaggagttcgagaccatcctggctaacacagtgaaaccccgtctctactaaaaaaaaatacaaaaaattagccaggcgtggcgggcgcctgtagtcccaactactacagaggctgaggcaggagaatggcgtgaacctgggaggtggagtttgtgccactgctgagatcgcgccactgcactccagcgtgcgcgacagagtgagactccatctcaaaaaaagaagaaggaagctgggagcagtgtctctcacctgtaatctcagcattttggaaggctgaggcaggaggatcacttgaggccaggagttcaagaccaccctgggcaacacagtgagacccccatctctacaaaaaataaataaataaaatttttttaaaaatagccaggcatggtagcatgcacctgtcatcctagctactgaagaggttgaggcaggaggatcacttgtgcccaggaggtcaaggttacagtgagccaagaacacaccactgcactccagcctggacaacaaagtaagatcctgtctctaaaaatatatatttaaaaatataaaataaataagttaaagaaggaggaaggagatgaagaaaatttggcttagtaggaaagtgtttttgtactgggcagaaacactgtgtcaaactggggcaaacaacctcttctttgggactggaacgagactcaccgttattcccctgtaagtccttacctcttgacaaaaaagctcttagtctgtaatgacaagttctcacatcccagacacctaatgaatttctaaatgagcttccatgtgttaaactgataaaactctctagggagaaggtcacccttacctttgcggctctaaatgtaagacatgttgtaagaaaaattgggaactgttaattgcagtgccaaaatgaagacagtgattacaaatattgggctagttttaatgttagatttataaaatataagcctttccaaagaaccatctcagggtgcatttattagtttgtgtctatacagcccaattgtccagttactttgattaatgttggtagctgatgcagatatttagggacttccttgagaaaacttctttgtgctcaaaattgcatgaattgaatggcacattacctaaataattgccaaatctgtttcactttgtgctgtatagactcagcctaataaaaacaaatgctgttgtgctttttcccagtctgtctcctctccacacagaaagtttccctttctactaaacagcatctcttcacacgaagaaaagatgcccagcaagccatttgacttattgctgctgctagtttgcatttatatgactcctttccttagaagggatgaagacactttatacgacttattagctaaacagattgacagcctaattaggaagagagaaacagatctgagtatctttttgtggctgctgttcctaccccctcgtgtagaacatttggtcagatggctctttgagacagaaataagacagggacgtggtctctgcttgtagtgtgggacgtctcagctgcacctaagaggttgtcacaggagtactaaataggtcagggcaactgacacagccaggaaaaatttctttcccctagaacttgtgtgtgctcaccaagcaaagcgtgactaatttgacatccattgttagtgtgtgtctacccttcttgcctttgttttcagacccttcctctctagatcctattccttccatctccaactcctgtatgtaaatccctgctctctcctttgaattcctgactgctatgcccatgcccagcaccggcacccccacgcacactgctgcctgcctctgtaaccatcagctgtatttctgaggactttcctagctccttgagtgatcctcaaatggctcagggcctgagggaatctttgctgagggttggccccagcagagccgctgcagaggtagaggtggccagcaagggacacagactgcctgcatgaaggctggagctgggcccaggatgaggaaaagcctcaggaaggaagggctgacacgaaataaggaataccatggcattcatgagatgtgcgtctgaatcctctctcttgcctgagaagctttagcttccaccttgagacacaaaacatgtggttatgaagagatgacaaggtttttgtaaaagaatgagccattgtggataggctttgggaatgtgctgcattgcgggtccggcactcaagtgattgttttaccacgtaagtatatcttttctcatttctgtgggctgttatgtccgtaaatcatatagaacagttcttcttatgcacacacacacacacacacccattttccagtcactgaggagaaacagtctctgggtctacctacacagccagtttgaccattaagatggtcaaattcatttttcaagataattttaactggttccatttaatgctgccaacagccaagggcattagcatgtcgtgggaacctaatctatgttcactcactgctgtgggaggacagtcatttcttcttctcccctggcagtcagacttcagaatccagctgaccttttccatgcctgtctcttctggcagattaagtggttatttccactaactttcttgtggaaaaacacacaagacagatatattctccttcagtttttactaagaaagttttgtggttatcattttgacaataaacttcagctagcatagtccctactattcatgttaataatatcttgacttgaaccatcatattttccccacatcattcacaatgcatttcaatgctgtaacccactgcaccatccccagcccttttatcttcacaacgttctctaataaggtaaacaggatcatacatcatcaaacatatgtcacagacagaaaagctgacacacagacaagttaaataatttaagtcaaaccaaaaaaaaatcataactgggattagagcttgagattccctattttcttacagtgaagtgtcttgagctgtcacttaatgcattgaaaacataataagcacaggccataggcattttcagaacatgaaacttgactgaaacaaaaactgactgtttgattgctttggtgttttaaatgtatccccaaatctcctttgctattgatagtcatttggtgccagtgacagggaagagcagaggggcttaggaggtttttgtagatctcagtatcactgtgtcttataacaccgacaagctcatctttgggactgggaccagattacaagtctttccaagtaagtactagaaaccaaggagccattttgaaaaggtgttttctttttctttttcttttttttttaaatgaagttttgctccttgttgcgcaggctggagtgcagtggcatgatctcggctcactacaacctccacctcccgggttcaagcgattctcctgtctcagcctcccgagtagctgggattacaggcacctgccaccacgcctggctaatttttgtatttttagtagaaacagtgtttcaccatgttggccaggctggtcttgaactcctgacctcaagtgatctgcctgcctcggcctgccaaagattacaggccactgcgcccagccttaaaaggtgttttctataaacaggaacgttctcacagcactgcaggccacccttaccaactccgagctctgtaggggcctttagcacctatagctgcagaaccttctataaaccaattaatctatatgtgaacaatttaacctatatgtgaacaccatggtgctgactaaaatcttatcagcagtgaaaagaaggcactagagcgtcagatgcattatgactctaaacaaatgatctgtttccctcttttgcatttttatttaaaatatcagggaaggtgaagcaagttcaacttctccaatttgaaaactgtttctgaattatgcttcccttgtatgcagagagacctagattgactttggatgtttagtcattcgatttaatcaaatgtaattaaatgagcaaataatctccaatagccaatattcctatgttgtttcattgttttatgtgctttgctctagactttttgtctgggctttgtctctaataggatccccggaaggacagtgaaggtttttgttaaggtttttgtgtctgtgtggatagcaactatcagttaatctggggcgctgggaccaagctaattataaagccaggtaagtctcagagatgtgactgcacgggagaggagacactagttgaataatgcacaaagtgtagcatgcagattatatttttaagaacaagtcagcctgctggagacaatgcactcaacccaaatggggtctccactcccagtgagaagcatgtcagccgctaactcttttgtttggtctagtagcttccggaatgaataatgcttaagtagccctctaagagagcagaccaggttgttagggaatatctaattccctctgatatggttaaaactctttgccaagggcagaaaccagcctcattccattggaagagcaaattcagagaaaaaggaaagggtcacacagccaaagacggtaaaatgttcaaaggtgaaaaatagccaagtctgcagctctcctgacatccttgctcaggctgctgtcccacgtggagagcagatgcctgcaaagctctcggtcacttgctggagtcactcagggttctgggccttgggatgtaacttaaatgacagtgtcagggcactgtcagaggaatatgaaggctgcagcgatgcctgcaagtcagcttttgctacactgggactgaggtgttctaagcctggaaagacacaaagctgtcctcatcccaacctgccgtgcccctccttgagggttagtgtaaggctctgaaggactgtgtgaattatggcggtgctacaaacaagctcatctttggaactggcactctgcttgctgtccagccaagtacgtaagtagtggcatgtgtcaggtggattctgtgtccatggcaagtaggaagcgacagcacccttaggtggaaaggatggctgaaggttgactttgttcactgctgtcatctcttatctgccgtgatatagcaggctgtcaaaattcccattctcctggatggcacaccacagtcaggggaggagaaacatgctaattttatgataaaccccaggggagaaaaagactactgtgggaaaatttagttgagaaaatcaaattgttctcaactaaatgctgcaggctttatgcttctgtgaacccagtttcccagttattcattgaccctgaacatacgtttacctgtgcaaatacaatctctcctaacctatttatacaattatgtgtctgccggtccaaatgccttcttctataggccatgtttttatttctcttccaaaagagactccagagccatccttgggaagagtgctgagaagtcaggcaggcctaactcccaggggtcagggaggggaaagagaaggctaagggtaacttagctcagtactagaactgtgatccacgtatctgtcactctatttcctacgtttgcttcccttttgttttctctagaataagttctttttgtttgctctggacacccactgctcccaggatgaaaggagagaaatgagatcagttttgaacacttcctcttgaaatataaagaatcaacaagttacagtcatgttggggacttcttctctctccaagcttaaatttctattacgtaagccttacttttaaccaagaaagttagtgacatggtatcactgtctgggatgctcacccctctctcttttctccagatactccgtgtatactaaagctcagccaatgctcagctttgtgataaaggagctgttgtgtgtctttatctctgcctttaggatacagtcttttttataacagaaaatgttcacttctcccatttatttcatggctggactctctaccccttcctggctgaaacagcatatgggtccatggtggaacttctttgggaaaaaaaaaaaaatagaactgtttgacttttgccactcttccctcatgaaatgttttttaggctatcaaataagcattattacacattgagaaggctttgaaaaaacttgatcactgagtctggaggtgagctgggatggctctgtagctggaaaatatccctgtgggtgtaggaatgtaccgtcccttcaaacttgtgtgtttagggctgagctcacacatacgacagcaagagttgttaacaaattagattcagctttggcagttttatgcctagaaatgcaaaagaattttaaaagctcataagtttggcatttttaaaggagacattgtttgctttatgttgcagagccaatttttcttcctatcataaaaggccagaaacacagagaaagcaaaaaaaaaaaaggaaaaaaaaaaaaacacaaggagagtctaactgccccctcaccacagtgctatgtgtttggtagggttttactatgggtttcagtaaaggcaggaagtgctgtgggaataacaatgccagactcatgtttggagatggaactcagctggtggtgaagcccagtaagtggccatgttttattgatatttgaccaaacaaataaatcccgtgaagttagtggagatttaatttaatatgtaaacaaatctacttcttgaaaaatgacttttgtgaatacatgaaacactcgtgattattgagactagagcaataatgataaataaaggcaaaatgagaccaccccaaatcacctttaacattgtgcttagccctctttcttctagagagatatggggccatgagctatttacagccgcagtatctcttaaactatgttctgcaatgacttgtgtgtttactctgattttagccacagaatttgttttccattctattaaaaatgagaatctatctcattttaaatgctactaatatttataaggtaccttctttgtctcttgtgcctgcatatatattcatttcaaaaagatctcataagaaacccaaacattgtcgcattttgacaaatgtccacatctagtcccgtaatgtcaaatttcactaaaaacacagcctgactatgcaaatgcagtggaagaaaaaaacaattcagaaatggattgacactcccaggtggctttataaacacctaaaaggaaatccagagtgaaataaaatggcaggtatgataacacgatttttttttaatgatcaattcctccatggggaataaaagtttttaaacttacctccttgaaaaggagggaaataggagttcaggagcctggcattcccaggtgtgctcctggggtgtctgtttctccacattgccattttggagacaataggacccatccaaatgtccaaccaaaaaactaatattaagaggctggagtcaccacattgactgtctgttattaaaccctataacaggttataattaagattatggaatgactaacccaaggagctttaaaataggatagcctagttttaaacggttcagccttgggaaatgctggaagacaaggaaatgagatagatgactccataggtttgttttacgtctggtgaacatatccatcccatgttaattttttttaacgactatgataaagagcttctttggggtcaggtagaacccaaaggaggaagagaaaatgggacttggttctttaagtgtcaaacaaggatccagccagggttgagggcaatggcataaggcttccctctcttggtggtgagagaccacatccatggactgtggaaggagaacattttctaaaagacggggatcccttgggctaaaatgaatgatgctcatgacccccagctagggcagggctataatgagtacagcaaacataaggcaaggtatcctcagaatttggtgacagggcaaattctagaacttaaggcttagagccagggtgaagggaagactctgtaatgcagttccttctcaggtggaaatccagatatgtgccctaagtgacctattcctgccccatttttgtttgggctctgaaaagtggattcctagctcagtggctgtctgccaggtatcttttgccttcagtaacagaattatgtttgatattggaaaggagtttgttgtattgttggctttataattcactctcagtgtcaaatgaggtcattcaacttcctctcgcacatttgcaataagcagcatgaaattcaagcagaacaactagaagacacagagaaagatggctgagctgataatgaggcctgtttattacaggagaagagacaatataggaatctgttaagtcccatgaggttgaaatatccaccaaaaaatatgcagctgtcccccaaaaaaaagtcactaggagtttttgttatggtcccaatcacagtgtgaacagagatgacaagatcatctttggaaaagggacacgacttcatattctccccagtaagtgctgtttatgtgattttctgacattaactcccactgagttcaaactgctgagagtgttcagtaggaaagtttctaagacatgtgggtggcctgtaggtcctgggctcttctcttgcagaggtccagtcctcagcctttccacagctgagccaaataccaaattctcccctccaggctggaaaagttgctaccagtcctctgctacccaaatataaattatttttttattgtttattaagaagagtaaaagaatcgtgacactttgtccagaacctattttccagtcttttcccccaggcttgtccctggtaacctctgtttggactcattgttaagcccagcgtgatttttggctccaactaaattgattttggaaatgactccagcatacctatgacccctctccttccaccctccataaaagatttatttttctttatttggcctctgctgagattcctggctttgatgccccaggatctctcatttcccttgttccagggataagtgagagatgactttttaaagagctactttcatcttagagacaacaaagagagtatgccagcaagagcaacatcttgcattgagccttctcactctatgccattttccaaatctttttctttatttaggataagtgaccactcctttttatttctagtacagcaaagagtacatcatgatgtcagaaacagggatttcctttggaatgtttttcacaggctaacaataagctagaagtctgcaagcaattcagaaatgcatccctgagctacaactccatgtatggaagctcatcagcagggtagacaggcaaagcagaaacattttaattatacccatactttgtagagattgggtgagaagtgggcaaatgcgtgctaaggaaaaacaaaaactatggttaagtggggagatttctagatggttctaacagggaagaagaccaacaagaggaaacttccaggaaaaccaccaaggccaggcattcagggtttttgttatggaggaaatcactgtgggaattcaggaaacacacctcttgtctttggaaagggcacaagactttctgtgattgcaagtaagtgtttctagccatccttgattttgatcagcaatggcttcttcccttgaattatttttcagtgtacctagaatgcttttgcccccaagaaaggtttggaaggagctgggtcattagcattgcgcaggaaaattacaggttattctgttataattcgaaagccaactggacagtcatgaatgcacacagatctgggccctgcattgcaccctggcctagttgcctccagcttgttctgatcgtaatcctggcccagtttcctcctctgatcccaggagacaaaagccctgggcagagaaccagactacttagcctgggggaagcacaaaaaggcttgtctgagatccataagccttttttttttttctttttcttttttttttttttttttttttgagacagagtctcgctctgtcgcccaggctggagtgcagtggtgcgatctcggctcactgcaagctccgcctcccgggttcacaccattctcctgcctcagcctccctagtagctgggactacaggtgctcaccaccacgtccggctaattttttgtatttttttttagtagagacagggtttcaccgtgttggccaggatgatctcgatctcccgacctcgtgatccacccgcctcagcctcccaaagtgctgggattacaggcgtgagccaccgtgcccagccccaaaagccatttttaaatacattgcaggtttctatttaatgttgttattcattttgatttgcccaagtaatacattaaaatttctcattgtaaaccattcaaattacagataaagtccaggcacggtggctcacacctgtaatcccagcactttagaaggctgaggtgggcaaatcacctgaggtcaggagtttgagaccagtctggccaacatgatgaaatcccatctctactaaaaatacgaaaagtagtcaatcgtggtggcaggcacctataatcccagctactcaggaggctgaggcaggataatcacttgaacccgggaggttgaggttgccatgagccgagatcgtgccactgcactccagcctgggtgacagagtgagactccatctcaaaaaaaaaaaaaaaattacagataaaaccagcattcaccttggccacttccttcagtatcagtttcctcctccccaaaagtgaccactgaaaccagcttggtgtgttgtgatgagtttctctgtggaatatgtttatgtgaaatcccatcttcaaccaggaaagcttgagagggaaagggctcagactgcagtttgcaggatttcaattagatataaggaacagttgattagatgtaagagctgttagcaaaggaaaaccttataaaaactaggagctcttaataactagacaggtctttggtcagacaacacactgactgaggacaggaggatggattcgatgacctctgaaagtccagccaggactctgaggactctgaggaatggtctgttccatagcctgcctctgtaatgcccttctctcttgcctattgtccggttgttacagtctgagcttttgtcagagctgctcctatgctgtgagtggtctgattttctcagcatctctggggtttttgcaaagaaaggaaactctgtgcatactctggggctgggagttaccaactcactttcgggaaggggaccaaactctcggtcataccaagtaagttcttctttctggctaattattcttcccgagaagcctgtcttccatcatgcagaagctgtcaaaacacaggtggtgttttctttgcttggtttgtgttgggtggttagtaatatcagttggaaaacaaggttattaatgcacatattccctggggcattgtattcggacatttaatatccatgtagtctctccctgtgaaaatatgtgaacctccacgaaaagaaaggtccaaggaaagtagcagggaaaaggcaggaattggatgaaaatagccaaagagcctgcaggaatataaacaaggcaggatcccaggagacagagcagtagccactttgagtgaatttcccaggaggtgctcctgccaaggcccataccttcaaggaaaattaaggcaaatagaattgggctggggagttgctacttattagtattcctcccacgttctaacctaattataaggaggttgttttggccatgggcagtcatctcaggttttgttttcctgctttcctccctaacctccacctgtcttcctagaggcctgagtcaaggttattgcaatagcactaaagactgtgtaacaccaatgcaggcaaatcaacctttggggatgggactacgctcactgtgaagccaagtaagttgtgttcttctttgcctaggccttcaggggcaatcaatcaaatcattagtttgaaaaagactttaatcctatgcatctggttgggctctttattaatgttctttccccaggccaaagagagttggttctcttccctgctttaaaatgggatatgagtgcatgtatgcacacagcatgcccacatgcagactcttgctctagctcatggtaagggcttctcaggagcatatacaacattttgaaagaaatagagaaacaaacaataatgagccaatggagctgtcaggaaggttctccaccacccctgaccaggcttcccagcaggatctctggccatataggatgtgcttgcactatatcggatggtctaggatgggaaatatctctctgtaattaattccaaaatttggcaacccttattgccagaaagtacttctcatatctaagtttgatctccctgctgcgatttaaatatctacttgaaaagaaccactagaactctgtacatctgggattgagaatcaagtaactgccatagaatatgaggctgagcactaagcccacctctgcagcacctctgacgtgtcatgggtcccctctggacattttgagctcaagtaataatggattaagcaggatagcacaagctttggaaacagaaaaacctgaattcaagtccttgctccactacttacctagctgtgtgaccttgaacaagttacttaatctctctgagcctcagtttccccatccacaaaatgaagataaaaatattcctacctcgttgagtcatcgtaaagatgaaataatacagctaaagtagttagcatagtgctcagaacatagaaaaagctcattaaaccctcgctattaataataatgataaacatcatctctaacccacagcagagcctttgtttggcccctggggctcttctgtcaaggttctgttgtgcatcagcagcagagctggaattggggggagggtggagaatgtcagcctgttctatgaaattcttcacctgggatttgaaagtggaaatacaaagaatcctgactaatttaaatacaaaatcatccaagtgtcagaggcaggggagaggtttctgcagagagctgcatagctgggatcctcaaggctacacacacacgcttggagcagggatgcggttcacaggatggcagggcaaaggttgcagaactgaaaccttgtacttccccatcaccaaaatgaccccagcatgatttcctttaaggtgtcccgagccccttcccaaaagacaggctccccatgtggaggggcaatgacagagggaagatggaaactttatgggaagggctatctatcccaaggttgtccttctcctcttcagggtagtgaagctcatgagaaatatggctcctgaaaatagccactaaatgaaactctccaacctggaggtagaggatcagtaaagtctgcagaggcaaaatgaggcagtttatttcaaagaaaagaggttgagggcaaggtgggagttaagtcacacatctaaatctgggaaaggaagcattaaacagaagacggaggggctcggctctccacctccaccaggattcagaccacaggacatggctaatactgcaagaagggagttaggttagtggtaaaacctttctaataggtttttgaacagtgaaaatgagctgtcaggagtagttgccagggcactttctctagagagtttttgaaaggagatagacaccctgctatcagaggtgattggagtgcagccctgcctcgaggcaggaggagaaatgagagaacctcttaaagcctctttccagcccccagagcctgtctccatgaaaaaggcccaggctcattaatgcagagctgcatcctccaggacacagggggttgctgggttgttaagtttggaacctttgccggcttagtggttaccaaactccctttgttctcaagacttgacttgataaatgggctggctttatccctttaaagccaaaaacacaggttctgagtgctgtgttgtttgtggtgttgagatgcccaggctggagggaggaagctctagggggtttttgctgagcccagaaacactgtggggataactatggtcagaattttgtctttggtcccggaaccagattgtccgtgctgccctgtaagtacagttaagtggagatagaaaatgagtccagtgcttgatgtggggagaagctgcagggtcttgaggccaggagtccaccgtgacctcaggagtggtgatggagaagaaggttaaaaaaggaatgagaaacagaaccataaggacaatacagaggaagggttcattttcgggaaggaaaatcacaaggccgtgtgattaacgctggaggaaatgcactcctttggagggtcccttctcaggagggctttgtgtcggggaaagctgagctgttaggtttttgatgctgagataatcactatgcagaaggacaaggcttctcctttatctttgggaaggggacaaggctgcttgtcaagccaagtaagtgacatataatttatatgtgctgaatatgattatctccaagaggaaaacttgccctcttttccacgggtgcctccttgggtcaggaggacattaaaggtgttgagcagaccaaggcccagtacctcgtcaccttcttcatccttgaaggagctttaagaggtgtggacgggaagaaacccaccaggaccccaccaataagcccagccttgagacccctccactctgtcagacttgaataagaaccatctgagaacaaggtcttcctcagaaggggactccagcatagtcatccccatttgatagattttgaaactcagggcggggcagagtggctcatgcctgtaatcccagcactttgggaagctgaggcaggtggatcacttgaaggtcaggagttcgagacctgcctggccaacatggtgaaagcccgtctctactaaaaataaaaaaaattagctgggtgtggtggcacgcacctgtaatcccagctactcagaaggctgaggcaggagaatcgcttgaacccgggaggcggaggttgcagtgagccaagatcatgccattgcactccagcctgggcaacaaaagcgaaacttcatctcaaacaaacaaacaagctcaggcaagtagaggccagtgattaacactcttccaataggaacagatcccaagcaacctgcagtagtttttccagtaggctcgtgaactcaaaacatcaagttatttaaatgacagggcaaccgttgtgatcagctgtcatttgagtagtgctgaggactgggtctgaccttgagtaaacgcctaggctggtgggtttctatccctgcagcatctaaagcggacgcccaggcttcactgaccccagcagtctggctttctgcccttgccgcccgggaggtgcagctcttggcacacaccatccttagtgtcttgaaagaagagaaattaaaagagaaagggggaaaagcttatatctcatatcatgcagttgcctcattttgtagcaagattgtttccccatgagcagtttgtcttcattcagcagctgtcttctctggggaagccattttgtagaggtgtttgtcacagtgtgacaactgacagctgggggaaattgcagtttggagcagggacccaggttgtggtcaccccaggtaagccccattccctggagcctcacctgcccttagtatttggcatgccctgcatgccaaatatttctagccgagactatgagaaacacatctgaaaggaagccatttccctgaacagcagtacccaaagccattaagcaaaaatgagagatcagactggtgttaaatagaaacgtttttggataaatagtaattctcattattctctatcagtctcctgtgtgaatacccttatttcccttataaggaaaaaagttacaataagcaggatagccatgattcatgctgtggtgtgggagcaatctgctgtggatttgggggtggaggattagaaatgtgttcaggcagactggatgtgtttttgacaggatatgtaacacagtgtgatttataaccagggaggaaagcttatcttcggacagggaacggagttatctgtgaaacccagtaagtataaaattgtatccctggattaagcaatgtctgtggattaagggctgatttagacccaattatacaccatatgaagaatgtttagagagggggatgagcatcaaataggaagccaatcgtcgtcctggctaggatctagcatctcagtgcaaaatgggctatgtaagtgtgcctctgggaattgctcctgatatatgtgttgggactaaaatgtatgactggctacttgttgtattggctgggatcatatccctggatttgtgcagtaattggtgacaagatttctaattccttaacaaaccttctaaggcactattctatttggctaagattatgtcaatttatagaaggaaagaaccttgtaaataatgatcattaaccaaaagtaatgtgattagtctctctcaaagtctgaaaaaccacttttttttaaaaagtttactcatgactactgagggacacttcctgtttctgagactttcagccaaaaattcgtacagcgtagcctcacggagcagagagaaccttgacaacattcctttttgactttctccatggatgagaaaactgaggctcagggaagagacagatcccggccccacagccagtctatggctgagctagaactagattttaggtctctaatttgccaaacctgtcagttggctcaaacttgaagtttgaagagtccgcaagattcatctgacaaatattttcatgtacttgccctctgccaggctcgttgctgaaaccagggatccaacaggaagcaaactcagtgtgatattgccttcatgaaacttacattctggaggtggattccatgtttcttcccagatatgacaatgcttaccctgatttctcttgggcatggctctcttatactatcatcacttccttaggaaatactaaaactaatttttgctgcagtttaaagtccttgagcagataactaacacacataccactttagtcaggagaagggaaatgcccaaaagtgaagtagaaaactaggaatttgtctgataattgattattataaagttattttatcagtgtgaaatgagtggccaaattaactggacaatgccagctctgtacctacctcactttgattctatagactcagtctcaggaggattcaagaattcagacagttctctgatgacataatccagtgatgcccacaacagaggaggcgtattctctattctggactttgtgagtctccttggatgaaaagattcaagtgctgttttgacacctaaaatcagagagtatttgctctatacatatatcaaaaatacacagttaatgtttagaactttgtagtggaaagtggaaagcaaaggtcccctaaaagaaaatgggattgtaaagacgaaggagggttagtttaggatttgtagaaagtcagtttggctactccagaccaaacctagattaacagtgatgcaggcctaattcaaaaggaagcactgccagctctttattcagtgctttgccaacctggcctgtttgatctggtttttgttgttgagcaaatcatagtgtttcttctggttctgcaaggcaactgacctttggatctgggacacaattgactgttttacctggtaggctgcctcaattaaatactatttgcactgatttactaatctacaaatgtattctgtacatgtaacttaatgggcctgaggttgaagatggggagagacagcaacaatgcatactagaaagggtaatgtgagcagagaattatttatcagagaccaagaagagaaagagaagctttttgctaaggcttttagtaataggagttaatgaaaatgaatagaaaaaaatttcattttaacttagaagaattgctgaataatgggaacagattccataaggggaacctctgcttctgaaaatatttgcactaggaccagcctacgtgctacaaaaactgtctcacaccaagtctagttggtcacttacatttttagcctattctagtagctatttctaaataagtcttcaaacatagaggtgcctatatttaagatatttaaatgaggctctatttctatagctctctggtgcccttccagcaaagcattgctgtaacacattgcttatcatttctacaagtgagaacaagtaagcccctggccctccaaaattgcatgagtattataattacttggcttagattgaagtcacttctgtgttacttctcataactgtgttcatttgttgagatctgtttaactccaaactgtgtgggcgtctaactgttggcactaaggtttcttttctcttgaaattgccagcaaaatattttacccataaataatgtttcatctagacttgcaaatgacaactaacactgcaggctctttttttttcttttgctttgtttccttttttctgaagggaatatgcaagcaggaagcaaaaaaaaaaaaagccaaaatgtacagtttgactgtggggtctgggaggagagtgtcaatgtggatgctaaaatatacatggttgtataatgtaggtactgtcacagagaggctatagtgatcttattagatcatacatacagagcaccactggtcagctggcgttgctcggggtgtccttaagaaaagctcaggtctagttgtcaagtgcaacccagattcagatacagagtctcagagagaagcttccagatcaccctggagctaaatgcagaatatgaattttccccttagttaagtctacctgaggggaattttcatttataattaggaaaagagaaaggtaaagaacatttacttgcagtgtcctgtttcaaatattgtgtgcattgagccagaggacacaagaatgaacccaagcagaaaactaaagaaaagaaatcaataaaaccactgaagaaaaccagttgcccttatcttgcctgtctctgataatgaatgtgccttccctgctcattcctcactttggttctcaaattttccagggaattagcaaagaactggtagggttgggttagtcttggtctaatttggttagtcatctctggataacaagtctcctttttaggaagtgccaggggattttttgtaatgccaataaacatggtgtacaacttcaacaaattttactttggatctgggaccaaactcaatgtaaaaccaagtaagttatagttgcctagaagaaaaagttaccaacacattatgctaaattcttcttttcagtctgtatttcagttcttttattttgcattttgggtccccacccatgatattttattagtccttattcatatgtcacttgaacagatatgtagtaaacaaatctcatgatcgagtagacatgctgaaactgccaatgttctcaaggtgctattctttataaggaaaatgcccaaattttaactgttgctactgaacaaaagagcatttggatataatttaaagcacccctgaatgtccaggatttcagagaggagacatgacaaattaaaattatatgtattatttaaagatgaaaagaattagatcctcttgaaaatactctaataactaacatttcttcaacattcgcaatatgcaaagcacctttcataccttgactcatctgaccctcctaacaaccctctgggatagatattacctatctccgcttcacagatgaggaaacagtgtgaaaggtaaaactaaagcaaagaggttgaaatagttacccaagggctcaccgcagatgaggggcagagctagattaagagcctggcctgcctgtcccctagcccactctcttaaccatggtcttggtgaggtttgtgtaggcgacctcgcactgtggttctaacgactacaagctcagctttggagccggaaccacagtaactgtaagagcaagtaagtaagaaagaaaagtccagaataattttaagcaaaatggtgggtaggtttttcagcaatttcacctaggaagtgcaatgtcaagaactaaattctaagagctttcccagtttgtgttagaaccataatttttctacctcacacgtctccctcgccttctctgtcacctcagaacagctcctcctaaggcatgacttcacaatggtacatttgttggtggcgcagtctttgtggtcagataaaaactgagctaattatctgaaattatctcaggtctctaagtgagagagttaactcctttcaaatatttgaagaactacgatgtagaccaggtaaggggtgagtgtggaggccaaatcaaaacgagcaggtgcaagatgtgccccaacctcccctcaaacattgttgaacaagtggaactgccctgagtggaaaggctgctttgtgaagtatggaacttttcttccttagatatcttcatgccagacccctaaggttaaccatgagatgttgcagaaggcacttctatgccattttagctattagattgaatcacctctgggctccctttcaaatctaaatgctaagatcccatgactcaagcctggaggattaataggtgagctcagacttgtttcttctatttttactattttgatagccaaagaaataattcatcaaattattcataagctaaagcctacttgggatttttacacctagaagatggtggggtatgatttcccagtgcagtaaatgagaaaacaataggagacatcaaggaggaaaaaaagaaggaagagataaagggaatgtcttaagggaggctcagaggttgaatgaaggaaatgaggtgattttgcagaggacagatgtggctatcaaagattttacaatttcacctttggaaagggatccaaacataatgtcactccaagtaagtgagcagccttttgtactcgaaaatagggccaggggagcaaagtttcttccaatttaaacacactcaaaaggatgtgtaattgctttctgatgggagggaactctgaaggtagaaagactattgttaccacagatcacttgtccctggagatatagcatctgaggactgactgtctagcttagactgctgtctgcacaagaagaagacttacagatgcttaaggaggatggaggcaaattttcaaccctgtactccaaagctgaggggagaggggatgggaaacattagggctgggttcatgtaaaggggaccagcattgtgccgacagaggctcaaccctggggaggctatactttggaagaggaactcagttgactgtctggcctggtgagtgagtcgctttctattccaggaaaatattactgtggagaaattaaaaggggagatgaattaactcctttagtcttgaaactaaagagatatgtgtacttcccctcctggaggaccccagtcctaggtagattaggacgaggaagcagagggagacaaaggcgatggaaagtcccttttaggaacccaggaatcagagagaacttgatggtccccaccaaaggcaaagaagggaggtcccactaaaacatgtgagcatcctaaaacacctgctctggtccacccacaatatttggtgaaggacatggccctccacccagaatgggcaagcaaactagaccagctttctaaggtgtgtttttcttgggtcctgtgactcttggccgtctccctgtcagaggctccatctgtcgctgcactctttcttattgagaatggcctctccgtggttctctgtaaactttccccaagaagcctgtttccatgcttcctcagcacttagcctcaccgatggatgggctctagagtagctggagggagtctgggtctgaaactttcactgagaaagtaaagttgatccgcagtatccagtggatatggcagctgggaggacctaggactgaagtactcgtcctctctttggggcctttcctgggcactcgattgaatacagaaaccctgttagcaagtgcatgcatgtatatgagtgtgttcattcagcatttccattctgaatgtatgaatagccttactctgaagactccctggagcttacagggctttctgttttcagagaaaattgcctttgtgagacaaaaatgccaagtgggcccctgaatgaggttatggttgagagctattaatattatccttattcacagagcaagatccgaattcccaaagcagagtagacaataactatgtgaagggcttagacccaaatatgtgcccacttgcaagcattccagctctatgaagaggatacagtgctaggagataggattaccctgcacattgcaaaccctccacttttccaagaccatagaaaatgtcctttgttgagcaccaactgagtgttattttcttggtccctgtggtttttgctgggccttaaatcattgtgtgatcaaagctgcaggcaacaagctaacttttggaggaggaaccagggtgctagttaaaccaagtgagtactggggcttgacccacaattgagccttgtcatcaatttgcaattcaatgtgccgtattggcccaaattaatgtctcaaacttgtctttaaaatgtttcatgttgctcttatgcataaacatgcacttatgtacaaattcagcatggataaaggatattgtcatcttgacattttctagaatctattttcttaagagaaggcacatagtaaaaggtacttttcttatttcttcacatttcttaactgattttcccaagaggcagaggaacttggacgtggcgtttctgtctattcagagtagttgatttgaatatggtcacaatagcagagcaaggacttacaatttctaaggttcaaaatattgctctctgtaccagcctgcagcctctgatgaaccattattctgatttatttcctctggccctcatttttcccaattaatgtaactgaaatattggtaaccattatcttccggttcacagaaagtgtgtgaggattaaaaagtcgctgctctgaaaaggaattgagctggagggttttcttttgggggattattgttttgttgatggtattgtctctttcattgagggagagaataagaaaggaggcatacttgaaaggcaaggtaatatgatcaatacatgaacgtgtgcaaaataaatcattaaggcattcaactagaagccaaaaaacagtatggaccccggctcagccactcactcactaggcagccatgagaagatcaccaagctctcccagcctcagttaacctaaaatgtggagattattattccagccttgactacttccaaaggatgctatgaaattcagatgagataatatatgtgaaatctccttgaaagagatgggtggtcaaatgattcatgatttttttttttttttttttttttgagacggagtctcgctctgtgcccaggctggagtgcagtggcgggatctcggctcactgcacagccgcctcccgggttcacgccattctcctgcctcagcctcccaagtagctgggaccacaggcgccgcactacgcccggctaattttttgtatttttagtagagacgaggtttcaccgttttagccgggatggtctcgatctcctgacctcgtgatccgcccgcctcggcctcccaaagtgctgggattacaggcgtgcaccgcgcccggcctcatgatttttaatagttagattttatgcaaaatttcatttgagggtaaacttaaaggtgaacaagtttaatggactttggccatggcagagaaatggttaggtttggatataaggtggacctctctaattataagaaaaaaaaggaacatgagaattggtgaacaagaccttccctggagatcttcagaaacctgaggtcactcaggagagaaatgtgtgaagttgagagcttacagtaaatggtctctgaagtttcccaccattccaaagagtgcgtgagcttaaaatttttcgtgagtttagctaaatatgtgcttagtgttagattaggtttcaaccaagcaaaagaaccctgggagaagtactctgcttggaaatgaagcatcctttggtttttgtggtacaatagatcactgtgggttttcagatggccagaagctgctctttgcaaggggaaccatgttaaaggtggatcttagtaagtattattactaatgaattcttaattgattagtttttgagacaagtaataagcttttttggaaatctaagtggactgccaaatgttctcgatttatccatatttcatggggagcagaattcttcatgccttctccatcctcacttctgccaggtagcagtttgcattgttaacagggaagcagaatggaagcttaacagagaagcagtatggaagacgtctccttagcccagtggtcagttgcatcagagaagtctgctctgaaatgcgaacactttctcttgcagctggcagccccctgcaacctcagtgccctccatggccagggcaaaagcttccaggtgcccagataacatcccaaagtcactctgagagaaaatcggtcttactttacccttttctaaccaggaatttacatggttagttttacatctaacacttcagcagggagaagacatgatctaaaggtccatgtggacactctgtgtgactcggatccaggatctgctctttcagcccctccatttatcgcaaaagggatgatgattaattcctccatgcctagacttcactttagacatcacctcagagaggcctgtcttacccagccaatctaacaagccatcaaacacagcactgcctggctgctctctaccctgttatttagcctgattttaattcacacactttcatcacttaacattatactatctgtgtatttattgtttgccttcttctagaccgtagacaccaggaggacggggacagtgtctaagtggctctcaccgtatccctagtgccggcacaatgtctttacacatcggaggtgttcagtgaacagttactgagtgaataaaggacttagcaccaactgccgctctttttcatgaaattacagagctttgctatttcatacccaaatactaaaacctactgagatttttgcaaatttccatcatttatagttatatccaaggtggatttgagtgagcaggtacatgaggtatttgcagggcctcatttcactgtgccaaccaggcagggaactgctctgatctttgggaagggaacccaccttatcagtgagttccagtaagtacctgataattattgatcatagtgcttgtacttatcctgtagtcatatattgcacaggtgaccaaatgcctcctatttctttgagttaaggaatattgacatttgatgaggaaagccatttaaacacatgggaaaattggatgttgtctctcacccctaatactccaaccatagcccctgtcctattccatgctcttaaaaaaattttaattgatagaagaaagaaagattatctacaaggatatgagcaatttgctaaacagtggtaaaatgagattatgtacaggtgttgattcctaggtaaaaatgggggtcagagctgctatcctttggctagtaaaacaagattacttggtgaaattatgtaaatctcctcgaaagaaataagtttcagagttgtctagagaatatcacttggactgttctcaggctttccactacatctattgtaccactatggtgccctgaaaagaggctttctcaggcttaattccatggcttagtctttattccagtatcaaaaagggggaatccagccagagctcccatgagggagatagctgcatgctaaccacattaatctattatcaaggtaactcggtcatttttgtcaggcagcacagtgctgtgatttatagcacattcatctttgggagtgggacaagattatcagtaaaacctggtaagtaggcaatatgtcactaaagtaggaggcttaatgtggctactgagacccactaaacttactgcagtatttggaaggcccaagtgtcaagaaattaatggtttatgcagacttaagtggattccaatgaaggaagaaatgttaaagtaatggcacagaggatagaagagctagctgtgaaaaaaaatagccatgtggatgaaccaaacgcaacagactgaaagatcctagagagttgatcctaaagaaaaaggcagaaagtctggctgagcacttccagttcttctgacctggcttgattagtgaatctgggccacagtatctttatctataaaatgaaaacatttaatatcacctcagattttttgttttaattttgtgggtacataataggtgtatatatttattttaaagataagctaatatatgtgaaagtattttgtaaattcttaaatgctatccacagtgaaaatattatttgtttatagaacaaaaaaaactatgtcagatttagaattcttttaacatgagaatttgtaggttcttagtgaaatagccatttacatgtgatctgtagccctaggcattggtaaaaagcactttctcttctactgaaatatagtggctcaaatgctacccaaatgaaaagggcaggggaagggaagtcattttgtaaaggcaggcattacagtgtgaattctgggggttaccagaaagttacctttggaattggaacaaagctccaagtcatcccaagtgagtccaatttcctatgctttcctcttccttgtgttgtcttctctcagaccgtaacatttggagcacataaagagatattatgggcctgctcttctctggctgtttcaggagactgaaaaggattgtataagaacatcctttagcatgttcttagtattgttttgtccagtgtgtgtttcttcttaatatcaaaaaaaactaagacattgcctgtgaagccaatggaaaacagtagatttgcaaagaaaagaactaaagagaagacaagtggtactttttaccaagcttaaagcagagtgggtgtcctttaatcagagggatgcttggttctgggggctggataggactcaggtaagtaacaaggctaccactgagtcactgagcttctaaaatgagttgactcgggggagcaggaagctgccactcatgatgatctgaatgctattccgtgaagtttcagattgattgaagttaaaattaggggtgacactatgtcaggaatctaaaaattgataactgtaatggaaatgaaagaagggctagctacatctgttggataaatggagttgaaaatcatgaatttgatggcgacagacccagagagttgggcaggtagaaacttcatttcaagtgatatgcagtaaataccccaaatttgagtcaaatggcctgtgtaaaaaggaagtgaaaatgtaacccgtatctccttgtaggtgaaaaggccatatctctaggtcttaggtatgaaaaggatgtgtgggcttctgggtgtttttgactgactaagaaacactgtgggatggatagcagctataaattgatcttcgggagtgggaccagactgctggtcaggcctggtaagtaaggtgtcagagaggcaacagaaagattgagggtaaaatgtcttcatgtctcaggaaatgattgtataatgcaaaatgagctggagttttttaggagcactgttactagagttctgatgtctggttctagcaaaagaaccctaatatagctgtaatccctctctagaaggaacaaggaagaggattcttctctgaaagctcctcctaagatttatccatcctctgccaaagtgtcttgtggatccaggatacttacatctttgttagcagtgctggcccaacctgctcagcctcagatcacctatccctcatttgtaaaatgaggataatatttaagctcatggcacagttgaagcccaaatgaggtagtggaatatatgcagattattaatccatttggctcataaatgaaggttttctttccttttccctatgtagatcatgggttgaaatacctaacactgcaaatcatttttgtatggggatttgctatagtgtgaattcaggatacagcaccctcacctttgggaaggggactatgcttctagtctctccaggtacatgttgaccccatcccacccatgttttccccttatctggtttaaggcttccatatgtattgcgtgttatcctcatggatttcatcatccttgttttattatcaatgttctgtgaatttaagattgagcctccatggactcttcatttaaaaatgaaaatagctaatagaagagttggaaataacagtagaactaattcactaggtcaggatggagaagggagtaataccctagacaattaggacaaacgatggtttttccagaaatagcctcactcctgtttaagcctagacgtggtctctccccgggcacccttcacattcctctaaccctccatatcccaaatttagctgtggaatcttagacaatctgtgacctatgcagctacagaaatcttttcttactgagatatctgcctatttgaaccaaaagatccttgagaatagacagtctctaatattccatgaagtgtctgatatggtccttttacaaaagtaaatacttgataaattcttgcttaattgaagttaaacacccaaagaaatcaggtttccaggccaaagggaagaagaaaattaagcaaatgacacagtacatttgagcgtgtagtggggaggaagaaatgctagattgggattcaaatagagccatgttttggtctctgctgccaactagcaatgtaacttagaccagatctcttgcctctaagcctcagtttctttatctgtaaatggggaagtgggtccaatggccctctttggcctcttagtacaaaaagtctatgaatgtatcccatttggggcacttttttctcctaggagtaactcaatagctattttaaagcttgagtgttttctaactcattagagcacatcaagaagaggggtgaagtgacaaaagggagtttattgtgaggcatcaaacactgtgatactcacgggaggaggaaacaaactcacctttgggacaggcactcagctaaaagtggaactcagtaagtatgagattctatggtaattacaaaatgtattctggtgacaataagtggaagaaaaggtgatgtaatttttgtcattgtatcttatttttaatctattactgaagcattaagaattgtgacatccagataaattagtgaaagtattcaaaggctatataagcatgctttctttagggtggaatttagctaaccactaagactttttccaagatatgagattttcagctctcttcaacgtgagagtttttaatactagtattaagctaaacgatgctcaatggaagaaaagagctagaagagcagaaaattgcaccgtcatgatcaaatagatcctttctacttccactgccatggactcagtggtgcatttagaagagggtattcaaggtcattttagccatgccccaaaaaaaccactcccaattcattccagagattgtgcccccttatgctaaacatcatccaagaagagtcagtgaagtacagagaaaggaacccagggcttcttgtttcggtccagagttctaggtttgatttggtcccaactggatgtgtgatattggaacgagtcattgcccctctctgcacctcagactcctccagtggatgagggggtcaaagccctcaaaatctgttgttctgggatttcgctattataccacccgagagtttataggactcgagagtatggaatcttgtgagtatttcataaacaaattctatgaccctcaggaaatagccctgttaatcaacaacctaacttaacatagaaataataaccaccatctcagtccctaccatgtttagatacgatgctagatgcatgacatgtagaattgttcatctgaaataactctgtgaggtaaggggaagtatcttattttacaaaagaagaaactgaggctcagagaaggaagtgcccaagatcccaaagctagtaagtaaagggcctaaatttaaacttgggtctgcctgcctgactaaaaagccctgctctttcttttttttaattttattttatttatttatttatttatttctgagacagagtcttgctctgtcacccaggctggagtgcagtgcagtctcagctcactgcagcctctgcctcccaggttcaagcgattcgattctcctgcctcagcctcccaagtagctggggttacaggcatgcgccaccacacctgaaagccctgctctttctactgcatgatgtcgtagagcttgtgctctagtttacttagaaatgagaggtgatgccaatcacagtgactggtgaaatgcttggaatttatcttttctactttagatattgctgtgagttagagagggtgcttcgggaaatcttgacatggatgccccaagtgtctaaagagttctcctcccctttcaatgacaaaacaaagtacagagttgctgggagcatttaccccaatagggagaaaagagaggggagctggctgcagccactcccttgttctgactgtccctttccttcgctgtttcttgtattttccccaggcagaccagccaccaatataactgatctacaagagcctgactcctttgtgagttatagagaaatgcagggtgaaggcactttgcacatagaactttagctctgagagacagcctcaaaatatctagttcacccctctttattttcccaataaggaaattaagacccagagaggttggctgaattgtctaaggtcagtgcgaactagggctgggactagaacctggagatcctggtcctggggccatattctgtgactgctgtttggtgaactaaacttctgataggtaggaagtgtgagttatgctcataaacaggaaaaacaaataggttttacaaggggagtataaaaatgtcctccttattactagcaccttagtataggctccctagacctgctccccagctgtggtgtaaaaatggaaggagaaggaaatggcccattttgtcgcagtgcaaatcactgtgggaaatactggaggcttcaaaactatctttggagcaggaacaagactatttgttaaagcaagtaagttccatgaaataacctgatttatattacagttgaagaacatctgttttcattgatttttttctttttagggggaaggggacatagttttgtctgccagttaaattagaagatacattggcaataataatgttgcactgtacagtatccatgggcatcactcttgcaagaaacatgtataattaacaaacagttaagtgtggatggtaaaacttccctaggtcctatctagaactgaaactctgtaattatattaataacttttttaacttgaatattagtgacatttttatataacccaaggtatacaaagcagaatcttcagttgggttctatctgatttgttgtcatcttccaatggtcttaggaaaattaaggttaaatagtaagattagatgcctcctaccactttggtacatgcatgcagacatagaaacacccttagtaactaacttgcatgtgacttggcaatcctagctatggcccagtgacagggtcccattttgtacagagttatgtcagagtgtgaacacaggctttcagaaacttgtatttggaactggcacccgacttctggtcagtccaagtaagtcaaatctgcagaaatgtgtagccctatcctcaatattgggcatatatggatataattattctggtctataatagattattattactactattttgttcttattaatcataacaatgctgctaatttcaaatatacattttctgccatattattatttttacctttaaggagaattattgtcaagatatcaggagggaaatatttgaatttcctttgagtcaagtttcttatttgttcgtcagttcccacctctctgctgagggtcatatgaacctcacgatgttttggtttttataccgccttcttattatctctcttagaaatgcttccttggtttttccttgcctaagcacttagattttgcagctcacatttacccagagtatacttagcttttaacctctcccaaaactggcctccctgtcccaataattatgcacagtaaaagtcagttcaattcagtaaatgattattgagtatcatcaacaaaccagggaatcatcattggttttaaaagaaagaaacaaagaaaagaatttttaaaaccctaagctatcttaggcttctgatctcaagaacttccagtcttatcagagaaactaagcactcataataaaaagtctaacaaaaatttatatgtgtatgtgccaagataggggggtgggtttcctgagggctggagacaggacaggtatgaccatgcacagccgcattctttggcagagaacacacatgattcccccaaatatgtttctggaaacggaattgagtctgttctgtgctgagatctttgactttcttgaggacaaaagcccccttggcagttagcatccttgagcgggggtgaggacagaaacaggaatgagtcaggcgtgagtcacccaagactctcactcagccccaagaggatggagtgactctgagtcatgccgaggcatgtctttagcatgtgctccagcagtgtgcatttatggcaaggtgaaaaatacatttttgcacatgtcactaggaaaatggtaccttcttctcaggcatggcagatgaagtaggaaaatgcccgcctgctctctggtatctttagaaatactcacacccatccagcctatgtaggatacaatgtttttcatgaagttttatgaagattctgtttttcccaaaggagaaatagccaaagctgtgtttattgatagctgtgatgaggaaaatgaaggccaacaggtagcagtggggtctggtgctgtttataccttttagggaggttccttcaagtcttcataccacccattacaaggaaaactttagcatccgcctttcagggtttccagatcttagagctactgtgaaggggatgtgtcttcagagaaggggtgggcaaaaccaggaggtttttgtaatacacttacacagtgtgactatgggaacaacagactcgcttttgggaaggggaaccaagtggtggtcataccaagtaagtgagctgggatcctcctgcacaaatggccacagcacccccatcgctaccctgtgctggagagcctcttatcatatttccatgggagcgggggaaggacatgccattcatcagtgctatatcgaagaaccttaggcggccactgtcccaaatctttgcctgtccctggtttctttcactctccccttctctgcatctccactgaccacactcccattctcatgtaagctgcccctgatcttccctgaggctggatttcagattgaacaaaggaccacagaagtgagagctggaggggaccgtggggacatcttgctcatgttgcagagggacctgatgccagggtctagcatctgtccaagaccgtgctgatggtcagtgcacagcagtggaggggccccagccctttactcccaccctgagtttggtggagccacacactctttgctaagtgaccctcaaacccagtgtgagataagctgagtgttgacagtgcccacctgctaggcaaccaagtactgagttcctgccccagctcaggactgtggcgcaggccatgacctccctgagcctcagttttcatatctctgaagtagacagcatggtctctgtttcctcccatctttcaaaaattctatggaaattattgtgacttttttctctgtaattgtagggtttcacagaggcagggccttgtctgagtcaaggtcattagaaataaaggaatccaagggctttggatgccttggcctaattctaggtggtaaagagggaaggatgaaagcacaaatcacaggaagtgcctaaatcctgcttggatttagtgttgcctcaaacagggatatgcagaaatccaaccccagggtctcccataggaagaagactaggagtgggaagtgccaaagagctctggaaaggaaaagagaacaaggagcactctgagaaaaggaggtcagaacagcttcaggaaaaacgtcacataaaatttcctttgctctctgtcctcgcagcactttcagaagctccttgcatctgactaaagagtagcagagccagaccctcagaatgtctgccccaagcaagcagagtgtggtgtttgtattggggtgctgggagcagacatggggagttgctgccctgcttctctgctgatgggaaggtggtattttcccctgggtacacgggggccaaagagctctccagtccccagcccctggctcccgcccctgggctccagcactcgggggctctaaggacagcagtaggagactttctacaactcagagagtattcaggagggtttcccaggatgttgcccaataccatggggcaattggtagagggaggtcacatgaaacaggttttatcaaaggctgtcctcactgtgtgcatcaggaggaagctacatacctacatttggaagaggaaccagccttattgttcatccgtgtaagtattatagaaatgatcaagggaaattttgcagacagattatattatggaaggatactgtagtagtgagagtttgtgttgtgatctattccatcattaaaggagtcctttgttgcctgggagtaactatcagtgtcaggtctgatgagatgattgaggctgtgccggacaagggttttgcacaatgatttcagaggacaaatccccaagttgtgaaaaaagacttcactcttggttaggtttctaaaacagaactttcttcttggcaaccaaggggtctactctgccccctcactcctatgtctcttccacctgagactctgtcaccacctcccctagaatccgtgagataccttcccctgaattagagcataccagccagggtgctgaggcactctgtggtactggaatggatggtacagggatgcgtttctgggcttctggctgcaagaagcctcatcctttcccccagtgtaaagcattgctgggaatcatcccattatgagctactatttactgaatgcctgacacgtaccagtggccattctcttgtcttttatgtaatcctcattcagtgattacacacatcctaataataggtagccgatattttgcccattttacaggtgaggaaacagaggcttgggataagtaaattatccaagattatatagccacgaatgacagagctagagtttaactcaaatctgtttgactctagggccttgttattaaccgtgccaccaccatgcctcctgcattctgtgaaggaagacttcacacctcaaaggccatctgtttggcctttggtttgcccatcctgagccttcttaccatagcgaccatggcatggtgactcagcacttctgaagagatcagcagagtcattgggttgggtggcagaatacaggtatggcagggagggaaggagaaacttagggggactgtttattgcgcatacagttagagagaaagaaaaatgtatcatcaaaccatagaataggctgcttaaaagtttttctcccaagaaactgtgagtgtatgagggtcatgggcagctgcccccagctggcagagggcaggattttgtactgtgatgtaccagggtgtggacacgggcaggagagcacttacttttgggagtggaacaagactccaagtgcaaccaagtaagtacccaaacttaggctctggccaaagacacagaaaggccctactctgctttcttagatgatgaatctgtacttcctgaactaatttttcatgtttctttatgaggcttgaatatcttgaaattttaattcctagccactagcttaatagtctgttttctaacggtagtatttgccaatgggaattggccatttcatcattgcagagacagattcctttgagacaaaagatctttatcagaaaagaaactgtgactgattatgccaaaagatttatttttgttccatttagttttcatgaaaggtgatgaattatgcttcccaaagactctgggcattggacacactttctcaaaactgcacatccaattgagagatataggaagaacttagagcctaaataatgccataaaaataataaaaagtttgtaaaaaggaaccatatagaaattaaagaagaaatgaaatagtcttaatgaaagaagataacagaactgcattagaaacgaatggaaatatttagagggtttatgtattcaacaaatatttattggacaattattttattccaagcactatgttaagtgtgaggaagggaatgggagggaagggaagggaaggaaaggaaagaaaggagaggaagtagaggaaggaccgggagggagggaagaaggaagaaaaggaggaaaggagggaaggagggaggttctctttcatccagggaaggagggagagtctctgccatctgggagctcagagtgcaaacagacaactatagcctattgtcaccacgtcatagtggaggtacatgcaagttgcaatggaagcacaacagaagacatgactagcctccaattctcattgcctggtacatacacacatcctccactataccttaagctccatgagggcaggaccctttttcatcctcacagctctacagctcagcacaatgcctggcacataggtgtcaccaaacaaatgattgtggggaaaaaaatgccttctggctagatgagttatgatttatacattaacaaatattctctaacagagagagttgttagacctcaaaaccaggagattgcagaatccatccagatgtctgtggtgggagaaggcccatctctcagggaagagcacctctgtatttatctgttcatatgtgtgcttcatcaaagcctcttctcagccatggttcaggctgaatttataaagcttgaaacctatcgtatttctcaagaatcagagatcagaggtggaaggtttacaatatctcgataagtaagcagtacaaatgagttctagcagtaaaaaagaaagaggtctaatgataaatatatgaagcctgtctccacttgagagacctcctagaaaagatttgttctaaggaaacttttctccattaggagcagaatcatcttggaaatatacagctccaagttgtgttagaaaggtgtgtacaaagaagaccaaaaattcacatttggaataaggcattaaagttgccattgtttctagtagggaaaccctgcaaagtgttggggcatcgtagatcctgcatgttgacgcctgcaactaatctgccccggagctgttccgacagtggctggagcatttgctgcacagttgcataggtgttcaacaattgccaaaataaaatgaagctatttcgtgatgattagaaagaaataatcagcatcaatgaggcctctgatgcatcttcaggagtgagtaggtggaatgaagacctggtaggtgagacttttctctcttgtcagagaaagtttgacttgggggagcctggaaaacagggacaggagatggagtgccccagccaggcttgccctgcccaggtcagagttcttgtaaagcaccatctgattgtgtgttttctggtggctacaataagctgatttttggagcagggaccaggctggctgtacacccatgtgagtatgaccctgcaagtgaccagtgcaaaaagaactgaccacttgtctatgagaaaacaggtgatgatctatagcaaacttggggatatattgagaagcactcattttccattcctacaagctctcttggtgacttaaaatgttcccatttctcatatgaaacacagaagtgccaagagccaattgcgtaaatgaaaatctgagcagaataatttatagaaacataaaaagagttccaaataatgagtgctttcaagcgaagctgataatatcggcaccagataatctgaacattcaggaaattagctaagtgcccttgggggaaagagatgagttaatggcaaacacaaattctcttttattgcagcatgtagctaaattccctggattggctaataaacatggtatggggatccctactcatagaatcttcctctctggagttaggagagttttcagcttcctcctaagggtaaaagtggcccagacccctaactgaacggcaagtataccacatgcaattacaaggtatagaggcagcaatgtagagggaggcccacagacctggggaaaatctgggctctactctcactggctgttttcaataaagcctccactttctcagcagcaaaatgactataactacatcataataatatgagataatggccagaatgtaaaaagtgatcaataagtagtagcttttctaaaatattattataattattattattgaggctttgcttatactaaggtttacactatcataaagggaaaggagaatcgcttccttgggaaataaaagatgtaagcaacaaagacccaaggagccttttagaatgttgctctgggaccccagtggcttccagcagattagcatcaagaaggttatctcaaagaccttacccacagtgggggtacagcagtgcttccaagataatctttggatcagggaccagactcagcatccggccaagtaagtagaatgaagcaggagagcaagggaggacggacaactatttcttctttgtccaaaatgccaacttgaacccaggtattttcctctgtgggctccaaaatggtttcttccacccatccccagaaaatcctcccatccagctctcggtgctctgcagacatcatccttaggctgggaccttaggaaccatgaggcaggcaatgagcgagtactcctgaaccttccacaaacatatccaagatactgctgcctggaattgaggtttttgttctagggaattattggtttattgaaatcatatgaagtcacaacctcagcccagggaatcacagcagaatggaacaggaggagaacttttgtatcagaagcgaaatttcagtgcaaaagagcagaaggtttaggcctggcgtggtggctcacgcctgtaatcctagcactttgggaggccgaggcagggagatcacaaggtcaggagatcaagaccatcctggctaacacagtgaaaccctatctctactaaaaatacaaaaattagccgggcgtgatggcacgcgcctgtagtctcagctactcgggagactgaggcaggagaattgttgaacccgggaggcagagattgcagtgagctgagatcgcatcattgcactccagcctgggcaacagagcaagactccttctcaaaaaaacaaaaaaaaaaaaaaaaaaagaaggtctaacccttaggagtgtgattatcctgttctcctgccttgtgggggagatcagtgtttctcttatttaagtaataggtaggtcctgtgagtttgtgcaatggtgtcacctacggtatgaatactggaggaacaattgataaactcacatttgggaaagggacccatgtattcattatatctggtgagtcatcccaggtggcaccacgtgcaaccccatgggccagtgtcactaatcctttctctggagatatcacttattactatggtgaggcttgctgtagatgttgtaactaattttcttacagaggtctgggaagggaaaagcattactatctatcttgaatattcatgtttctctaggtcaaacacattaaaatttgactttaatcattcaatgggtattgtaaaatgccttctatgtgactatcactctataaaatgttagactgagtatgaagtgtgagatagattcctgtcctgtcctcaagtggtataaaaactagacaaaggtactgaactattgtaaattaagcagccagaaaactattttagtattgaccagttgatgatgtcaatggacacaatagagattcagaggggatagggtgctggctgagaagttggcctagactgagaagtttcctgtggtacaaaggattcattgagccctgaaggatggataagatctgtatgggcagagaaaggagagaagggaagttctgggcgtagggaacgacaagaaagaaggcatgatcttgggaataatcaaggcacatgcaaagtagcctaagtatacatctgataataaaattggttgaaaagtagtcagagaagatgtctttttaggcatggaaaaaggaaatactagagcattcaacagaatacagaaattagggccagggccagccattgggaaactgagaatccgatttagagatgcagactagaagtgaaggtgagagcagccagctatggtgccgcagacctcccctctccttcctcagtgggctctgagaggggtcatcccacaccttagaggaggagaaacctaagggattctgtaatagagacacggggcatggtatgaaagtattacctcccagttgcaatttggcaaaggaaccagagtttccacttctccccgtacgtctgcccatgcccagagtttcctgatgctcactaaagcctcggtgggacccagagtgactgtcactaattctgatttctgggtccctagtgcccaaacacaggggacagatttaatggtaaggaagctttcaatcactgctgtgtccctagggatctaaagcactagagcacatgtgcttctgcagttcattttgaatttaaaggacagcttaggatctagaatagctgaatttccacctcaaaacattggttccgtcttgccaagcctaccttctgatatcatcagtgatgggatgtgtttttcttactagggtagaataggatgtctctccccaaaggactctggcagacagacccctaaacacctccaaattaaaagcggcaaagagataaggttgaactagacgtacatggggataaaaagtataaaaggtacatgggaatgaaaggataaaaaggctaaaaaaattaagtacctctaactcagcccctgttgccatttctcagagtcttgtgttctgtggcattgcgctttctagaccaacagtgtccaatagaactttctgtggcaatggaaatgtcctgtcaatctgcactgtcccatacaatagccaccagctacatgtggctattgagctcttgaaatgaagtttccatttttaattgaaagcattttatttcacattgactaatttttatttcaacagccacatgtagctagagactattataccagacagagcagcctagatcttctccagtctgacacccaccagccccaggacttgagtgagtgtttaaccaggactcaaagttgggtttctgccccacaaggccaccccctttcctctttaaagccaacctgcatctggtggcccctgatcccctgccttgaggatcggcacttccagactcctctccccctctgcagtgctgtccagtacccccactgatgactaacaatcagggggatgtgttggtagagctaatggctttctgtctgtcccttcccagcaaaggaactatgccttagggccttcacccagagtgatgtcaggctgcccaagcatgaggagggaagtaggcagaatcctctggagccaaagctctggatgtctctcccctctgaccatggagcccacccctgctccactgctccagggacagccctatgctgcaggcagctctgcccccactcagcatcccaggggctgatttctttggttttggatccagctggatgtctgcattgccgaggccaccagggctggctcagcaactgtcggggaatcaccagggtctgagaaatcttgtgcgcatgtgaggggctgtgggagcagagaacactgggtgggaaattctaatccccaccctgctggaaactctctggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcaagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggcgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacagggccttctaggccatgagagggtagacagtattctaagtacgccagaaagctgttgatcggcttcaagcagggaagggacacctaatttgcttttcttttctttttttttttttttttttttttttttttgagatggagttttgctcttgttgcccaggctggagtgcaatggtgcatcttggctcactacaagcctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcacggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctcattggactctagaatgaagccaggcagagcagggtctatgtgtgatggcacatgtggccagggtcatgcagacatgtactttgtacaaacagtgtatattgagtaaatagaaatggtgtccaggagccgaggtatcgtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgccgaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctgaggtgaggggccttgaagctgggagtggggtttagggacgcgggtctctgcgtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgaacttctcccctatgaggtaggaagaacagttgtttagaaacgaagaaactgaggccacacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcaccctcctcccccagggtccccagtcggtcttgctgacaactgcatcctgttccatcaccatcaaaaaaaaactccaggctgggtgcgggggctcacacctgtaatcccagcactttgggaggcagaggcaggaggagcacaggagctggagaccagcctgggcaacacagggagaccccgcctctacaaaaagtgaaaaaattagccaggtgtggtgctgcacacctgtagtcccagctacttaagaggctgagatgggaggatcgcttgagccctggaatgttgaggctacaatgagctgtgattgtgtcactgcactccagcctggaagacaaagcaagatcctgtctcaaataataaaaaaaataagaactccagggtacatttgctcctagaactctaccacatagccccaaacagagccatcaccatcacatccctaacagtcctgggtcttcctcagtgtccagcctgacttctgttcttcctcattccagatctgcaagattgtaagacagcctgtgctccctcgctccttcctctgcattgcccctcttctccctctccaaacagagggaactctcctacccccaaggaggtgaaagctgctaccacctctgtgcccccccggcaatgcaccaactggatcctacccgaatttatgattaagattgctgaagagctgccaaacactgctgccaccccctctgttcccttattgctgcttgtcactgcctgacattcacggcagaggcaaggctgctgcagctccgctggctgtgcacattccctcctgctccccagagactgcctccgccatcccacagatgatggatcttcagtgggttctcttgggctctaggtcccggagaatgttgtgaggggtttatttttttttaatagtgttcataaagaaagacatagtattcttcttctcaagacgtggggggaaattatctcattatcgaggccctgctatgctgtgtgtctgggcgtgttgtatgtcctgctgccgatgccttcattaaaatgatttgg

SEQ ID NO: 37466 - DNA, 55896 bp, Homo sapiens
agcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgaggtaagagccgcggcgcccccggatctggggcgggcttggcgtcccgagcggcccccggcgccggagcctcccggctgcgcgctttgcccgccgcagcccagccggggccggcgcctccctccgctcgccgcccgcccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcagtgagtcccgggagggacaggcccggggcgaaggcggcgaggcccgcggtttcctggactggggaggagggcgggagtgggcggcgaggtgggatgcgttgtgtgtgttatgtgtgtgtgttgcattccactccatgtctttttggtccccttttggggattcacccccaattcagcaggtagctttgggctcaacgctaaaaatccggggcattcctaagtccttttccacccccgggaaagcctggggtgcgggttggggtcggatggggtgggagatgaactgcggaggacgtggagggctaggttagcttctcttggaataggttttaaggaggtgtcgtcaccaaatggctgaatctgcttgagctgagagcgaaaaacgactcccctttccagaaggggtgatcttatgacttggacggtctctgaaagggtcggaagtttggggaacgggaggacaacccacggtcgttaagccgaggtgtgggatgggggcggaaggaccgttcggtcccaatctggttcctagaggtgggggaagggatgagggtttttgtccggtgtggttcactcggcagcgatgcgtatgcttctctggcccagacccctctgcacctcgcttcccctaccgttatgtttggggttgggagaaaagtgaggctacgacccatgtttgcggaggaattttatggaccttgtagatgggggttcatatagaacacacaccccctatgaggcagccagacacttttttggtggtggtggggggggggtggggtgtgaagcctgtttcttgttctgagcccagaagctatcaacccttttgaaaaacattaccacggtgcctttctcccccagcactcccccacccccaatttccagatgtagcagccgcatctggttccgtttcaccccacacgggtacaccgcagccgcattattaacttccctcttcctcccctccccctcccccaaattaaaactcagattcttcagcctgtcttgaccacctccctccttaacatttctggagacttggagatgcggcgttgagattcgggggagaaaagaaagttcccttggatcccgagttatttaagatctcaccaagttattcgccgccgctggtgggtggcggcggtccgggtgctttctggattgcgcagtaaagaggcatcttgggagatggggccaaggttttagggggtgccactcgcgaacggttcatccgctagactaggggggctctttggctgtgcgtctggccagaactggccttgacgatggaagtttctggaaccaaagcgttgctttctctcccttgtgttatagctggagctgcgggagcgcctgccctgcccggagcccgcggtcccctctcggctgccccgcggtggcgtcacgcgcccctcccggagcaagcccggtgcgcagggccgggggcgtgggcggctgctgccagaggcgctctctgtgtgtttttaaggactgatttgggccgcatcccccggaaactaaagtggggtgttttaccgtttaaataacggctacaggtttgaaagcggggttggattttcgagttgtgtttggtaatagtctttgaggcaggaaagcgccttgtggtccaaagttgccgggagggtggggagagtcggtgtcttacccgcttctttccagcctctttcaaattgaaaacacttctctggtttccttctttgggcggtagttttggaggctgtaatgaaatcgcactttctctagacgtggtaattaaggtgactgtttcctccgcagatgtgccctaccctttgcacctccggaccagcgctttttttggaatactatctagccttgagactgtttagcagaaagtggccattttcctcccttggcccgggctcccggtttcctccctgaggcttgtttaaaagcgaagtagcagggccccgtgggacgcgccttggtctgggtaatcacccccacgcccgggtcatccaccttcctctcggtgaccgaggttcagcagcctctgctattgccggccgtctttgccgatggcctgcctccctaatgacttgtttacatatcctacccccagtgggttaggagaagctccggggctgccccgaccctccgagtgcagggtgtttggggaccgggaggctgctggggcctgactccagctgggagggttatgaactgcatcagtgacgagctgcttgaaatatctgttgcatttactcttagtcatagctgagtgtcagctttttaatgaggttcatccagattgagagccacttggactgcgtacttcactgcctgcttttccaaacatgcctgcagaaatgctcattttcgaggtatttttcccaatgggaattcaggccagagtgggcaccacttgaacaatcttagggtgcttcttttccttggcctctggccatggagggtgttagacagttccattaggtggccctttgatagcaagggaagcaaaggctcaggaagaaatggagaagcgtcccccactccctaggggcagaggattagatacatcggtgcatccctcaggctgggctagctttattcctggtggactccagagggcaagaaaattgaattgaacactgggtaggcagattcaagccttagagaccaaggaaaatccatgggttttgcttttagtggtgtgctctttgttttcagtattgacctgaaacaagactcctaaaatgagagatttgctggtatgaacttgggggtttagcagccggcttctacaaaggcttttttcttgccttcgtttctaaagtgtctttcgtcaaaatggctgttagttatagaacatcctagcaaagtttgagcctgttgctgctggaggaaaaggagttagaattgattcaaatgtcttattctgaaagggcctcacatcacttgatagtttaatttcctcctgggaaatttgtgtcttacatttgtcttccccagagctttgtaaaaggcctgaacgcaccagggactagtgggagcccagatgcagagctttagagaagattctggtgtttccagagaggatgaaatgtcagacttgggctaggatatttgtttttcctcctaaggttgcatctactttaaacagaaattctctcctcgccaccatttatctctcccctgcaatgaaagaaaccatgtttagggccctctcccccatttaatagccctcacatggatgaactatcccaagaatttggtggggttccactcatagtacatcctgtcttcaagagcaaggttttctagattatgtgcagcagttcgtgtttcacttgttgctttttttttttttttttttttttgagatagtctcgctctgtcgcccaggctggagtgctgtggcgctatctcaggtcactgcaacctccgccttccggttgaagcgattctcctgccccagcctccctagtagctgggattgcaagcatgcgccaccatgtccggctaattttttgtgtttttaatagagatggtgtttcaccatgttggccaggctgggcttgaactcctgacctcaagcaatccgctggcctcggcctcccaaaatgctgggattacaggtgtgagccattgtgcctgaccacttattgctaattttttatatgtctcttacttccaaggacatttagacactttttttttttaaagagactcaaaaaattagcatttccattggaccaactaaaatttagcaagctgagctgagtaactttctccatatgtttattaagtacttgccccctgccctctcaacatgtgagtagagaatggtcactttggggaagaaataagtcttattctcatctgaagggattaatgttttggtgttacttcctcaattctgaagaaccaagttgtccagaaattttctcagggttctttggactagagtttggctggttaacaaggggtactacctaattgcttttctctgatattctcagcctctttttctggaggagtatctctgtcagtttcttttcatcagcccttttttttccttcattcacttactcattcatccagttaacaaacatgttggcatctcctgtgtacatgctaggtgccgagggtgttagcaaaggttagggaggcacagaccctgttctgaaggagcctgcagtttcgtggggagagaagagaatgaagaacataaataacaatcatataatatgacctaagtgctatgtgagaggggctagtaatgtggtttgcaaatttggaggaatgaaattctccagctagaaggcccaagaaagtcttatggaagaaacagcttcttaaggtggggttcagagaaaagggaagggctggcctgttgcagaacaaggaatggcatgaagaaagtcttgcacagaggcatggatgttgcttcgagctgtggcgccctatagaaatagaacatgagcagctggtcacagtggctcatgcctgtaatcccagcactttgggaggccaaggcaggcggattgcttgagcccatgagatggagatgagcctggacaacatggtgagaccctgtgtctaccaaaaaatacacaaattagatgagtatgctcgtgcttactggtagtcccggctattcaggaggctgaggtgggaggatcacttgagcctaggaggcagaggctgcaataagctgtgattgcaccactgcattccagcctgggggacagaggaagaccctgtttaaaaaaaaaaaaaaaaaaaaagccaggcacagtggctcatgcctgtaatcccagccctttgggaggccaaggcaggtggatcacctgaggtcaggagttcaagaccagcctggccaacatggtgaaaccctatttctactaaaaataaaaaaattagccgggcttggtggctcatgtctgtaatcccagctacttgggaggcaggagaatcgtttgaacccgggaggcggtggttgagccaagattgcgccactgcaactccagcctgagtgacagagcaagactccatctcaaagaaaaaaagaaaggaagaaagaaatataacattataacatgagttatgtatatgttcagattttctagaagccacattggaaattaagttaaaagaaagaaataggtaaaaaaaatttttttttttgagacggagtctcactttgttgccaggctggagtgcagtggcgcaatctcggctcactgcaacctctgcctcccgggttcaagcaattctcctgcctcagcctcctgagtagctgggactacaggcgcgcgccactgcacgcagctaatttttgtacttttagtagagacggggtttcaccatgttggccaggatggtgtcgacctcttgacctcgtgatttgcccacctcagcctcccaaagtgctgggattacaggcgtgagccaccgcgcctggccaatatttgttttttaattaacttgtttgtttagattttatttaatgtaactatatttccaaaatattatcatttgaacatgtaatcaatatagaaattattgatgagatactttacatttttttcataacaagtttttaagatgcggtgtatactttttacttatagcatatccgttagcaccagccacatttcaagtgtgcagtggccactgtgtgggccacaggtctagaatataagacatgaagatggagagtgagaaatgcctttggaaaggttggaagttcctgtccttctgctgccaattaccaaatctcctgagagtgctattaaggagtgactcaaagcactacacaaagagaattataaatatcttaatattatatctgaaatccaaatgcataattctttacatttggttggtactttagagaggagagaatgggcacagtcacccacaccacccatttgagcctcataatcacctgtgatgtggcttcctctaggtgggaaaccgaggcttagaacggttaagtgactatcccagggtggcaagatcataagtggaagggtgtgaattcatactgtctccagcggacaagaataaaaagacccaggctgggtgtggtggctcatgcctgtaatcccagcactttgggaggccactgtaggtggatctcctgagcccaggagttcattaccagcatgggcaacatggtgagaccccatttttattaaatatacagaaaattagcccagcttctcgggaggctgaggtgggaggatcacttgagtctgggggatggaggttgtagtgagttgagatcgtgccactgcactctagcttgggtgacagagcaacactctgtctcagaaagaataaaaagatttggccatgaattcgtcagctagttttccttacataatttttggacaaggagatctgacattcataggtttttctcttagaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaaggcaagtatttcagccccctctgatgagtgggaaactgagatgtgccccctctctgctccccaccgaggacctctgcatgcaggcatgaatcccaggagcctagctgatattggagagacggggcggggggaaccagctgcagggtcttggaggaagctgctgtgtacacctgcaaggctgcaggttacatctatctgtcaagcagtgaaggaaggaagttgtttctaagggattggaaaaattcattaattagtagaatgagaaactgaggtgaagcaggaggtggcagggtcccagacagcatgttggactagtggcctgtgtcactgtgttttttgcaggcgggtggcatggggtgtatgctgacttcttattccaggagttggtgccaggaggccaggttttcttaacatccttgttttacagatgtcaaacttgagggccagaggggtaggagaggaagagactttttgtaccttttttgggaaagaacaagagggaagctggcagatgaatttgaagtgcattgaccagggagctgagagagggcggtctgcagccagcccacacctgggaggaggcggcaggcttttctggggacagagtggccaagtcgaagcaagcttaaccatctcaacatgacaccactctttcccattggaacctgagaacttgttcagtattctgacacttagcaagggacctgggttttcttggtcaggtgtgcgtttctgggtgacaggcctgcatcaggtgtattttcgggatgtagtaagttgtggaatatgggtttaggggcatcctctggcaagcactgcttctatcccagctctgggaatgtgccccatgcagtgtcctagatggcccatctgtggtctgcttccaagggtctttcttttagttagttagttttgagacagagtctcactccgtcacccaggctggagtgcagtgatgcaatctcggctcactgcaacctccacctcccaaattcaagcaattctcatgcgttagcctcctgagtagctgggattacaggcgtgcaccaccacacccagctaatttttgtatttttagtagacgaggaatttcaccatgttggccagtctggtctcaactccccacctcaggtgatactcccgcctcagcctcccaaagtcccgggattgtaggtatgagccaacatgccctggcacaagggtctatctttgaccaatggaactgcaaatcaagcctcttttgttaccagagttaccttggatttacccttatctacttggtttggataaattgagtttgcatcagatggagtcaggcttgatcaatcccttatttacttcctcccaccctgttctctaatatccaaaaaccttgaggcactattacatgctagctacatttccttgagtaaagtacttaacctctttgagcctcagtttctccattgcataaaaggaataataaaacttatcccccataagtttatagtgaggaatgaattaattcctcactatagttctaaattaattctacttagggcatccttggtacatagtgggtgttcagtattcatttcattttctcttttctgattcctttcgtaaaagtagaaaaatgaaagagaaatgttgacttctcttttgatttgaaatcattaaaacattttagtaagccttgggagggagctagtggtgtggcatgtgtatcccgctggccaagcacatgtgaacgaagccaagaatccaggggcttttctgccagccagcactgactcacttgcgaggggccctgcctggctcgggggaggcagggctgaagtaccacattagggcatgttccggggaagtagattctctgaataacttggatggctccctggagcatttaggacagaagccacctggaaaatagagatggtcacccccacgtagccttgacagtgcccagaaagtcttgtcacttggtaaatgttaacagctatgatccgttctttaagaccctggggagttttaagttttaccccaccagacctgagaagggtaaagggctgcagattctgttcttttaactggggccagtgtgagccatctttgactcagtgcttgcaatagaccttgattctgcagtgggacctcccaggcccccttgccccccgcaacttctggactcatatccgtcagacatcacttgtcaccttccagcatcagggagaactggatccctcctggctccacactcttaggctctttgtaagtagctggtgagggttttcttctctctgcaagggaggctggtagaactatggatgtgattcgtacaattttagagacaaaaagaaagtacccaggaggtcatttatttcagctgcttcattgcataggtcggggagttgagcatggagtccagcagctactaactagttatctctgtacctggcttccatttactggtccttagcttgttccgtgattcttcattgccccttatttctcaccagagggactggttggccctagatggagtggtctttttaaaattttttttttaaattttttgagacagagtctcactctgtcacctaggctgtagtgcagtgctgcgatctcggctcactgcaacctccgcctcctgagttcaagcaattctcctgtctcagcctcctgagtagctgggattacaggtgtgtaccactatgcccagctaatttttgtatttttagtagagatgggatttcaccatattggccaggttggtcttgaactcctgacctcaaatgatctgcccaccttagcctcccgaagtgctgggattgcaggtgtgagccaccgcacctggcctgggcagagtgaagtcttatgctggggagccatcagcatgctcaaacctcctgcaattgtagcacactttgtaaaactgtttcccacaaaagggcagaactatttgggactttcatgagaccattcactttgtagcacatactactttgaagtttataccttggaaaacctcatgatggtattcccaggcttgcacgtaatctgcactcaaaacatagctgtagaattgaactaaagcatccctctgtccaattaagacctataacctctctttttgagacagaatctcgctctgtcacccaggttggagtgcagtggtgcaatctcagctcactgcatccttcgcctcctggattcaagcgattctcttgccttagcctccgaagtaactgggactacaggtgcgcgccaccacgcctgggtaatttttgtatttttagtagagacggggtttcgccatggccaggctggtctcaaactcctggcctcaagtgatcctcccgcctcagcctcccaaagtgctgggattacagggtgcaccaccacacccagccaggacctatgatctaattcattgttggggtagcttcacaattttcttctggacgccttagtaagtccacactttaagcagccaccacatggcatactttaccttctgtttttcctttcccctcccctacctagaccctcctaacttttggggtttttttcctttcctcagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaaggtaaggtgctggctgggggcagcctggactcctgggccttgggaacaggatgggctgggagggaggtgatatggttgcaggtgatgtggtcaacagggaaggctccttcccaagtggagcaaagaactcccttcctgtaggagaaactctcaagatacctgggttggttctggtctggttataaacataactgacttcatcagaggttggggtcatgaaggctggtgacatccatttacctgagatgacatgtttgtggggggtaatttatgcttttctctttctgaggaaagaatatctgatgaggaccctagtgtcacactttaacataggtgatgtataaaatgcagctggtggtgcaatggggagagaatgaccttagaatttgcgtgtagaacttgggtcagactacaggggatgttgtaggaggtgagagcttgctaaagacctctgacttccagaaaattgtttcaaggccacatcttcgccaggcatagtgggtcacacatgtaacctcagcactctgggaggctaaggcaagaggatcacttgaggccaggagttcaagatcagcctaggcaatatagcgagaccccatctctacaaaaaaaaaggaaattaactgggtgtgatggtgcacgctgctagtcccagctacttgctactcaggaggctgagacaggaagattgcatgatcctaagagttgaggctgcagtgaattatgattgcactactgcgctccagcctgggtgaaaaaaaggcacatcttctataagggtcagcagtcatggcttcacgcctgcattttcctatccttaactgtgtctcacaggttctgtttgggggcctgccaagcgatttgctttggataggtactgtttgaggggttttgaagtgattgagacccaggaagcataaaggggcatggagacctatggcgtgttggaaattcagagccatcatcggtaacaggaaggacttaccccaccattcttgggatctgtgtgagctgtggaaaggcctcttgggagattataggtacagaataccggtggctttcgcgggactttgaaaactaatgtatgagcatttctgctgccagaggatagtgtggttcgtgactcagtggctggtcacacagagaaggttgacacacagtgggtgaaaggttggaggtgcgcgtgatggggtggctgtgtgcaaaaggctgccactcagctggtcagggactcgtttgaatgatgagtgatgggtgagaatatgtgtcctctggatggagttggggatgaacagggaaagttgtgtgagactttatagaaggtgcagtggctagagcaggcatattcatgttgctgtcagtaacagaaccgaaggcaaggtctgagctggagcacggtggggacccaaagtgggagagactgtgtctgcccacagggagtttatggtcaggagggatgggcaagtacagggataagtaacacaagacagactgtgtttaaaccacccagtgaagttacaaccagaggtggtgggaatgcagaggaagaggggagcagagagcacctgagatgggcttgagttcagaaggggaaaaatgaagggccctccaggttgaacagcatgagtgttcagagacagcatgtatatggtttatggagaacggtttgcctggtgagtaggtagctctgggaaacaacacttggaaaaattggattgagttagcatatggaaggcttaatgccctgctaagaaaactatacttagggccgggcacggtggctcacgcctgtaatcccagcactttgggaggctgaggcgggtggatcacaaggtcaggagttcgagaccatcctgcctaacacggtgaaaccccatctctattaaaaatacaaaaaaattagccgggcgtagtggcaggcgcctgtagtcccagctactccagctccagtctccagctgaggcaggagaatggcgtgaacccgggaggcagagcatgcagtgagctgagatcgcgccactgcactccagcctgggcaacagagtgagactccgtctcaaaaaagaaaaagaaaactatacttaggccaggcgtggattatgctggtaatctcaacattttgggaagccgaggcaggaggattgcttgagccaagaagtttgagaccagcctgggcaacatgatgagaccctgtgtctacaaaaaatagaaaaattagccaggtgtggtggcacatgcttgtagtcccaactattagggaggctgaggtgggaggatcacttgaacctgggaggtagaggttgcagtgagccatgatcacaccgcttcacttcagcctgggtgacagagtgaaactctgtctaaaaaaaaaaaaaaaaaaaaagcaagaaaagaaaactagacttaaatgggtagatgctgggaaacttgaaaagtttttagcaagtagtgacactatcagctttcagaaagttaatttggcagctcagtgtggatggctgggaggaaagagtgaggtgcacctgtgtttgcatcctgctctgccacttgatagctgcattatttacttcaacaaactactcaaacaccatacgtcacagtttgctcatctgtaaaacagggataaataataaagggttaagtggggtaatccagatgaagcacttccatgtaaggtgttaatagttgctattgctgccactgctgctgccagaaggatgaggtcgcaggttattttgagtgtctggctagaggaagtgcaggtactgaccaggatggggactgggagatgatagaggaaggaaaaagtagtaaagacactacagcaatagcatctgtgggtttaagtaggttgggtgtcaactgtgggcaactggagactgagatgagagtgtaaagggagtgagtcagagtgggaggtttgaggggagtttagatttgaatccgccaattgtagacagcgataaaggagtggaagagtagcaaggagctagttgaggtttgagaatgtgaatttataatggagcctaaagtactttcttttttttgcagcccaagaagggagaagtggatctcgggcctggctgcttgtgagccagcccgacgggatgagtataaggaactttagggccagggtgggggtgctagtagaggagggggcttcacggaagctgctggggcagggtggaggctggaacctgggggctgaagatcttgatgaggacaaagtaccggccctgtgaacagaagaaagggagtaagagaggtggatggggctcttaggagccatgtacccaggaagactgacattaaatgaccattttttaaaaatcaacttaattttcaaaggcacattggctcccacctataatcccagtactgtgggaggcagaggcaggaggatcacttgagcccaggagtttaagatcagctgggtttgtttgtttgttggttggttggttttaagagacagagtttcactctgttgcccaggctggaatgcagtggcatgatcttggcttactgcaacctctgcctcccaggttcaagcgattctcctgcctcagcctcctaagtagctggaattacaggtgctcaccactatgcctggctaatttttatatttttagtagagatgggtttcaccaggttggccttgaactcctgacctcaagtgatctgcccacctcggcttcccaaagtgctgggactataggtgtgagccaccacacctggccaaaccaacttaatttaggtataacagtttgggctattgtaataagactgctgtgaaccttcatgtgcaagcctgggtgggcacacattttccttggactgccctggttttgattttggctccacaccttactgactgttggctcttggggaagttcctctttgtgcccttttataaaatatattgataatgaatgtgtgctcataaggtcattgtgaatatcaaataagcatgtctgcagagctcataggacattgcctggtccgtaggccatgagcagtcaatggccgttgtgggtccctttccctgggcctccaggggagacggcacatggcgaggagcatgttgtttcatgggacacagcaacggaaagcccctgcacttggagaacaagccccaggtctctgtttggtggagtaagcccccgtctcagtgtgagtgtggtgctttcacatagcctgtctctcatgagctttgtgacagaacagagaactgctgtgcccaggacattctaaggggagatctggcttcatgctttgtaagctgtaaggaaccttgtaagtgtaaagtatattgcatagtcttgggcctgctgattattaaataataatgctgatattttttaattaattaattaatttatttgagacggagtctcactctgtcgcgaggctggagtgcagtggcgtgatcttggctcactgcaacctccacctcctgggttcaagcgattcttctgcctcagcctcccaagtagctgggattacaggcgcgtgccaccacgcccagctagtttttttgtatatttagtagagacggggtttcaccatgttggccaggatggtctcggtctcctgacctcatgatctgcccacctcggcctcccaaagtgctgggattacaggtgttagccaccatgcctggccaatgctgctgttgtcctaaaaaaaaaatcatagggcgagcacagtggctcacacctgtaatcccagcactataggaggccgatgcaggaggattgcacgagcccgggagttccagaccagcctgggcaacatagcaagaccccatctctaaaaattttaaaaattagctgggtaacgtggcacacatcggcagtcctagctattcaggaggctgagatgggagaattgcttgagagttgcttgagcccaggagttgaggctacagtgagctataatcaagccactgcactccagcctgggtgtcagaaggagaccctgtctttaaaaaaaagaagaaacacattataatctatgtattaagggctttgtccaaaaggtgagagcaaaccacctaaaaccctgttcacactgagttttccccatttaaaaggccttgctgtgattttaagtgtgtgtgtgtgtgtgtgtgtgtgtgtgtgtgtgtgtgtgtgtgtctgtgtgtctgtgtgtctgtcgggagcccctccccactgagcgcagtaccaacgcccctcagtctgcaagtgctcctgagggattggggagggcctggagtttctggctgtccttggaaagttgatttaataagggttccaggaaaaccagcctccctcccctctccctctccttcccctcctttggtttgggatcttacagagcctcagcttgtttcagatcaggctttgagagtggtgagggagttgtttggaaagactgaagccggtttcagatgataagccccaacattctgagcttgcagagggtgcatttgtctgtcttttgcaataagtcaagtcttggtgggcaaagccagtgagtgagtacaacactgcttgcaaggccactgctggtagttggggtgggggtcctgcccccttttcagcagtactgtgggttaaacaccccagtgctcagaaaacctgcagctcagaagtgatttaatgggctgagttttacagctcctcccacccacccagatttgaaggagtctggtggcttgttagaggggggagaggttgcacttaatggaaaaaccacacatttccattctggcctcaagccccctggatgccctgtgtgcaccacaaagcggggctttgtctctgtgttttgcagaaacctgcacctatgggggagaggctgtgcgtggtgccagagccattgcctagcctcagatcatagggcccttgcaggtcctccatccctgggcgtctccagctgcctttggcccaaaggggtgtgcgtttcagcctggctgcagggagagtctcaaataggtactacaggtttggtagtgggacaccctctgttccactatcagacctgtagtctagcatctacactggactgtggtcctgtgtcccaaggctgccttgggacacaggcaagaccctcccctactcccaccccatctccagcatgatttcttatgatgaaaagaacttgtttgcttctcattcaacctggatggtaagaggagtttcttcatcccctgccagaaggcgaatggaattccatggagcaaaaggtgatgtcagatgaccctcttgagaacaagggtggaggatttaggcctctagaaatctgcaaggtgctaagctcataacaggtttccccagaggatcagctctgtcccacttcccctggagaagtggctccagtgcctggaaggggtgtttgcaagtgttcagagctggacagggaggacccagccctcggcctgtgagagaatgtgaggacgctcacgtggccctcttgaccaagctggggcaagcgcagcaaagccactccgaggctgtgttcttggctccggcttctgcattgctacaccattagcttcactgattttccactctggctctgccaggcccgctccctgaagtcagggaggaggaatttctcagggaagaacaaatggctgtccagagatcttgctgccagtgggggaagggagggatcccaaacaaagactctgtcagggtttccatcacctggttcctgtgactacctggagtcgggtcagcaggaactggagagacagcatcagggattctttgggagcctgtggccccagcacggaggggtgtttgctcctggccaggcagaagcagtgagtgatggcttgtgtctgggcggtgatgaatggccctgggagaagtgagtcctggggagtcattatccgggagggcgaggtctggggtcagagagcccgaccagcagctggccctattttcacaatgcctcgttcctccggggccactgggggctccagctcaccctgtagacaccacctttgcctctttcttccttccctgaggcttggaaatgagacaactgtttccctgttgaccggggaagtccagctgctctcattctcctgggctcctgaacggggcggcccaggccttcctcctgggcctggctctttcaccaacttgcaggcaggcaatcccttctccccacccaccatactccccagccccactgcaccctaaataattaagctgaaagctaactgccctacctggatctgaagggcctgggctaaatcccaaactgtttcctcctaggagaagcctgctggagtctgggccacttctgaccttggggtttgctctgacttacagctggtggcagccaagtagcagggccaattgccctaacccctcctccccggtagtgggcctgttgcctcttagcattgccagtgtggcaccaagagacattgaacttctaccctcagagttccctcccttctcctgtttcttggctcacaacagttcttgcctttccacttgccaaacaggtatctactgccttcatgtaaagcatttgtgccctgcaaactaggggctgtggggtgagggctccgtgtagctggtttcaggcactgagaaagatccaccctggcagagcttgaaactccacgccctctcctcgttcacatgctgtggcgtggctgagcctcccgggatgggttgtgtaaaaggtggggtgggggctgtgccatttgtgttcccaggccctggacatggagacacagggagcctgaagtgggtgagagggtcaaggagttccgcaaagagtagacttagtggttacgaggttgggcagagaaagaggtcagaaacagcaacacggaggtttctaggagttaaccaacagtgaacattgaattcagagcttagcccttcctcacttttctctaggatcaaaaactagcttctggctaatggtccattcattgactgattttttttcactcattcatttattcattcatctagtcaagcaagtctcttcctttttccgtaaatacaatgtatactttatacattgttttatcctagtcccttagctggaaatatctgttcctgtccttttcttccttttcactttttataattcctgctcaaatcttagtttaaggtttagcttgggtttagattaaagcttaacttaagggccacctcccttttgaagccttcccctatctccaaattaattaccccattttttctctttttcttttttctgtgttttttttttctcctgagacctagtctcgctctgttgcccaggctagagtgcagtggagtgatcatggctcactgcagcctcgacctcctgggatcaagcgatcctctggcctcagcctcctaaagtgttaggattacaggcatgagccaccatgcccttttgagatgtagtctcgcttagtcatccaggctggagtgcagtggcgcgatctcggctcactgcaacctctgcctcccaggtgctagcgattcttctgcctcaccctcccgagaagctgggattacaggcacccaccaccatgcccagctaatttttgtattttttgtagagacaggttttcgccatgttggccagtctggtcttgagctcctgacttcaagtgatccacccgcctcagcctcccaaagtgctgggattacaggcgtgagccaccacacctggcctctttttaactttcattctaacacttactttactctgcctcacattatgtggagtttttaatagatgtctgtttactccactagagcaaagttctctatagtcagcaagtatatctttatcactcttttaaaaacattagtgtttaggctgggcgcggtggctcactcctgtaatcccagcactggccagcctggcgaaaccctgtctctactaaaaatacaaaaattggccaggtgtggtggcacgcacctataatcccatctactcaggtggctgaagcaggagaatcacttgaacccgcgaggcggaagttgcagtgagccgagatcgcaccacttcacttcagcctgggcaaaagagcgaaactccgtctcaaaaaaaaaaaaaaaaaaattggtgttttgttagataatctgggttcatctttcaaaattcagaaaatacagacctgtaaagaggaaaaggaagactcctataattccatcattcaaaagcaatcactgttaactgaatttattgttttagacttttttcttgcatttatgtaaacctgacttttcagaattaggatttatactgtatacgatgttttgtgactgatatcagcatttagagccatacagagaatgtttttcattatgcttaagaactacataatgttccattgtgtgggtgtacaaagttgatccagttctctacatttgggcatttaggttattttcaatagtttgcattcaatagaacatattcttacaaataaaatctgtccatgtatccaaggatagttccatttgttttaagttttgattttatcactattacatcactataccaaatatcccccaaaagattataccagtaaatgtcttttaaaatataataataaataccagccgggtgcagttgctcacacctataatcccagcactttgggaggccgaggcaggcagatcacttaaggtcaggagtttgagaccagccttggtaacatggcaaaacccttctctactaaaaatacaaaaattagccggtcatgatggcggccacctgtagtcccagctactcaggaggctgaggcaggagaatagcttgaacccaggaggtggaggttgcagtgagctgagattgcaccactgcactccatcctgggcgacagagcaacgctctgtctcaaaagtaataataataaatatcatctccacactctgcatgcttgacattttcccatttttacaatgattccataggcataggttttatgaccataatcagatgagtaaactgaggtttgaggggttaagtaacctatcttaagtttatatagtgggtgaggggtggaactaggatttaaactcaggtggttctgctatagtatttttttcccattgtattacactatttttctatatcaaattgggtttccccacaaaatctaggtggaccaacttctgaatgtaaacattgctggctcagtcccctttgtctcacaggagtcaggcatcccctccctttgtcaggggtgtgtgtgtgtgtgtgtgtgtgtgtgtgtgtgtgtgtgtgtgtgtgtgtgtgtttgcttgcagtaatatctcctgtggcattctgtagagaggttacacatcagtcacaggtctgtgaactgccttaatgaacaaggttccctagcctagaataatcaatggaacaaaatccccatggacgctgccatttccactgttgccaaagacctacatggagaaggttcccaaggtgtcagatccgacacctgagttttctttataggtcacagttagcctagaatgtgtggtatgggtattgcctggacgcataaactagattgcttctaatatggatgtggtccaacaatctctgatgaatggaagtaaacatatcaaaagcttcagaggctgggacattaacatttttttgaggctactagtgttttttataaataatgaagaagggccaggcgcagtggctcacacctgtaatcccagcactttgggaggccgaggtgggcagatagagtgagctcagaagacccgcttgggcaacatggcataaaccccatctctacaaaaaatacaaaaaattacctgggcgtggtggtgggcgcctgtaatcccagctactcgggaggctaaggtaggaggatcacctaggcctggtgtggtgggtcacacctgtaatcctagcacttttgggggccaaggtgggctgattgcctgagctcaggagttcgagaccagcctgggcaacacggtgaaaccctgtttctactaaaatacaaaaaactagccgggtgtggtggcgggcgcctgtaatcccaagtactcgggaggctgaggcgggagaatcgcttgaaccagggagtcagaggttgcaatgagccgagattgtgccactgcactgcagcctggctacatagcaagacttcctctttaaaaaaaaaaaaaaaaaaaaaaaggtgggagagggctgagtcagtttgccttggaggcatgggggaggagaaggatgtgaacagggaagtgatctaagagcttccctaggaaggaaggacacccttttcctggaatgctctcctgctctgccacagctttcagtcaattatcactgcctttagaatgcttatcagcactccagcccttcagaagtgtccttctcctcctctggtgtcaaactccagagtttacttttggaattaaggtttattttccttaggttttaggaagtagcttttgaaccttagaagagtcagtttcctttactaactactgaatgaagttaggcattcaaaacttgggtagtcatgatttgaagtgtcacttgcggccaggcacagtggctcacctgtaatcccagcattttgggaggttgaggcgggcagatcacctgaagtcaggagttcaagcccagcctggccaacatagtgtctctactaaaaatattaaaaaaaaaaaaaaataaccgggcgtgatggcaggcgcctgtaatcccagctactctggaggctgagacaggagaagcacttgaatccaggaggcggaggttgcagtgagccaagattgcaccattgcactccagcctgggcaacagagtgagactccgttccccaaaaaatgaaatgtcaatttcattgagactgtatgaatgcctgacatgcacttgaaagtgatgtttattttataattttagcccttcttcactaccccaaactcccagtgcatttaaaaaatttattggcctagccattctcatggggtaatatatcatgaccatcaaaagatgacactaaagtgaatcctccatgtatagctgggctttctgccagccttagattctggagaagcaccccaggccagggagaacgggtgaagaggagaagcatttattgaaggtgctggtagccggagccctgagaccaacacagaatcgttttttctgaaggacaactcaaggacagttgagggctcttcacttccctcacatcagagggagctttgtgctcacgatgggcacggaaagggatgccagtaagcgatgcccctctatcatctcacaagacccaggtgaaacaggacattggttagggctgggacagggtcagtcagccttctcattttacagtggaggaagctgaggcttgagaggggaggtgacttgcctgaggtcacacagtaagtgatcagctgtcatctgagtgatttcttcaggtactctctctggctggacccagccagtgacaactacctgtggctcaagctgagtttgggactaaatggttttacaaggacctcaaagtatactctctctcttctagtaggacatggggaatactgactttgctgagagtaagggctcttttcccaggattgttctagatccccagatcactggaaccctgagcatagatactaggctttagcttcctggctaccacagagccacacactctcaggtagaaaaatccctaaactggctgggcatggtggctcatgccagtaatcccagcacttttggaggcccaggcaggtggatcacctgacgtcaggagttcaagaccagcctggccaacatggtaaaaccctgtctctacaaaaaaaaaaaaaaaatttagccacgcgtggtggcaagtgcctatactcccagctgcttggggggctgaggtggggggatcacttgagccagggaggtggaggctgcagtgagctgaaatcatggcactgttctttagcctgggctacagaatgagaccctgtctcaaagaaaaaaaaaaaaaaacccgaaccatgtttttaatttcttaaaactgagagtactaaatgctcaacgttcatgttgtgtgcataaaagtgagactgaaggatgaatgtgtggggtatggatagatgggatgtgaatgaagcagtctctgggtccaagctctcctggaaattcgtggaacagaccagtggtcccagatttttagatttcataggccagtaaaatttccctccagatttttggaaccaacaaaggatcatcaacttttttgccaagtaagaacgtttttaataaactaatgctgcctgctaccattaccacctgattcttttttttttttttttttttttttttgagacagtttcattcttgttgcccaggctggggtgcaatggtgcgatctcagctcactgcaacctccacctcctgagttcacgcagttctcctgcctcagcctcctgagtaggtgggattacaggcattcgccaccacacctggctcattttgtatttttagtagacacggggtttctccatgttggtcaggctggtctcgaactcctgacctcatgtgatccgcccacctcagcttcccaaagtgctgggtttacaggcgtgagccaccgagcccagcgccatctaattcttttgttgtggtaaaatatatgtaacataaaattaaccattttaactatttttatttttttaagttaaattgattatgtaatgtttttgagacagggtcacactttgtcacccaggctggagtgcagtgttgctatctcagctcactgcagcctcgacctcccgggctcaagagatcctcccacctcagcctcccaagtagctgggaccacaggtgcacgctaccatgcctggctaattttgtttttcttttttttttttttttgtagagatgaggtctcactttgttgctcaggctgatctctaacccctggactcaaacaatcctctcacctcagcctcccgaagtattggagttaagagatgtgagccactgtgcccggccaatttttaaatttgtaattgatgcataatggttatgtataatcgtcgggtacggtatgatgttttgatccacgcacacattatgtaacgaccaaatcatggtaattgctgtattgtatccatcactttaaatatttatcatttctttgtggtgcattttcaccaattttaagtgcacagttttgtagcataaaatttattcacgctgtgtagccatcaccaccatccatttcaccttccctgacaccttacctgttcaacgctaactcccccttctcccctcttccagccccttggtaaccactattctacagcttttcattttcaaaggatgttttattgtctttagtctcatcgtgtgaaaccttaagagaatttctttacggtggagaaaaagtaactttatgaagcccattcctttctctactctggagaggctggtgacccagccccaccattgcaggaatgagacgggattgcggggatatggcaggcacttggggtgctgagagtccaggtgaactgtgagctcaagcacccatgtcgggcttgggggaccagaagacacatcctgaaacagctgaagcctctactaattcatcagcaagtttagggagcggcaacttttccctgcccagctgctggcgtttccttccccatacaatttctgctgagtttgggggaggggaggttgttcgagaggccccagctgggagaggtggggggagggcgatacattcttttccttaaggaacctgaccgaactttaaggtcagagctcagtggagagtgggagctgcagggttacctctttgccgttgattcatctctccaccctcccccactcttaatgatctttccattacagaacccagaccaggaagtgcatgacaggtcgcagctgcagacacatggctgggaggcctgggctccgggccagtggtgggagagtctgagctcccctccagcagtgggacccctgcacacacacacacacacacacacacacacacaccactttaacaacttggtggaagatgttctttcttatgcactgtcacaggtgatgacgagttggactttgctttgagtttaggatgtgatttatattataataaaggcaggagaagacactccccctgccccggtccaacctgagtgtttagatccccccaacttacagtccacctaagtggtccttaccagatcctgggagctttctattatcgtgcagatgccccaacttcttttcccaaaataggacccacccaatatggccttagaagcttcccagggtatccggggcagttgctagtcacagtcttaatgtctccgaaatagtatgttttcctctctatgtttctattaaaatgtcagccccaaaacatgtttctgggtggaggtctaggtgcaacagcacagcctttgcaaacacagatagacttgggttcaagtcataatagatgagttgagcctctcatttttcagtcttcattggggatggctctttccatttgcaagttgttcaggaaatgttaattgaccctaaactgtgtcctagggggcagttgtcacacaggagtttctgtcttcaccaccagctgtgtccttggcttccttccctgaatctgccaaggctggattctggtgctaaatgtgaaatggtgacacaaacttctaggaactgtgagcttggacggccctcctccatagccgcagggcatctacctttgctcttcttggatgagtgaatgaacttccctctttccagagcaatgctttcttcctgtttagataggagggagagaagcaaagtgtattgggaataggttgagcgaaagagtgtagtaagagttttctgtacagctctgtccttaatgtatcagtaaacaatagggtgagaacttttgctggggagagaggaaggagggaaatttcttttcagacaactcttgggtgcattcctttgttaatcacttaattacagcccttctcccagtgaggtagtgaactccccattgtgagaggtagggaggaggtgggggacactggtgctgattggagaaaggtggcaaaatccctaggggaaaaaagtacagatttgaaggaggcatcagatgaatccgtgcatagaagcttgagccccaaactcagttctcaggctgcgttatcctttacgacacccagagtccctctgtcttttaagatccacacacaactctccaggccaatagctcttggcgcctgcgattcccaagtgggattctacacgtgtcttgctgcccagctcggggggatctgtttttggggggtctcggggcgggtgcagggtcctggctgtggctttggctagtgcaggcggctcggcactaaattacagtgacgaggtgggacgcacaaaaggccgaaatctttttttaataaaaacaaaacaaaactctgggccccaagcccctgggctgctgaatggccatggcttcctgtcaggattagccgggctgcctgggcctgtgtgctcggcctttctcctcaggaaatacctttagtaagccccggtggggtccccatggcaacgcacggggggacctgctggcagaggccattcagtctgccattgtcccccggcccctttgttgtgagctttattgccggccctctggcaaacacagcagtttgcaccgttttgtcaggctgaatgtggagtttttacattttaatgggctcttctggcagtggcccatttgcatgcaaaatgtcccctcttactcttttcactttcttcaatttaaaaaaaaaaaaaaagcccttctccaaatcccctgggtcggggggctggtggacgccattggccctgggtgtcaggccctgctaattgatttggtgctcccggctctctttccacacatacctgtgccccccatttttgcagctctccttctatttggggactccgagagttgagagaaacacatttttggggctctctccacccaaacccttgtaggatggcagctgtgacccgggatttcggtgagatgcttctgcactctggccgggtcctgccagccgaaggtaagttttcagttccatttcaaagccaaaatacgtaataaaaaaacctctgcagagggcccccggagccccgctgcgctgttctgtgctccttttaagttgctttcaaagccaccccgagttcctcccccacccacaattgccccctcatttatctctggggagtttataccaagactgtaaacattcctggaccaccagtttcccccatgttgctgaggagtttagcctttctctcctaattttcttaactcagaaatcaaaaagatggaatagggatgatagaaattgctaccctgagacatcatgctcatggaggatgcctggattttgttgggggccagttatccaagccctaagccctttggagtgtagaacgtagagtaggtaatacaaatacctactgtcagcccagcaccccagcaacatgagtaagtgcaagacacaggcatgaacattttcagctctagggaaaggcacattcatgttggggagaggtggagaatgcagtttggccagtctcagaagagtgagttttaaggcctaggaaagtgatggagatgattgcttgttggagagagagaaggagaaaggcatttaggggaagaaaaggaaaatgaaaggagcagtgaggatattggctccactggggaggtggaactggggtagtggccgaaccaggggtgggagaggacgtggttgagaggctccagaccagctggggctgtcatggagtgttgggggtctggagcagtcaggacttgaaagccgggacccttgtgagccctgtgcagtcctgaggatgtggcccaagggggagggcggaccagctcttttgcctcgtgttcttaatcttctcagtgggtcatcaggggtcatcagctgtaagctgtaatcaacggtgaggggctcgagaagagaaggtgtcaggtgactgctggggattgagctgaggacaggagaggcagggtgctgtctcctgtggcccaggcagagcggcacagacctggagtgggccacccctcatcaccccatgtgctgcgacagtgctggctggactgaaccctggaagagtacctggacacagtggaggggccaggacccagcagatgcagcctctagagcttgtccctgttttgtgactttgggagccatttttccatgtttaaatgggaaggaacacaagtcacctggtcacaaggaagcaggccctatgaaatattaagtgcaatgccaaaacagggcattgttactggtcttgagtctgccacaatcacaatgaacacctcccccattttctcacctgccacatttggacagccgagcctgctggactcgcaggggcaggagagtgcattttataattaaaagcactcaactgtaaggtaatgattgatatgagctatgggcttgaggaaatgagggaaggaggggaggataaggccaaagcaaccaacttcagaatctcacgggaggaggtaggatgcagggggtgccattagacagaatcaaagggctgaaccagaagggcttcctcacctggggaagtcaagacactgtgaagattgaggctgccttgcacagcggtaaagctggactctggatgtatgatgtatgtggattctggagaaccaggctacctgtgtttgaatcccagctctgccacttaacaacctagctgggccatcttggactaatcccaaatctttctgtgccccagtttccccctctgaagataataattcctttttttttttttttttgagacggagtctgggtctgtcacccaggctggagtgcagtggtgtgatttcggttcactgcaacctctgcctcctaggttcaagtgattctcctgcctcagcctcctcagtagctgggattacaggcgtgcatcaccacgcctggctaattttttgtatttttagtagaaatagggtttcaccatgttggccaggctggtctcaaactcctgatctcaggtgatccacccacttcggcctcccaaagtgctaggattacaggcattagccactgcactgggcccgaagataataattctaactcttaaatacttcacaagattctaagttaacacatgctgagaactatgctggtatgtagtaagcctccgcatccataggatagaaatcatagtaggatcaacctcataagtttcctatgaggatgaaatgggagggtctgtgttaaaagctttgtgcagcctatgggatatagtgagcgtgctggaaatattggccagtagtagtattgctgtttactcagatgtttatggatccctagataatatatgggaaggcacatggtaaattacaaagtgctatgcaaatgtgttgttattcttcactgggttcctgttaagttgtggggtttggggatggataacttccagaccagagtggctgctgtgggaccgggctggtgaagcggtatttcaaaatacattttcaggtgtgtttgtccatgtggcatgaatgccctgcattcatagtctctgcagagaggtgtgttccctgggatatctttggtggctctgttctatccctcaacttacaaattgaaatcattatttgttactgttttctcccatgaaccttctgttcctggccagctgtacagcctggcctcatctcccactgcccctcagaccagggtacagccatgcctgtaagcacttcattctcttctgttccccccagacatttcacttctcatctaaatcctctcttttcccttccccgtcattttgtccaacctctgctctcactgctgatacttttctttatgtttcatgacgtcagagcctgtgctagacctgcctgtacttggtcctgacattctccatttgtctcatgttgcagtataaaatcttaatccatattaaggtgctgtgcaaatctgagcacccctgttagggcaagacatatgccttctgggcctttgtttcacccatttctccttgcacagtgacaagggctcccagagtcacctaatggtagctatgttgatgaaagttccctgactcctccttggatttttgagaactggggtctcatcttgtcataagaatagcaaggtttgtatgggtttgggtctctgatggttcccatgactggtggaagacacagatttagaatcaagaattgggaggccgaggtgggtggatcacttaagttcaggagttcaagaccagcctggccaacatggcaaaactccatctctactaaaaatacaaaattagccgggcgtggtggcgcttgtctatagtcccagctactcgggactgaggcacgagaatcacttgaacctgggaggcggaagttgcagtgagccaagatcccagaactgccttctaaatgactgtgggagatttttgtccagtcctgctagaagcaaaatgctgtacctgttggcttgttggaagtacaagcctgcagtatttggggggaaagtaggaagggaagagggattcagtagggcctcattatcattaatcgtgttcctgaacttgaaagcaccatgggaaaatcccctcccacccctgcctctgtcctttctagctgcttccttgaggattatcaaaaagtgtgggtctccggtgggctcctaattccttcttaggggatagagacaccttagagaagcagggtaggtttgatgtatgaatccttgtcactcgcactaaaaggagcactggttgcagcctgcacaaattcccaaggtccacccgccagctgctttgacccaggaacctgcgtggtaatgagatcagcagcctgagttctcgaacgatgttcaaggcaaaccctaaccctgaccttcccactcctgttgatgagaacggtgactccattctattggcatcaaagcataaggccccttttttttcacaatgcactttttttgttgttgttgagacagtgtctctgttgcccaggctggagtgcagtggcaagattatagctcctgcagccttgagttcctgggctcaagggatcctccctcctctgcctcccaagtgcctggggactacaggcatgcaccactatgcctggctaatttttttatttttcgcagagacagggtctcactatgttgccagggctggttttgaactcctggcctcaagcagtcctcccaccttggcctcccaaagggctgggattacaggcatgagccactgcacccagtccgcaatgcactgttaacacatggcacctagagcctgtaatagtgaacagccagtctttttcagcctcaggctaggtcaccagggaatccagataccagatgccctccagcctccattccccacctcatctctcaggaaacagatgcacaaagcaagtgttttggtgctgcttccctcacagcatccccatgtgcattttgaggacaacctttgtatctgattccaattaatcaggttctccaggagttggaatgttggtttcaagtgactgaacaataaagtggctttcttcatctttcttggccagtccaataaaagtgtcaggtagcttttctcttgctaatggacacctaacgacaccctggcctgttggtcttgaccagagaaaggccagctcagggcagctggagctgaagaggcaaggacctttctaatgaggacataagtgagggacactggaaagaccaaaagagaatggaaagtactgacatggtagttgcagggtgctagtgagcagtcatgcccccaaatcagccaccttacatagaactccccaagttcagggccactggatggggttgtgacgcagtcaagcagggcccagaaagcatacaagcagttggtttcatctcctgtaagaaagtggcatcatccctgctttgtaaacggagaacctgacacacaccaagagcactcctagccgtggaaaaaagccgctagaacccgaggttagtctgatttttggttcctctgaaaattagcttttgctggatgctagattcagttctggacttactgagtagtctctgggtttttgacattgttaggcactgtgggaaaattataacaggtacgtctgcgctgagttgcttgctaattcctaggagagacttggacattttggacaattaagaagcaatacaggccaggcacggtggctcacgtctgtaatcccagcactttgggaggctgaggcgggtggctcatctgaggtcaggagttcgagaccagcctgaccagcatggtgaaaccccatctctactaaaaatacaaaattagccaggcgtggtggcacatgcctgtaataatcccagctactcgggaggctgaggcaggagaattgcttgaactggggaggcaaaggttgcagtgatccgagatcacgccattgcactccagcctgggcaacaagagtgaaattctgtctcaaaaaaacaaacaaacaaaaagaagcaatacagctctttgagaaagatgcagtcataagtggtgcagagttgcagtctgcccattcctgctcctcactcatcgctgttccgaacaagtcagccaggaagccgcactgcaccaaggcttttaaagataccagaaaacacctgtgaagctggaggtgaccattcaccaaattcgaatccctctaatgatccgcagcgtaaaatccctggagaaggtgtgtgctgacttgattcagaggaggaaaggaaaagaatgtctaagtgaagggaccagtttgaatgcctgccaagactttgagaatcactataagaaaatctccttgtggtgaaggttcagagacatgggatcgtttccagatgagaatccacaagctacccactgacttgcacagtccttctgagattgttaagcagttgacttccatcagtgttgagccaggaattgaggtggaagtcaccattgcagatgctcaaagtcaactattttaataaactgattagcggttgttataaaaaaaaaaaaaaaaagcagcagcaatatgggttgagcgcagcggctcacacctgtaatcccaacactttgggaggtcaaggtgggtgggttgcttgagtccaggagttcaagaccagcctgggcaacatttgaaattttaacttattttttaaaaaagaaagaaacattatacccaatatctgtcaattgatgactgcaatgtggtatgtctacacaattgaatattattaggtcattaaaaggaacaaagtgctgattctatgctataacatggaggaagtttgaacacatgctaagtgaaagaagccagtcacaaaagatcacatattgtatgattccattgatatgaaatatctagaatagccaaatccatagacagaaagcagattagtggttgcttagactggggataggggatggaggagtgactactatgggtcaggcattttttgaggggcgagggatggtaaaaatgttctaaagtgagattgtggtgaatgattgcacaactctgaatatacaaaaaccattaaatggatgaatattacagcatgtgaattacctgtctgctgtttaaataaaatagaaacaatacaaaatggaatgtaattgagtgtgaatttgtgtgattcaggcggtaactgttttacagaaaattagagatgagacattgatataaacaaggcttcctagtttcttgttttgttttaagacagggtctggctgggtgcggtggctcacacctgtaatcccagcacttgctaactgaagatgcaaggaccgaggcgggcagatcacttaaggtctggagttcaaggacagcctggctaacatggtgaaaccccatctctactaaaatgcaaaaataagccagccattgtggcatatgcctgtagtcccagctgctccagaggctgaagtgggaaaatggcttgaacctgggaggcagaagttgcagcaagccaagattgtgccactgcactccagactgggcaacaaagcaactctgtcttaaaaaaaaaaaagggtctttgtcatcccgtccagtggcatgatcatagctcaccgtagcctccaactcctgggctcaagcaatcctgtctcagcccactgagtagctgggactacaggcatgtgccaccaagtctggctagtttttaaatttttttgtagagacgaggtctcactatgttgcctaggctggtcttgaactcctgggctcaaatgagcctcctgcctcagcctccccaagtgctgggattgcaggcataagccactgcacccagcccctggacgttttggatggtggactttgagtagtttggggtaggaggactctggagtggcgctgacagtcctcaggaaggagtaagctttgccatgccagggaggatgcagccgtgctgaaagcatcccaactggggaggggggggggcgcggtggggagggacagcccctggtagagagaatggggctgggtggagagagtggaagccaattgcagggagtcttgaaggtgaggcagggatgtggattttactctgtacacagggtagattttgatcaggaaaataatgtcaagcacatgacagcttggaagcaggagtctgagctgcagccccagggaggccatttaaaagattatcccggctgggcgccatggctcatgccagcactttgggaggccgaggcaggcagatcacgaggtcaggagctttagaccagcctgaccaacattccccttctctactaaaaatacaaaaattagctgggcatggtggcgcatgcctgtaatcccagcaactcaggaggctgaggcaggagaatcacttgaacccgggaggcagaggttgcagtgagccgagatcgcagcacttcactccagcctgggcgaaagagcaaaactccatctcaaaaaaaaaaaaaaaaaaaatttatcccgagatggttccggtaaagggataggacagagcatacctgagccacgtttggaagggaaccggggtctaaacttgcatcaggaggaaagcgagctggttcttgaggcttttacagatcacgtatagtggagttttgtttgcacgttctggttgggacgggcaggaagttacggatccaagctggtatcagctagagcgggtctcaccagggccagtgttcctttgctgcattctcttggggggaaataaatgcctgggggttctctttgctacatttttgtctttgggagctgcttttttctctgggatcggctgcaataggccttgtgatgccagagggtaagaattcaagtttactcttgaccaatgggttgcacagatcacaagctgcaaaatatttaatcaccgaggtcatttgagggaaatgagatttgatcaatagaagtgtctgctctgttccttaagagttgagtctaaactgcttttctccttaccttcgtttggcaaaaccacagaccattaaaaatggaaagaataactttttctaaggcccacaaaagcttatttttaatcagttgtgtggtctactcacctttgtggtgttccccttgaccggactcacaaaaataaacgtgtgcaagcctagtggtttctgagcccttttaaagcagtacccctgtttctgacaactcttatttaagataaagcccatgggtcaatgcaggactgggtctgcaaccttggcccccccaagagaaaccactgtcagtccctgtcagttgctgatcatgatgcgcgggacacccattttcatttttaaggtttctagcggaagcctgttgagcacttgaggaagaccgtgtttcaaataagggggagtgaaagagaaaagggagagtagaaaggaaggcagtgaagagccagagtgactgcacgtgtggtatttattgagcaagcatttcttgagcaactcctgggcgccaggcatcgtagtaggtgctggggatttaaaggtaccgatgacacatcaccgcactcaggttcagaaagaggactgcccttcagtgtgacaggtgccaggagggggagggcacctaacccagactgggagtcagcaccgccctggaggagaagtcaccagctaggctgagacagaagagtgagtagtgagagctggacagaaaaaaatcaggggccctgtggccactggggcagccgtgagccacagcaggggctgagggagaacatgctgtttcagagccttatgcatcggggagcggcagtcgctccactgagtctcttagggtgaacaaatggtgagaaaagtcctctccaaggctgtgggcgggatgtgggtggtaggtgagaggtggaagatgccaggagtacatttgaacatcctaaaaggaaatagaaagttcatttcccctcgtgagtgcagaggggtgtgctcaggagatgggtaacagcccaggatggtgaactcaggtgtgtccgggccacgggccttcttgaacgcgtgcgggaagaggcactggtcaggggagggacaggtgctcttggtggtatcagatcttgtgaggtgcagacaccccggtgggtccagtgctcccacccagggacagagaaggatggggcacggggagggagagtggatggtggggggcctgagggtgtgcccagtcagagggctgaggagaaaggacctttgtgtgcgacagctcctgctgccagagcaagtgtgggttttatggcagctgtggcctcccgtcctaatatagtcaacagctccaaatcccctgccctgacacctgttagcgagaggttccctgagctgacctctccttgggctgcccccccagcatgtgcatctgacgcgtcgagggccagacccccaccctctccgaatcacacgcatcctggtcagcccccagttgacaaattgccttctctcgacttgggcaggggctgctggggttttgaggggcggggtttgttcagctgttgctagggaagggtgaggctgagctatcccaaaggaaatggggtgttcctctggcaagtggcaatcttggcaaagaactgagcatctggggagggggcaactccggacacaaagaagtcctggggagggccgacctttccccttaggatgggggaaatgaaatgcgcttaatgctgctacagctgcttcctaactttgcctctttcttcctttgacttttggaggagtggggtggaaaagagatgggggttcccaggcagccagctgttttccccactgacccatgctccaattcccactgccctggctcagtagcctccagtaagtgatgcccaggatggtgcggctccgtgtggccagcgtaattccctttgtctctcccctcctcccctctccctgtcttcctctctcgccccttggcttcccttcccggccccgtggtggctgcagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcaggttggtagccaagccctgcccttgcccctccctagacccaccccctccagccctctctgccagtttcagaggaaggtgaacctcctccccctccgtgatctgcccccactctgcttcagaaactgctgcccactaacattgctccctgcctgccgcgtggcttggctctcagagaggtgactaggtggggtgggccccagggccggagatctggggcttccaggacacacctcggaggtgattgccagggctcttgggatgttaagaccctgtgatttttttccaccacagcttgcccagatctccaggaggctaagtggtgctcggccagcttccactccatcactcccttgccatttggacttggtactcggcttagtgattagaggccctgaacaggtggtggtatccctgctctgctggagaggaacccaggtgcaccgcaagggagctgtgcgagggcagccagggagccctggagctctgtgaacttgggaacttgccactcttagaatgtgactttcacaaaactaggagttgaggaagtggagctgaaattttctttatgccatttatgcacctcagggtgtggacttggcagcagatccccaaaggtgataggaaggactggagaaagatctggcatgaaccctgatgggtgaccacatgtgtatcaagcgtgttcttacaagaaataaatacttattggggagaggtgttggcagctgctggggtggtgggtgccctatctgctctgattaaggagggcagcccccaaaccttagtagacacatgctagaaaaattctgactgtggggtgtttagcccatcctttggaaatagcatctagccacagtgtgtctagacctgcctgggtttccctatagtcagccgtccaaagaagaatacaggttgcctggctccagcacacccaggtggcaccacaagttgagaaagcgcctttgaatgtaggacggaattaagttaaataggaacagctgaccctgatggaaccacccagtgtgaaggcttccaggcagtgggggcagtgcttcggggaaggaagcaaacacgcacaggaactgttcttaaacagtttccatcccaccaagagatcatcactaagggagcagtgggactgggatccccatggggagggtgtccgtgttcatctggaactgcactagccttggtgaaatctaggggtccctaggaggaacctcagtgccccttcttcttcccatagatgctctcccctcctcggaggatgatgatgatgatgatgactcctcttcagaggagaaagaaacagataacaccaaaccaaaccgtatgcgtgagacactgtttcctatcttactgccctttgggtctgggcattgggtttaagaggggaggggaaggctgaaaggggaggaagaggagggcacatggggtcacggtgcctgttctgctaagtgccaggcactgctcacaggtgttgggcagatgggcaagacacctccaggtcctggcctgggccctgctcctgagcctgaccagctgctcctctccaccctgcctgtctctcttggctttccccgggcagccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtacgtgtgtgtgcatgcgaaagttagagtaatgggaacaggggaggccgagttaggaagtcctgattacatgcttttcatttttttaagtaatactttccacctatacaggttattcattaaaatttttaaatacaaaaaaatgcaaataaagtttaaacatttcttcagtcttctttctgtaatatggtttttacatagttgatcacatcatgtatgtaatttccttgccttgtcatttgttaacatgagtcttttcctgatatatttcaagcatgaatatttgaaacataatttttcatgactgtataagattccattattttaaaatcccataatttggctgggcatggtggctcacgcctaaaatcctatcactttgggaggccgaggtgggcggattgcctgagctcaggagttcgagaccagcctgggcaacatggcgaaacctcctctgtactaaaaatacaaaaaattagccatgtgtggtggcaggctcctgtaatcccagctactggggaggctgaagcaggagattgcttgaacccaggagacagaggttgcagtgagctgagatcacgtcatttcactctagcctgggtgacagagtgagactctgtctccaaaaaacaacagaaaaagtcctataatttaatgaactattttgtgatattaggtattttctggtttttcaccataataaataatgttgcagtgaatctctgtcagcatttttttaagcgtgcttccttaggacagattgttacaagtgaaattactaacttaaagggtgtaagcattttttttttttttttagacggagtctcactctgtcacccaggctggagtgcagtggtgccatcttggctcactgcaagctccacctcccaggttcatgccattctcctgcctcagcctcccgagtacctgggatgtgcagccaccattcccagctaatttttgtatttttagtagagacggggtttccccatgttggccaggctggtcttgaactcatgacctcaagtgatctgtccgcctgggcctcccaaagagctgggattacaggcttgagccaccgcacccagccagaaatattttaaattaattcaccatgcactcactacatgcaagacaccatgctttaaatgctgcaagatagcgttcctgcccataaaaattttgcagtctgataggaggcaaatgtccatgagcagctaccgtaaaaagtagactgtgatcagtgctttggtaggcagagaggaaagggtgagcacagttctgaccagagactggactggaggagatggtttttgaaatgagctgtcaaggacagtgggggctggattcttagtgtaataggagaggtgcacagttgggaacattcttggtgtatttgggagtgtttgcagaaggcacatctgtccggatcacgaatgatcttgaacgtcacagtggagacttctggagtctttacaccccatctgccagcttgcagagtgtgaacgggctggtaggggggcaatccacgccttgtcctagccaaccctgcagcctggggccctgtgccaccaggctctgatatggagggcaggtgccacggggtgccgacattgtcatggggcctgcattttcctctggaccctcaatgtatccctttggcatttcccctcaggtccgttatgccacctggagcatcataatggactctgtggtgccctctgacaagggcaactacacctgcattgtggagaatgagtacggcagcatcaaccacacataccagctggatgtcgtgggtaagagggcagaggcagcaggaggaatgagtttagtgggaagagccaggcttggagaacacagccggggtgtccaggtttcttaggggcagagtcaggatagcgattggcacttcttggctttgtcaccttgagcaggtcacttctcccttttgagcctcacttttcttatctgtaaaatagagttaagatcagacagtaacacggtcaaagctggttgtcactgtgaaattgaaggtgctgttcagagtctgtcctgaaggaggcgttgttggagaggtgttaaatgtagcgtaataggagctgtcgcttaatgctagcaagatgccaggctccttaaatacctgccctgtaatgctcatggcacacctgcaaggtgggcagtattagtctagccctgcacaggagcacaggcgcataggctcagagaggtcagacaccttgctaatgcagaactgcacacctgtgccaacttcagggcatcacaggagactctgggaagaacattgagcctcttggagctattaccgcaaccttttccttctaggagttctgaaactcactccctagagatcattgggtacagaatctctcagccagtgttcttcttgattatgatgatatggtctaagaaggagattgtggccaggagcagtggcttatgagctccaggtggcatgatgggattactcacgcctgtgatcccatcactttaggaggccaaggctggaggattgcttgaggccaggagtgtgagaccagcctgggcaacacagtgagaccctgtctctataaaaaaatttaaaaattagcctagtgcagtgtcatgtacttgtagtaccagctgagttaactgaggctactgaggtgggaagatcacttgagcccaggaattcgaagctgcagtgagctatgatgacacccttgtgctccagcatgggtgacagagtgagaccctgcctttaaaaaaaaaaaaggtaaaaaggagattctgatccaagaggttggggtaagatctgagattccgcgtttctaacaagctcctaggggatgctggtagcactgctcgtggaccacactttgaatagcaggagtcaaagtgactctggttttttaaggaggagcaggttgtgctgaggtctgggggtgcaactgaattagaaggttctccattaaagcatgagcgacttactgtgactgtaaatatgatgactgccttggggaggaggatcctgatggcttagggcctgaagagagggtgtccctttccccagctctgttttgagaggcttgggctcagcagaagtgctgggaggtttacaacccatcactgggaaagccaagtggggcgcaggtgagcccacccctctttagccatggcaaggtccccatgacaagtgcctcctctcccatcttccacagagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaaggtaatcatggcaccagtcttcgtgggccagtctactgggaaggagaccactgtctcgggggctcaagttcctgtgggcaggctcagttgcccccgaatgggatcattcctcacgcttcaggcacacacactccatctcagtagggatctagccacatcccccaggactagtaacagaggtcacaaagtggaggtgagctgggaacagagggctgcagggatgggtggtgctggtctgtaataagctttgagagcaacgtcactggggctttggggtcagctacacaaggaaggcatttggacccctgccttttcattgcccgaaaccagagcctttccaccaagcgtttcccagtcttagccctgtgtcctgagttacgtacgatctttctggcaaatggggtgcatgataagagcatctcttacgaagagttggaaaaacaaatgccatatataaattctaagccatatgaggacgaggagtaatggcattttcttcctttttcctctcactcccagacattcattgtccctgaatgctccattaatccagggaaggtaattgcctaaatctccagtggatctcgcaacaggaaggaaccagaagctgggaaagttgtttacctctttgtcccagagttagacctcatcctcccctagcttagctgtctcagagatatactggccctcccttctcttctctttgctgctggtgctaaaactgctctgtaggtcattggccactgtctccactcacaacccctgctccagtcctggagggagtgggttaaacacaaatagaacattccatttgaagcagtgattctttttttttttttttttttttaatcaaatgctttggacttttgaagtccacttgttctgtacttgtaaaagggaaagaaggccgggcgcagtggctcacgcctgtaatcccagcactttagatcacttgaggtcaggagtttgagaccagcccggccaacatggtgaaaccccatctctactaaaaatacaaaaattagctgtgcatagtggttggcacctgtagtcccagctactcaggaggctgaggcaagctaactgcttgaacccagaaggcagaggttgcagtgagctgagatcacgccactgcactccagcctgggtgacagagtgagtgagactctgcgttaaaaaaaaaaaaaaaaaaaaaaactaaaagggaaaggtaataaatctcacttaacatctcccttcgctccctgggcctgcctgaaagttacacgggagcaacgtgcgtggccacatctcagctttgcccaactgactggtgtgtcgttggtttgttccagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaaggtaatggggagatggatgggaccctgtgctggggatttgatgtaggccccaagctgctggggcaggcggggaagccagtactggactgtccttgccaccctactgtatttctagtgcccagagccatggaaaaatacccggcctgggaggctggtttggtttggtattgtgttggtgtctgtgggttccctctctgccttctgtgtgttccttggctttgtgtggatccatgtgaggactcacggggacacggttttgctgtgttacaaatggtacttcagactgaagttgtgagtgagtggtgattaagagaaggggccataggccaggcacagtggctcacgcctgtcatcccagcactttgggaggctgaggtgggaggatcgcttgaagccaggagtttgagaccagcctgggcaacatagcaagaccccatctctacaaattaaataaattagccaagtatggtggcgtgtgcctgtagtcccagctagtctgaaggctgaggcaggaggattgcctgagcttaggtcgaggctgcagtgagctatgtttatgccactgcaccccagcctgggttgacagaatggtaccccatctcttaaaaaagagagagaaggggttaggcattcccttgcatactcgcatctgctggctgtgtatgcacatgtgcgtgtgtgtatgcgtgtgcatgtgtgtgtctgcagcccccgccatccctcctgtgttcaccttctggctatctttacctgaaaccaaacagcccctgcccgccggccccatttctccatgccgctcaccgcccgcatgctcggatgggccagtggctgccagcatctggtgaagggtcgtaaccagccatcgtcttctcaggtctgccggagttcttccctcagggtctcaccctcttcctctaacaggttttgctgcctggtggttttcgtttgttccttgttgcaaagaagatgtcagggagcatttcttcctctagtcccccttctttctgtctccttcccttgctctgcgtctcttagaggtctcatgtcctgtgcttgtccattttgcttccgttgtctcttctagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaaggtacacactgtaacttctcctctcgatgtcctgccctcgccacgggcacggggggagcatgcatttccaggcttggggagacacagaggcaggagagctggaagaatgggctcctgcctgcctggtgccacatcctgccccagctttgagggctgaatcctctcagctcagagaagagcttccctagttttgcaggcgcacggaggcctcccacccgtacacctgcctctgctctccccctggccattgcaatgcatgcccgggatctgggtttaccctgcagcccgactcctccagggcaggctccttccgtccttgggtccagcagcctcccccctccgctgggtactgagcatctgaaaagtctcagatagggccctacacctcttctcccttctcaagtgctcagcccaggggtggggcttgctgcttgcaaagagcagcccaccctcctgtactgccatcctattgcctttgaagaaggaggtcagcctggacaggtgaactgagttgccttcagaaaggcctgtctcaggcagccgcagcaggcttcacgatgtccatgtatcctgtttgcctgctgccgtctctcctctcccaagaggggaggtctgcgtgttgagccagggaggaaggagcctgcagcctgctcagggtggtggctggtgactgcggggccagggcttgctgctgtctctcggaatgtcctgcatgtgggtctggctgttcctgctggcactgccctcttctctctcccctcctttcccactctgccctgcttgcccgtcagggtctccggatgcccctgctggaggcagagaagcgttctgtttttatcatcgtccctgtcttggtcctgtccgtgctccccatgtgctcccaatcagttgtcttcgttcctcaacatcagggaaagaaaaaacagcaacacttctccctgtcatcagctctgctgtctccttgtcaggccttgggacgttctctgggctcagtctagggtcgtgcctcatgcctcatgcctctctgggaaggttcccaggggcgccgcctccatggttggctggtgggttttaaaggggaaggttgggaggaggcctgtggaaggaggagggccgtccacacccgtggggcaaagcgtgttccatgaaaccagtgctgtgcgtgctgggatgaaagcctcccagcctctcgtgctgaagggaaaggtggaccgaactggcttagctgctgtggcaatggggtggggggtgagtcctaatcagaaggtgggagaagagaataacaaaatggaactccgccccctgccgccacatttccttaagttttaggagttggggcctatgagtagaatttgaaagaactaccaaaaaagcttatttttggaaattaagtcagctttgcctgtggtttggctaggaataaatatttacctgtgtgcccctacagagatgacacagacccaaagtgggacattgagcaaggcacaggctggttcccctcctgtcctctgtcctcattctgtgagtgccaccatcaccaggtactgtggcctgcagaaataaacgaggcaccaaccctgccctcagggaccccgtgtcttcttagggacagaggactcagaaacatctgtgtccccgcatgttaagtgcatgcacacagtgctgaggctttgcagagaagggccatggctccctgaggagaccaagaaaggcacatagaagtgacttctcagctggcccttgcaggatccctgggtgcctgtacctctccagtccagctgagcaaggaggctcaggaattaatgaagatggggcttgtgtagcacgatggttctaggccatcccttttccatggctcaagtccattgaaggcagcctccaaaatcagggggttgcctgatcctcctagtgccacaatcccagtcctagctagaacttgccatggttcttctccctaaaagttcccaggggacaggagacaggtgttgcttttctaatggagcgggacctcgcatggacggggccctccaagcctgctaacaccctgttcgcactgactcagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagaaagtagatgggggatttgcacactcagcaccacctctctctctgggcctctaatgccctgccctctccattgtccctaatttatagctttgggccttattttctggcttctgggcaaggcacagtggaatatcatgaactaagtgctctagagtctgtttcaagctagtgtagcccgtgaatttcctgcaccctccatatcacactgcaagtcctccggactcctgggacatggattgggaggaagtcctatttggacagaatgtgcagccaatagcatgaatttgaactgtccccaagggctgcttagaagtgcagagatgcagggtagagaagagaactgtttgtattagtccattttcacactgctgagaaagacatacccaagaccgggcaatttacaaaagaaagaggtttaatggactcacagttccacgtggctggggaggcctcacaattgcagaaggcaaaaggcacgtctcacatggcggcagacgagaagagagcttgtacagggaaactcccctttataaaatcatcagatctcgtgagatttattcactatcacaagaacagcacagggaagacctgcccccatgagtcaatgacctcctaccaggtccctcccataacacgtgggaattcaagatgagatttgggtggggacacagccaaaccatctcagccataccatacccttgtcccctgtgtgcccacccttccccacgggaggaaatggtacagatggcacaggtgtgtgcaagaatgaccgttccctcagaagcctgtgctcattctggaaggtgctttgggagttaggaatccataagctaaggcaaagtatttgcaaagagtcaggagaacagagttgttactgcaatgatcagttataaaatgtcaagctggaagaggtgcatttggtctgcttattttaaaggtgagtgaagtccagaaaggccagcttgtggcagaaataggtcagtcctagaagttgggcctcctggcctaccatggtctttggaccactctgtgttgaggaaagaacatcagatacacagacatgtgcctctgccattgttgggaagccctgactaagaatgggaaggagtcaccccgtcccccctccttgctctagggtgaccccactcttccttgcaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacaggtaataatactttgactcccaactttttgaaggcattccttgcttgctattctagtggtggaaggtgtgtatactaacaccttctgggcggtgaaggttcatgaaatgcctgcagaaacattcattccactttctgctcgcagttgggtgaaatacagagaggtggagatggggtgcctctcaaggtttgaacttcaccagccccaacttatgccactctctgtttcccccgaaagactggtcttaggcaaacccctgggagagggctgctttgggcaggtggtgttggcagaggctatcgggctggacaaggacaaacccaaccgtgtgaccaaagtggctgtgaagatgttgaagtgtaagtgatgcttctgtccttgcaaagaaaatcttgtcccattccaagcaaacagcaggcctcgggcccagcagaacagcttctctggtgcctttgctgcccacacctgctccgctgcctgcttggggttacctgggagtggagggggtgttctgcaccttgagattgttctatgacgtcactctgttccttggcgtcaacctgggctgtggtcaggtgtttatcctggatccatcgcttgcaggctttcctcaccacatccctgcccactcactaccacctattgcaacaacggctcccatgagagggaagagaaaacaagtttggatgaagtggggaggagagaatcaagtcccagggaaaagcagcccctcgacacataccccactcccttagcctttatcctgccctcctcccttcccaagtaaatgagtctcaacgtgttctttaaagcggacgcaacagagaaagacttgtcagacctgatctcagaaatggagatgatgaagatgatcgggaagcataagaatatcatcaacctgctgggggcctgcacgcaggatggtgggtgccggccagactggctttccctgcccagcggggagaagatctgagctggggtatcagtcccaaggcctctctcagccacagctagggaagggggttaagagaggctgctttggcagaggtttaaaatgtgttatctcgggatctgggctccgctcattggtgttcattcaggaatacagatacctagattcacacacgtggtgtgttaacagaggcagctgagtaattatggtctaagagcgctcaggctgggtgcagtggctcatgcctgtaatcccagcaatttgggaggccgaggcaggaagatcacttgagatcaggagttcgagaccagtctggtcaaaatggtgaaaccccatctctactaaaaaatacaaaagttagccaggcatggtcacgcatgcctataatcccagctactcaggaggctgacgcataagacttgcttgaacccgggaggtggaggttgcagtgagccaagatcacgccattgtactccagcttgggagatactcccgctgtctcaaaaataaaataaataaataggccaggcacagtggctcacgcctgtaatcccagcaccttgggagggtgaggcgggtggatcacttgaggtcaggagttggagaccagcctggccaacaggtgaaaccccatctctactaaaaatacaaaaagtagccgggcgtggtggcgcatgcctgtaattccagctactcgggaggctgtggcaggagaatcgtttgaacacgggaggcggaggttgcggttagccgagatcgcgccattgcactccagcttgggcaacgagcaaaactccatctcaaaaaaaaaaaaaaaaaaaaaaaaaattagccaggcattgttcatgcctgtaatcccagctgcttgggaggctgaggcaggagaatcacttgaatccagaaggcagaggttgcagtgagccgaaattgcgccactgcactccagcctgggcaacagagtgagactccatctcaaaataaacagacaaactggggctcttaccccaatgttgctcgggaattttctggactatgctgggagtaattatttctctgattttttttgggtagtagaatggatttcccaggtcccctaagaggaggcaggagatgggaggttggccggggtgtgctgctgggggtggggtttctttgaggtgaagccaaacctgctcacctgctgctggccccatggcctcttctcctgtgcctgcaggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaaggtgtggaacctgaaggctcccctgggtaatgccagggtgggaacagagcccccctagtcttccagcctgtgacttatcatcttgtggtggcgttgtggatgcactgagcactggccctgtgtgccctgtgtgttgtcttaggctctctgggaactgcagagtcaggagcaccagtgtagccaggtggccttggggtcagactgatgcagggtccgatctgtgcactgccactttctgcgtagcctcaggcagctacttagcatcttaaaattcttcaaatacaaaataataataatatcagctgggtgcagtggccaaggcgggaggattgcttgagctcaggagtgtgagaccaggttgggcaatatattgaaaccccgtctttaaaaaaaaaaaaaaaattaaaaaattagctgggtgtggtagtgcgtgccgatagtcccagctactcgggaggctgaggtgggaggctagcttgagcccaagagtttgaggctgcactgagccatgatcacaccactgcaccccagccggggcgacagagcaaggccctgtctcaaaagaaaataaagtataacaatacctgttgtagaattgttatgaagataaaatgaaactgtctgtgagtgttgagtgcagtgtttggtgtgtaagggctggcctggtttgagcccagccccatgtggacttgctgtgctgggaggcaggacctaggagcatgcatcgctgcagacgcagcagaggcataaggggccagtctttggggaaggaagggaggagcgcttgctgtgatgagaagcctggagctggcagagaatgttagaagagggaaagcaaaggttcggggggcagagcagtgtggcagaagttctatgagacaagtcggctagttgcatgggtggcggccgcccagagccttccagctccctcacctccccgcctcccgctctcccttcctccttcctcagtgcatacaccgagacctggcagccaggaatgtcctggtgacagaggacaatgtgatgaagatagcagactttggcctcgcacgggacattcaccacatcgactactataaaaagacaaccaacgtgagtgccgacaaggccgccctgtgctggtggtttcatctgagaagcaaggagtggggtgggctgagaacccaccccccagtcccttcccacctgtgccctcatggccctgcctggggccactccaacctcccctgtgctgctttcagggccgactgcctgtgaagtggatggcacccgaggcattatttgaccggatctacacccaccagagtgatgtgtgagtttgtaatagcaattgccagggaggtgtgggatagagagcttctagcactgtagagtcctgctttctccctggactgaggagtcctctttctgccccagagagaaaaacaaaacattgtctgtggccattccctctgctccagatgttgaaaggctgatctgttctccatgctgtctcctggcactgccctgggtagaggatttgtgctgggggaggggaggcggagaagctctaacaccctgtggctctccgcccatttgcaggtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtaagcccgaggagatgtcggaggccctgagccaggccttggggcaagagtgggcttgaggggcagggggctagactagagagtatccatctccaggagacgtccctgaccttacagtcctgccgcaggtacatgatgatgcgggactgctggcatgcagtgccctcacagagacccaccttcaagcagctggtggaagacctggaccgcatcgtggccttgacctccaaccaggtaaggctgcccgtgccagagccagagctcaggccgtccccactgcgtgcacgcacctccctgagcagggaggaggggcccggcccatcgctgcttcctctcgcccatcacaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcattt

SEQ ID NO: 37467 - DNA, 40182 bp, Homo sapiens
gcttccgcccagtccagcccgggccggctgaccgggtccgacacagtctcctggaccaggctccctccatcctcacccctcccccagcttcccgccgccactcaccgaaccggaaccggctgccatgcgaaggggtttccggccgggcgcggaacgcaaaacccgggaaccgccgcgaaccggaaccgccttcacagcaccggaagagtcgctaggtggctgaagaggagggggctggggcaggaggtcaaagaacagagttaaggaccagtggggcgcctgcgcggtgtggcgaggcccgagaagcgaagggagcatttaagactagtcgtaatttctcagtacccttttcagtctgggctttttcgctttctcgtactcggaatactgttagtgagcccttcgtcctatgcttttctctgttccctctgctcccttacccgccgccttctggttccgcccggcgagttttgcttgcttgcgttccagtttccatggcagcttttcgcggtggccctaaatctgcggaaacctgtggcttcccccgacagatagggacctgagatctaaatcgatctcaggctatctcgtgttttattgagaatcacagaacgttagtgcttgtagaggttattggagatactttagtcttaccaggttcagagaagtgaagtgatttcccaaaggttttaagtgcacggcccatctaggactaggaaacaagtttcttaacttgcaatcctgtactctgcaccacctcatacttgattgaccattcagcaagcaaacaaacaaacaaacaagcaacttgaggacggattaggctagactctggcaagatgtagaaccttccagaactctggaggaatttgaaacaggcagagctgtgaggaaagcttttgggagcccactagagatctgcttttctgggtagagatagagaaggacccaggaatcacctgtgacctttgaagggctttgttgttcctgggacacattgattaacctggaatctgccatactttctaagagaacataatgggaagaaatatgtttgttcattcaggctttttgtcaagcacctcagcttggcaggcctctggacccaggccctgtagaagtcttagagaaatgcccccttaataggtcctttacacccagatcacagccacaggcacagtctgagctcagacttaaagaagggcagtttctggaggcccccagcctttctgatactctcagcagcttgctgagttcagggtttcctcccctgtcaaatacatcaaagtagattatttgtattgcctcatgtgctgatacttttatattatattgtcaagtcctaaggccaagtagtcatgagtgtagctggtccatgtcagtcactgacatcttatttcacagctctgttcgtttggattaaactctgtctctatttctaggaggcagccatgcataaagacgagtttcatctgaaatttttcatgtgtgtgattcagtctcgccagttagtcaggactcctcagagaacaggtacccttgtctcctgatcatactccagtgacagagaatgggttctctcacaagaagtctaaatacaggatgtgaggctttctagtgtaaatacggattttaggggtcaactgaccttgtttatcacattctcactttgataaaatattgatcactgagtcgtgtattttccaggtaagattttgacctggtttgttgtgatagatgccaggcagataaggaggacttgagagttgaggggggaacaaaatttatcccatgagcttgtcattattgtgttgttatgtgaattacttcgaccagtctgggctcatctgtgggaatctttattgtcattataactgacactccaaaactatcagataaatcaagccctaaggaaaaatggccttctcatccaccccacctcaaagtatctagttatatgttctgctttcccccatgtatgtcaagggaatagaatctttttgaggtacatcgcgtctctaatttttcactggatttttggaaagaaagccctggacagctcagagtcatagggaaaatgaaagggagtaaggaacactcccttcccagaatcccaccttgagggtgacctaaagctattgtttctcagctggggaagcttctacttccagcatgctcataccaaagccaccaccaaagacagacatcttgaagagtctagatactatggatgatccagacaccgtgggaagcatacctgttttcaaaactggtgaggcatgtgggtcaacagtgagaaatgttcaaaggaatatgggaaagtgaaagttgtatgcatagtattataaatcagcgtagacctactaaagctgaaatataagacccaagggggaaagtctgtgtgtgtgtgaaacagagagagagagaaagagagagagaaagagaaagagggatggggagggaaaggaagaagggagagaggtggggatggatcatctgggaaattgtagggaaacagacacatctctatgcagaataacttaatttggtcaatattaaatcaattggctcataactgtaaactactaatctggtttatcctattgtcagcatccttgatatataaatatgtgaaacttaagaaagttgactaaatgagttattattttacaaaatgattctaaatattgtaaaaaattttcatcttaggaaaccatttaataatagatttctcatgtatttttaaatgttcaattcacaggcaatttatatgaagcttcagaaacacatctatgtatttcgtcttaacttaaatacatctatattggagtcaattcactggaaacctttattgagttcccgctatttgcccaataatatactggaaatgatagattataaaacatatgtataaggcatatccttgccattgccccaatagcttacactttggaaatgccttagcgattatttaccccaactctcttatattttcagaaggaactcaggactaaaaggttttcctcagaaagttgataatttcattaaagtaacaactcctagcacttatgaaatatatatcagtatttagccatatttttgagcactcactatttgaaatcattgggctagactctgtaggaaatgagaaaatgaaatagacactttccctgttccctaggagcttatgattaaggacgggagataatatggaacaatgtgtaagttaagaacttaataattttggttcaaaatgttgaattggttcaaaataagatgccatagaaatgtagggttcaaaataactttggttcaaaataagatgccatagagatgtagggaagagaacagccagctgactgctcagagccagcttttcttttccttccttccttccttcctccctccctcccttccttctttcttccttcctttctttttcttttctttccttttttcttttcttccttttgcaactgtttgtggtctacatccctttaatcagacttcctttgcccctgcatagaaagcagcaagaaataaacccagctgatggttttttcctattgtttattgaatttgtacagattatttcttatttgccctcatctttcctgcttttttcattctccttttgctctggtgtacctaaaactcacctcagactccctttgctctgatgactcatttggacctgcttctgtggtttgaactcagcattgtctcatggacaaaattctgatgttcaacttctgcctttaaatcctggggtctgtgtggctcagttaagtggccactcttaaccctttcagctttcctactagagaaaggaaatctaatattttcccagcaccaataaggcctccattcctcctcttctgcctacctccctgcttccttcctcatcctttcctcttcccttcctccttccctcctactcttcctccttctttgacttccttccaagagaatgtgttgagcacatactatgtcaagtactgtacttggcactgggaataaagtagtaaacaaaacaggtacattgtctgctctcatgaagtttatagtcttgtgggactaagacagtaatcacacaatcacacacatggttatataactagaatggtgttagtgcaatgaaggaaaataactccatgtaatcagaggataaaacagggggtgtaatatggcctgagaagtcagaaaaacctttctcaggaagacctgagggatgagtatgcattagccaggcaaagagagaagagctttccagaaaaggggacaataggctgtgaaacgggaaagagcagaatgggccaatgtgacttgatgatgggaggaatagcgggagagtgaactgtacaggtggtgtaagagccagattgtgcagtgccttctaggtcttatggacacttttgagctctgggaaatcactgaagaatgataggatcatattgcgttttaaaacatctttctggctcctgggtggaggatggattggagaggtacgagggtagttatctgctctaatgagatggatgccactgccttgctccatttctcacctctaggcaatgcatcactatagggcaccagtgaaatggtgaggaactcatgtcgtcaaacaacagagatgagcacagagctactggtgcccaaacataaaaaacccctggcctgatgtctttctgcttctgccagcccaagaaattcacagggactccctccagggtgttctgctccttgttctaagtgcagttgtatatggagattctgtgctctagtccttaagaaaaatggaatatatttctttcttgtctcttacctggcagggaagcagctgctgttttttccaacatcttgcctatcagtataagcagctctgcctgtactataatgaggcaggctgtgtgtgtgtgtggcccatagaggatcagctcctggcataagaaagccacttgatcctacactggggcatagcaagggtgtgagtcatctaggctgtacactttacccctatgtcctgacccctaggcttttcaaagaaaggtggttagcatttcaagataggtaagagtgtgggacaactacttccaggaaaaaagctcaggggtagcaggcacctttgtggtccaggctctgatccagcagatccaactgcccactagacataaagcctctcctgtgtataaagacttcgatgatgggcaacctgcctaggtaactagtgactctcaagactacttctagtgacctgaaaatgtgggaagcattccaaaggagtgctgcttcacccatttgctccttgtgtcacagcttctccctggaagataagagctttctatcatatttttcacttcatctaggccatctatcaccagcattgcccatgccccctgctgcccttctgatcctctgtaccttcctttggaagtaaagcagccttgagaagagtttttattaaagaggcattaatgatggaggacctttgcgtagcgaggaaacctttctgcctatgtaacagcatggtggtgcaggatatggaaggcatatttagagtcagtataaatattgatgcgtagtccctttgcaagagtgagagctcaagttaagacaatgagttcagcttgctgagaggtagtggagcggggaagatcagtagcctcaatgatagatgtggaagatactatagcatagcctgcctttgctggtgagtggcgattaggcctggtggaactgccatcagtaaaccaagtgtgatcagggtgaggaacaggaaagaaggaaacatgggcaaatggagtgaatatcgggtggatcaaagagagacagtcatgggggtcaggtgtggtatccagaataatgtgggaggccggatggaagtctgggccaggaacaatggtaattgtgggatactcaacaaagagtgagtatagctgaaggagccagggagcagaaagtatatgcatcaggtgtaaggaagaaaatagattttagaagttatgagagctgtagagagtgagttgagcatagtttgtgattttgagggcctctaaaagtattagggcagcggcagccgctgcacagaggcatgatggctaggctaaaacagtaaggtcaagtcatttggataaaaaggctacagggcgcggtcctggcttatgtaagaactccgactgcacggccctgcactttggctgtgtgtaatgaaaagggttgggatgagttagggagagctagtgtgggggcagcttctagggctgtctttaaggaacagaaaggagcggcgaaaggatttaggatctgtggggtcagctaggtttgcttttgtgagtttatataatggtttagtcaggatggtaaaactaggtatccaaaggtggaagtacctaaccatgcctaggaaggaaaggagttgttgttttgtagaagggattggggtttaggagatttgccagacacgatcagcagaacacgtgtgttttcatgaagaattatgttgagataggtaatggataaggaagaaatttgggcctgactgaagtaatgggggctgtccgtgaagccttgtggcagtacagcccaggtaatttgctgagcctgatgggtgtcagggtcagtccaagtgaaagtgaagtgaggctgggatgaagggtgcaaaggaatagtaaagaaagcatgtttgagatccactacagaataatgggttatggaggggttgtggagggaggtattgaggttaggagagtatatgcctttggcaccacggggtggataagcaagacaatttggttgataaggcgcagatcctgaactaacctgtaaggcttgtctggtttttggataggtaaaatgggggaattgtaaggagagtttataggttttaaaaggccatgctgtaacaggtgagtgataacaggctttaatccttttaaagtgtgctgcgggatgggatattggcattgagtggggtaaaggtgattaggttttaatgggagggtaaggggtgcatgatcagtcgccaaggagggagtagaggcatcctatacctgtggtttaaggtgaggagatacaaggagaggatatgaaggagactttgaactgggaaaaaaggcagcaatgaggtgtggctgtagcccaggaacagtcagggaagcagataatttagttaaaatgccttgacctaacaagggaactgggcaggtggggataactaaaaaggagtgcttaaaagagtattgtccaagttgtcacgagagttggggagttttaaggggtctagaagcctggctgtcaatacccacaacagttatggagacaagggaagctggcctttgaaaagaaggtaatgtggagtgggtagcctccgtattgattaagaaggggacggacttaccctccactgtaagagttacctaaagcgtctgtgatggtccaggaggcttccgaggcgactgggcagcgtcagtcttcagccgctaagctgagaagatctgggaaggagtcagtcagagagccttgggccagagttccaggggatctgggagtggctgccaggtgagttggacagtccgatttccagtggggtcccgcacagatgggacatggcttaggaggaatcccgggctgcaggcattggttggcccaagtggccagatttccgacacttgaagcaagatcctgggggaggcggtcctggaggaacacctggccgctggggttcaggcattgtgaagttcttgtgtgctggagatgtggctggggtttctctcacagtggaggcaagtaattgcaactcagaaatacgttgcctctactctattattgtacaccttgaaggcaaggttaattgagtccttttgtggggtttgaggaccggaatctaatttttgaagatttttctaatgtcaggagctgactgggtggtaaaatgcttattaggaataaggtggccttctggcctctctgggtctagggtggtaaagcgtctaagggttgctgctaagccggccatgaactgggctgggttctttacctcgggtagtttctttaagtttgtcataattaacagctttgtaagctgcctttttaagcccttcaacttggcaggaaaccatgtagtctcgcctagctatatctggggaatcggccggatagttccattggggatcgcctcagggaactgctctaatgccttcctggaggtgtggttcatgaagccagcagttatcagcatgcgattgggctagagaaaaaactttcccattcatctggggagagggtagaagttaggatgacatttaggtcactccagattaaattgtaggacagagctcgatgtcggaattcctgtatatatttagtggggtctgatgagaaagagcctaaacgctggctgattcgggaaaggtctgatagagaaaaaggcacatgtaccctgactatgccttcagctccagccacctctctaagaggaaatttttgggcaggtgggggagagctagtcctaggacgaaactgtaaaccggaccgggtgtggggaggggaggtaatagaagggttatagggttggggagcaaaggctgaagaagagttggagcctgattcagcctggcggggagcgacctgaggaggagcagtctggggaggaggtgagaggtcagatggttcagtagaaaaggaagattcagaagactcagcaacgcttggggttgggactgaagggacaggccagagggaaagaaggaggatttgggacgagttgcattgggaacacagactagggagggaacaaagtgtgaaaaatgcctggatgtaaggcacctcagaccatttgcccattttttcaacaaaaattatctaggtctcgtaggatggagaaatcaaaagtgccgttttctggccatttagaaccattgtcgagtttgtattggtgcaaagcggtgttgcagaagaaaatgagatgcctagattttaggtcaggtgagagttgaagaggttttaagttcttgagaacacaggctaaggcagaagaaggaggaatggagggtggaaggttgcccatagtaaaggaggcaagtttaaagagaagagtagagtcatggagaagggggatggggagcagctctgggctgcaatgtgggtgagcagccaaagcaggcatccctgcaattgacttgccaccaagggaacacgggtgaatgatcaaggcaggcgtccctgtggagatcagacaccaatggaacatgggtgaataatcagagaggcatccccacgataattaaacaccaagggaaggctgctgacccgggtcttcggcaccaaatgtttcacgtgtccatgtgaagagatcaccaaacaggctttgtgtgagcaacgaggctgtttatttcacctaggtgcaggtgggctgagtccgaaaaaggagtctgcaaagggtggtggattatcattagttcttataggttttaggataggcggtggagttaagagcaatgttttgagggaagggggtggatctcacaaagtacgttctcaaggatggggagaattacaaagaaccttcttaaaggtgggggagattacaaagtacattgatcagttaaggtggggcagaaacaaatcacaatggtggaatgtcgtcagttaaggctattttcacttttgtagatcttcagttgcttcaggccatctggatgtatacgtgcaggtcactggggatatgatggcttagcttgggctcagaggcctgacagcctgaccatcttgggcacatgttctcaggatctcctgagggctgtatcacaggccattggtcactcatatttggctcagaataaatatcttcaaatattttacaaattttgacactttttgtcatatttatatgacacattttatttatccattctttagttgatggactttgggctctttccacattttgccaacattgtgaataatgttgctatgaacattggtatacagattttgtgtgtacatatgttttcatttttcgtaggtatatacctaggagtggaattgctaattaatatgatgactctatgtttaacatttgaggaactgccaaatttccactgcagctgcaccactttacattcctaccagcaatgcagaagggttccaatttgttcacatccgctgtaatacttttctttctttttcctttccccccttccctcccttccttccttccttcctctctctctccctcactccctgcctccttcctttcttcctctccctctctccttccctccttccttcttttctccttccttccttccttccctccccctctccctcctttctctctctccacccctccctacctccttccttccatcttccttcctttctttttttcttttttgataatagccatcctaatggatatgaagtagtattttcacttcaaatgaagtagttttgatttgcattgccctaatggctattgatgttgagcatcttttcttgtactttttagccattatatatcatttttagagaactgtctattcaagcctttgctcatttttaaattttttatgtttgagacaggatctcactctgtcgcccagggtggagtgtggtggcgcaatctcggctcactgcaagctctgcctcccaggctcaagtcattcttgtgcctcaacctcctgagtagctgggactacaggcatgtgccaccacacctggctaattttttgtatttttgtagagacggggtttcaccatgttgcccagtctggtcttaaattccggagctcaaacaatccacctgccttggcctcccaaagtgctgggattacaggtgtgagccattgtgcctggccagttttccctacttattaacatcttgcattagtgtggtacacttgtgataattgataacccaatatttatacattattattagctaagttccatagtttacattagggtttactctttggattgtatagttctatgaatttgacaaatgcataatgtcatgacaaatgtatgtcatgtatctgttatagcatcataccgaatcattttagtgcccctaaaatcccctgtgctccacctattaatctctccttctctatcccaagccccagtaacaactgatatttttattgtctccgtagttttaccttttccagactgtcatacagttggaatcatacagtatgcagccttttcacactggcccgtttcactatgtcttttcctggcttgataattttttattgatggaaaatattccattgtatagctgtatcacagtttgtttattcaccttttgagggacatcttggttgcctccagcttttggcaattatgaataaagcttttataaacattcatgtgcaggttttttgtgcagacataattttcagctcattcagctaaatacttaggagtgctattgctggatcatgtggtaagacaatatttagctttgtaaaaaactgtcaaactgtcttctacagtgactgtaccattgtgcattcccaccagcaattaatgagagttccagtggttccacattctcattagcatttggatttttgaattttaatcatttaatcattctaataggtgtgtagtggtgtctcactgttttaatttgcagttcgctaatgacatatgatgttgacatcttttcatgtttatttgccacctgtatatcttctttggtcaactcttttgcccatttttaaattgaggtattttctttttattgtcactgaaaagagtcaaactgtaaaacatttgaagagatttatcctgagccaaatacgagtgaccaatagctcccccatgacacagccctcaggagatcctgagaacatgtgttcaagatggtcgggccacaagttggttttataaattttagggagatataaggtatcaatgaatatatgtaagatgtacattcatttagtccagaaaggcgggataactggaagcagggaggggggagcggggcttccaggtcataggtagattcaaagattttctgattggaaattggtgaaaagagttaagttattgtccaaagacttaatagaaaagcaatctgtgaggaccaaggttttatcaggtggacaaagcttccaggtagcaggtttcagagaatagattgtaaatgtttcttatcagacttaaagagtctgttctatcagtaattccaaaagggaggagcatataatgaagtgtgtctggcttcccctttccatcaacgtctgaactagtttttcagattaactttggaatacccttgactgagaggaggggtctattcagatggttgaggggcttataattttatttttggtttacattcttaatgagttgcaaatgagttctttatttattctggatgccagccccttatcagatacatgatttgcaaatattttctcccattctgtgggttgtctttccactttcttgatggtataatttggagaacaaatgcttttattttgtgtagtcaaatggggttttatctcctagtcacttgcatttgtattgtttgtgccagaatgtgcagaggtagagatacaagtaagcaagaggaagagggcagtggtaaaagcaagaggagacccgactgtggagacaatgaagcaaagggaaggtgagacttgagtaatggatgcacctcttgctctgggagcatctgaccctttttccagagtggatcctgtttgctgtgaagcccaatttatatgtttgcttcactgccagaatcccgcccccatccctccccactgcaggcttgagaagtggcctcacagacacgcccttccctcttgacactttcattccaaatagctagcttttctgtactttctctgagaaaggtaatgtaaatgtaaaagaagtttttgaggctattctatagaagatgtcataattcaatgttcctcaaaggcagggactatatttattttttttaaacctctcggcacctaatgcaaaatctagcacacagactcccaagaaatgtttgcttaaagacggatagagggccacaggggcaggttttattagcagttgctgaagatgttggaatgcaaggtgtctcaggcagtctggactaggaaaaagttctgtgttgaaaacaagagaagcaacgaaataatttattattcccattaaataaagatgctgatggctctcgagatagatatgaggaccccaggactctggggagtgaaggaactaagccgctgccatatctgagctgagtacttagggggaggaggaagaggaggagaaaggcaagcaggaggaggcggagccttcttgtcagcatctgttagtggaggttgggaagcctctcctccttccccctccctctttgcctccacctggctcctccccatgttcgtccatcacccctcccccctttcccaaggacaatctgcaagaaagcagcggcggaggagagctaagactaaaaggcaagaggggccattgagtgaagagcaagggggagagctgggagtgaggtgggaaggtatgggccgggagcaggcggtagggagaactgaaaggagcagaaaggaaaagaagagatacggcatcctaagctggagccgagagggggatgggcagggcagtcgtgaaggatcctagccccttggccagtcccctccgcttgcaggctcagctgcattccccaggaatctgggatgggtgggtggggctcggacgggttgcccttggctgcctgaccctaccctggcactcacccaattcaaatcagtgctcctatgatgctgcttttctgttcctccctgccgcgtgcttatatacgcacgtgattttagagatatgttttaatatctgtctgtttttgtctacgtgcgtgtcattgtgggtctgtaagggatgcttatacatgagtctgcatgaatttctgtgtcctgtgcctctataactgtcttagagatttcaggagaagaatatgagcggtttttacaggtcagcactcttaaactcctcttgttatggcgaattttctccctcactgacgcttccaggggtggaagagctctgtgtgggattctgcccccgtcatgagctccaagagtgaatgagaagaaaaaacgggaggaaagggatcagcatacccagatgtcttgttttttcctttccacctttttgccttcctatttgccctagtcacttaatctttctttttggaaaacagcagaaatttggacatgaacattccagttaaataagagcgtctctagtcacgcgtgtctctatgttcctttcactgtttgtcactatatgatttctcaagtccaagttaaaagtgtgttttaaagtagaatatggaggtatatctgtatctaagccgattttacatttttcatatatttgtatttcatgtagttcatcagttcattaacgttttcaacaagtatttattggggtcctgtaatgtgcatagactttgcaagtctttagtgagctgtgggagagtttttaaaaatgatcatgatccctgccctggaggagttctcagtctagttaggaaaaatgactttagcagccatccagtccagtggttggcaaacttcgtctgtaaaagaccagatagtaaatattttaaactgcaggcttatgagtctctgtcacaatatccattctgctgttgtagcacaaaaacatccatgataatacgtgaatgaacgaaggtagtgcacatactgaaatttgaacttaacatttttcacatgtcatgaagtactttttgcaaccactaaaaaatataaaaacctttcacagcttactgccatacaaaaatgtgagaagggctggatttggcctacaggctgttgtatgctgacccctgatctagtccaaccctcttatcagtgcgtacgaaactattaaaatgccacataaagcaggccgagcatggtggtttatgcctgttatcccagcactttgggaggcaaggtgggcggatcacctgaagtcaggagttcaagaccagcttgaccgacatggtgaaaacccgtctcaattaaaaatacaaaaattagccgggtgtggtggtgcatgtctgtaatcccagctactcgggaggctgaggcaggagaatcacttgaacctgggaggcagtgatccagtttagacaacatgtggttagaggaagtccaaaagaaggtttccttgacctgtggtaatcagtgaaggtttaataagggtacaactatcactggtcttaaatgatggaatgggatgtgaatctgtggaaagggccagggtagccacctggacaagggatgcagtgtgcccaggcactaaagtgggaagagcaaagtaatgttcaggtgacaatggagcagagaatctataggaccaacagttgaagctatatgcaagggctaaattgtagaagcttcgaatgccaacccaacaagttgggaccttatttgttagtactgattatatgtagtacgttcattaatctctgtctgttaacacaatgcatgtttgtgaatgtatgtcttcatatatgtctcattgcattattttattatttgtgtggatttgggtgtttatgtgacttatgtctctataggcagctaccctgagttctccaaatgcagggtagaagcaagcacaagctgcccgtaaaacttgggttcctgtgaatgaatacacatctccactgaagcctagggacctatgaccttcctatgaaggtttattttgtgtgtctaatagagtgaagaaaggaacacaagcacagggaaaccagctattgtagtaagcagttcaggtggaaaatggcaatgaggatagaaaggaggggatggataaaggaagataataagaagggagaataataggatttagttactgttttgaatctgagaggaagggaggagataaatttaaaataacaggttttagcctgaaaaactgggagagtgataattctactggcattttatggatacaaaaatacgtcctcttgtgtgttcctttgagagaggtgatccctaaagaataaaatatgaaggtgttcccatgtcgtatgtacacatctgtgtatatacggcagtgactttgtgttaattttctcatttcatagcatgtagtaatgtgaggggcaagacccaaagaccaaggatcaagagatgctcaggaggctgacatcctgagagggaagagccatagaaagcccctgaccattcttgagactgacaccattaatttgcctaactctgatgtgcctttatagcctcagactccagtttcaactccatatcacctaaccccattccaatagcacaattccataacacccaaccctaatcttaattataatccaacctacccttgctcttctacttctactttgctgattgtcatcagtgccctaaacctcatctgattccagccctctgcaataacctatcccttcattgaaaagggagggatcgttgaggctaactcaactttttctcctccctttctcatttctattcagtcaacttctcttttccctgaccttagtttattccccaaataggttccaattggggtgggagggatcagggaggaattaggaccttagtagtcttgggcttgattacatgacatttcagcttgtcagtctacaagggtgtggctttcctctggaagaagtccaaagctctcaggctgcaaagctcagacttggtatagtgggagagcctgactgaggtggctctagccagtctaattgccgttcctttagctagtggcatcttgattcctgctgtgtcttaactgaccattgtcttaaattctagagtggatcatgacccatgaagagcaccatgcagccaaaaccctggggattggcaaagccattgctgtcttaacctctggtggagatgcccaaggtaaggaggaggggacaaaaaacatggctggtgggacttttggaatttactgactcccttagcctatacaatagaattattcttctgtaggttcacgggaattttgggctttgctaaaaatttctgtgaggcctaagtcctcaagtgcatttgaattttatttgccatgcgtttatttacccacatcttcataaaacttatttccaagtttctttgaagacagggggctcttttggtctttgggaacctaaaagagtggtgttttctcaagcagcattggaaagaaactaaagagataaagttattgagaaggcagtaagtggattaacttcatgtactttggtaatggtggggatgggaggagacccagaattagtatatggtgggtcccaactaggtcttcaggtattaactctgatgtctggagagttcctgcactgaccaaggtcagtcaggcactcggttttctctggcctttcctcctcttccctttcatcaccccttgaacaaataggaacagcagcagttaatcaatacagatccggtatgaggtggaggggcagaaaacagagccagcaaaaacccttttctaggttgaatttaagaaacctgggagtcacgaaaattaggtatataggaaacacggagtgggagtaagagggtattgatttttttaaaaaaaactttttctcctttgatcttctgatatattctgatacattgaaaagaggtagaatttctttgaaaaggatacatgacatggagacaattagaaagagagaaggaaagcgatttcagctaggctcccctcctctgcaccactgttcctaggcttttttagactttgcgctaaggacccactttgtatagagccctgtcttgtatgttttgaagaagttgaattcctttaggaatttatagtttaatgaggaaactagaattcttacataaggcacataaataaaaataagcaagtgtgcattaaccaagtggaatctacttacataatgaaatgatagcctctgattgaattaatcagtgaaaacttcatggagaaggtagatttcaagacactgaactctttatttaagtaaggtgcttagaacagtagcaggcacatcgtaaatactcaatacatgtgatcattaattaaaaatgaattagtgagtatctactgtgtcaatcaggatgatgatgaggttcaccagtgatacatcagtgaaaaagtctgacgcaatctttgttcttatgatacttattagtatattagtaaagctagactttttaaactaatatttattataattgtgatataggttatgaatcagaaagtgctagaatgaagaaactgaggaaggagggtacggaggtctgagtttaggaatagtgaccagattaggaatgcagagccctagttgagtttgcagaaaccacagatctggcttttattgcatctgtcttctctgctggcagagtaccatgccaatactgaattctttaacatgtacttgagcattgatcctgaaaccttggtagaatgatctgtggacccagattgtcagattaggggaagaaagaagaaagcctgctaaacaaaccaagtgagatgcacagagttataaaatgaagaagagctttttagagagggaaagagagaaagaaaggtcagactaggatttaacttgggtctcagagcagcagagcccttccaccttctgatcctgagcagtgagaccctcttattctagtgaagaccataactcactgctgtaagaaaaagaccctgttttatggaggcagggactatagataagctgatttctgaaggacccagctgataggcacagtgtagccagggaaatagcccacctgcaaatccccataacatcacagccacatgtcactagggattgagagtgatagaaactgaaattctatggaggcaaggaggcaaaacagaaaactcaaaatagagctgagaggtcctagctgaaggagaagctcaaattcagaagtcgcctgcccagagctgagtttgatggactctagttctcccggggagaaaacatagaaatgttttgttttgttttttttcccttagggcttgtgggccacatgggaaagtgagattgagctgtgtaaaatccatagaggtcacagctttgtcattctccaaattcagcaaagctaatcatctcttgaggtagaaaaatggccaggaatcagacatcctgagctcaaaaacaaagaactctgggatgctgggctgatgccgtaccaaatcctaattccctttccagcctaggaatggcttcagccgccaaaactatgctacctttagccttatgacatcggcatattctacccctggaaaggacctcagtcagtcatctgctctggccctctgtctccagatagccagccattacaaatgtatgtttatctttttgatttttttttttaagagatgggacgggatcggccaggtgcagtggctcacacctgtaatcccaggactttgggaggccgaggcgggcagatcacccgaggttgggagttcgagaccagcctgaccaacatggagaaaccccgtctctactaaaaatacaaaattagctgggcgtggtggtgcatgcctgtaatcccagccacttgggaggctgaggcaggagaatcgcttgaacccgggaggcagaggttgcggtgagtcgagatcacaccattgcactccagcctgggcaacaagagtgaaactctgtctcaaaaaaaaaaaaaaaaaaagatgggaagggatctttttatgttgcccaggctggtcttgaactcctggctcaagcaatcctcttgcctcagcctctcaagtagctgagaccacaggccatgtgccaccacacctggccttttctatttttaaaggttcgcacgaacagagatccttttacctctctggcttgctattctaaggtttataatttttacttatgatatccattaggaagtgcaattcatctctaacaaatgtttattcctcatatatttttaaaaatcttatgaaagttaaggcagaaataaattatttagtatcagctttaaagtcatgctcaagtcatttattagattttttttctgtctagtctcatagagacccattacccacagttcttctttctaaaacctcttcccaatatgccgtaattggagactccaaactacgtgcttatgatgttctccagaacccctcctgactacacccagaatacctactggatggtgcctgtaatcttatccttcgtcttgcttctaataagtcagacaactgccatggagggttatttagggcaacatggaacagccaaggagactctggccaggactggcttggggccagactaagctagtcaggttggctaggagagctcaaagaattaccggggctccttaatataaactatttgtataccccaaagtttgtgatttttagggaactaggggtttgaggcataggtaccaggtacatgaagagcatcctaaagtttggtttctaggaaaacactcagatattcaagttggagacaggatgaatgacttctggaagttggtagagttgaggtaagaagaaggcagagggagaagagaatttccttattgtgagattttttttgtatgcccaacagatttggatagtccctgcccaccatctgttgtttgcttttgtactgaaaacgttcggagtcacttgtctctcttaaccctgggtataccaacaggattgcattaagttagagtttttacaggaccatttactcagcttgggaacaggaaacaatgttccaacctatacatttcagaacaattttttcccttatttcctgaaattacaaattcatactccagaactccaggtatccagaagagaatcccataggccttgtgaaagactggaaaacaaactttagtttcatatctattctgatcttattgagctaactttattcatctttcctaaagcattgaaggctttgtgttgacttttgaccttgttcctttcacacacataggctattcctcaagctactgagaagcccctctcttcacagattttttggttttgatgccttcaacttaaggttgtgaacttaggcttctagacttcatggggctttgccttagtgatgtcataagtaagctttgacatcagtgctcaccaatggcttcttgttgacaagcccaaactttcaggccttaccttagatcagttatcagaagcatttggcactgttccaacttcttgaaactgtccacttttggcttctaagacattgctaaatcctggttcttttgtatttcttgctgccccttattagtttttatcatggaaccccccttccccttcctgttccttcaatgttggttttcctcagggttgcattccttgcccctttcccttataattctgcatattctcttgagatagtctcttctgtgttcacatggatactccacaagaacttcaaacagcatatccaaatatgaatgtatcacccccactgccacctgcccaaaccaaaacctgcctctgctgagtcagtggaccacgcttttaccctttgtctaaatcaatcacgggacattttctccttctctgacccttgaaatgtaatcacattgccaactggatataagtcctgttgcttctgtttcctagatgtcttctgtccagtattttgttttgtcccaaatgctactcttccagttcaggccttccacatttcttttctaggatgccaggtagcctcctaaccctagaaatccctctctcaagctgtctttcacactgctgccagagttatctttctgagatacagatcgcatcatgtccctctgctctctaaattcttcagggattctttgttgtatgcaacttttctttttggaggggccacagacccctttaagaatcaaatgaaagctgtggaccttctcccgaaagaaatgtccatgcctgcagaacttttcatacagttttgtggggttcctggattccctgaaacccatcacccatggatccctgattaaaccctggcctgtagaagacaagtcaaacttctcatggcacataggtgcctgcccacctgtagagcttcatctctcaccatttcctagtttatattttattctttataatactaaattacttaaggttattttttgaccctcacctttatttgtgctattccctctgccaagaatactctccctcaaattatccacctgacagaaaaattttaaaggaaattgtcctttaggtcccatgacaaatgctgtcttttctgtataaccttctctgacttccttctggcaggcttagatactctttgtccctgtttcgactgtactttgtctctctctctctctctctctttttttcgagagatggggtctcactgtgttgcccagactacacttaactcctgggctcaagtgatcctcctgtctcagcctcccaagtagctgggactatagggatgcaccattgtacttggctcatgtcttttatagggaccaatagaccatattgtaattctccacatgtcttgaagaccattaccaagtcctttatcttggtattcccagactctgtggtggtcattgctgtacccccagtgcctagcatagtgcctgaaacatgataggtgttcagttagtatttgttcagtgaacaaatggaccttcaattcaatttggagctaatagccatgtaataccaacctgcaaaaaaaagaaacattttgattttttttattccattctattcctgatagccttggattattcaaaagtttgtgatggttttttagtttggtgctgcagatttttccgattactagctctcttagtgcttgttggtatattacatttctccaggcagggttaaggacaacatgaacagattttagattaaaacaaaaatatgtactagaatgtctaagagagactggctaaaatggtttacaagaagttgacccttcatggctcttaagattccctgtgcatcaccatgtgctccttgtcacattacatggtaggaaaggaatgtctcccatctctcaccaataaggccatgcttagcagaggatcagtgcattgttcctaatatgaaacacacatatgggacacctgctgtgtgttttatgttgggacgggttggctttttcacagtgctcctggaagagagttcttttcactgagcagctactaggagagggataatatcatctgtgaaaaagggaaaaggattgcctctctattttagtcctaagtttttgttctgttttgttttaattttctttctttttttttttttttttttttttttttttttttacagatggagtcttgctatgttgcccaggctggtctcaaactcctaggctcaagcagtcttcccagcttgacctcccaaagtactgagattacaggcatgagctaccgtgtccagccctagttctaagtttttcttccagtagaagcagagagagaatgatttacagtatactttttgagttccccataaacatcttatatacagggccacaggaagagactagcaaatatttgttgactaattgaggaaatgccaggagaacgcagtgagagaatagagtccccaccaattcttcctgcacacttggtcacagcctcttctggcagtgtgataactagtaaatcacaactgtgtggcacacattggaacatagaccaactcaagtgacacaaaaaaggggggtgtgtgtgtgtagactgagagaatcagctgtctggtaacagatatactgtgaacttgtgaataaactgtgacttgccaggttactgaaccatatagagtcatgtctttgtcctgaaatgccaactaaaagctgatgtctcgattcagtgcagaaagcaaggaaaaacctagtacagccattgacattagtaggacaagccatagaggctaataatgttaacttaggcatctgagaacttgaattctaatctgaactttctaaaagtactagctttgtgccccttgacctttttgagtttcagtttccaaatctttaaaatggagacaattccaggattgttaacagcattaaataagatgatgtttgacaagctcttggcagtgtctagcccacaatacacattcaagaaaatgtgttattcttgttgttattgtttcccagatggtcctatcaaggaaaggtcttgggaaaggcaggattttgggggggcttgaggagcaatgaatgcagattatctgaagctccagtaacattgactgcagtaattgggagtggggaggccagaagactttgatgagaggattattctagattcagagaaaagactaaataaagtactgattcgttatctttagccaaatgtaatatctctggattccagggcgccttttcttaggagcaacctctccgtgacttcttttgtccctcctttcaggtatgaatgctgctgtcagggctgtggttcgagttggtatcttcaccggtgcccgtgtcttctttgtccatgaggttggttctgtactttgttcttcatcattctttctctgtcttcttctaaatctgccttctatccccttcccacattctgtgtccttacctcccagttagttacattgctgtgtttgattttccttgactccgtagcttcatgagtcactctttcctacttgactccaatagtgatggtgggacctgagcatctacaaactgggtcttcatgttgcctgttcaatttaaaggaaaaagtaactctcagtcctccttttatctccctcaaaacagagaaagaaatggaaatgggtagtatttacagcaaatttagtatatccagaggaagagccccaggagaaaagagacttgctgcatttctgtagtttgcataactttctgaggttctcaaatcttcttttgcacccttctcccagtaccctctcatgcttcacccactcttctttttataaggtccacctgctttcttgtatcagattttataatcttttagagcaagtcgcgtttctttccttccctcccaccaacttccccttctccttttctccatggttatcaagaccatctgttatcattggccccctaggaagcaggttggaggagataggatgagccaaaaataagaattaagattaactattaggaaggatatccacatcccagtatttcaaaaatgggagaaagtagaagagagtattgcaaaagttgatgcctccttctttggactgtgttaaatatgatagtctcacgagcatccaggactcactaatgggaggaggtggcttgactctcagagaatctcttcccagggatcctgtcttaatcttgggaatttatagagaagcctaacgggctgaacaggtataatgtgtcacacagggttatcaaggcctggtggatggtggagatcacatcaaggaagccacctgggagagcgtttcgatgatgcttcagctggtatgttccagagaactccctgtcccatatttgctctgtccttgtttcatcccactctgttttgggctcatggtctcctaaattccctgtcatgtggtttcatgggaaggaattcagtgacaagagagggaccctatttgccctttactcttagcatttgaaaataccaccctggtttcctggggcagggagagggtggaggagtgatcacaggatgctttgctctttatggaaaggtcataaacaagactatggggactgacacataagcagatcttactctagggtcacagggaaggtctggccctgaaaataaccttaccagaggactggagccagagccagaagtggagctgaaatctgccagtcctcatgtgatggagatgaggtgacctgaaaccagaccacttaaaggacgaaggaactgagacagcctttcggagtctcaaaaaaatcctaagagtatcctgaggatttccacagtcctttatgctacttgctccatgttgttttaggcttctcatgtgtatccactgtgggctagcccacagtgagtgagagaaatacaatcatttgctggtttactgaaaatttgtaaattacatttgtatcccccttttttcagctcagttccctaaaaatccatgggcaaaaatttaatatgcagtgtctagtgaaggctctacctaggtgctaagtaatggtgcctgccataaagtggtctgagaatgagccagaattctccaccagtatcccaaagtcatggctgcccaggagtacatatgatatgaaaacctaagtatacttacctctctcaggtaagtatactttctctcagggatagaaagccttaatttcccagggacttatagatacctctcttggggtatctataaggctttctttacctagagctatttttcctgtgaatacctggatattgcagcttctgctgctagcaccatggattgcaaggagctaaggggaaaggattggcagtacctgggtacagttagaaatctcagtgcagagagaggaaaaatactacaaaacacattgggatgaactcctaataataatttggacacaatccagtaatgtcaggccattagggagaatttctaaagactgaagtcactgcttctaagatgtgaaagttggagattatttgagaagccaacatacatgtatgtattcacttgttctctttaggatagtcatggatgacaaagccttcaatgaaaggagttcttagcagtcttctcagatgtgtagcaaaatatgggaatgaccctatgatgcctcagccagcatcatttccctttcctttggaagggacagatcactcttaaggatgtcaaggaactttctagggagtcacacagttatgttaggccatcacagcattggaataggggatatctcagcatgttgagccctgtctctggggagctgacttctacctcttccaaagggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagagagttttcacatcagtattgcttatttgtgtcggtacgtgcacgcgtgtacacacacacatcgcccccgccctgcttttacctcccattggagaaaaatgttacccagacacaaataggcagtctttgccctcctttttctggtattgtctacaattccttttggctagagtttctctctctctagatatctcctctttaggcatgccaggtgcctcacccagtggctcctggtttgcttctcattgtcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagaggtaaggggacttgggaggtaggcagtgtaagaagatggcagctaggacaggctaaagggctagaagctcctgaagactaaagcgtttgagctatggtgactataatggccagttttctggggctagaacactatttttaacgaaaaattatctagagcactgaaattgcactgttcccttaatgatatatgatttgtcttttgccactgtctggcccactgtccaaatatgcagctctgaggtctttcatatcattggggtaaatggttattcttcagactgggcaaatctagggagcccagacatgagctacgctttccaaccatatcatagaaagtataggtgctgctatgaccacgacagctcagagataaggggacctggggggaggcaatgtaggatgggaggatagaagggtaacagtttaccccagggtaatcctaaaggattccagttagtccaattctcccttcacttcttatcctttcctttccttcccttccctgacccggttcctccctggaacagagcctctgtttagacactttttactgctgtgttttctcaggcctaggaaggataccttgtggctaaagtatttcccctaggtcttcctggtctcaggaagcctgctagaaggcctggcagcatacatgtatctcccagagagggtaattggcctagatgtgggtggtggcttgatcttggccatagggtcacttggactgtgtcatatgtctatctcttgcagccaccagaggacatttgtgttagaagtaatgggccgccactgtgggtaagatcctcattctgacccatttattccgtggacctagcgatagccctttccttttccccagagagtccagtgaggtctctcagtagcagcagatctggaggtgcacatgctccttgtggtgtggttccctttccggcctccatcccctctgttacatccccacacatgcatgtgtgtacgtgctcaggcacgtgcttggtgtaaagagtgggtagtgctctgaggctggaagccactgtggcaggtgaacataaatggaaggtatccgttagagacagaatctcattgaggggccccggtgctcttacccttgccccacgaataaaatggaggctctccagaccttttatcaactatgaggactaggagaacttgttgggtatgggtgaggctatttgtagagtacaacttctagcaggatgcttctgactctcatctcagatacctggcccttgtcacctctctgtcctgtggggccgactgggtttttattcctgaatgtccaccagatgacgactgggaggaacacctttgtcgccgactcagcgaggtacttgcactttattttgcccttaagaaatccctcaccctgttccactgatgatctctttcccacccatcagcttcattccatggaccattttaccctttgttctcaaccagacaaggacccgtggttctcgtctcaacatcatcattgtggctgagggtgcaattgacaagaatggaaaaccaatcacctcagaagacatcaagaatgttcgtatgaatgaagccagagaggccttagaatccatagcccattcccttctggcttctgagtctcctgacattgcttctccccttggtccttctgcacatctctccctggttccctgcccctgattgcctcccacaaagaaccattacaagacaagaggctgagctgtccatggtttacccaagtctctgcttgttttcttcctttgactctgcgtaaccctctctctgtccctctgttggtcccttcagctggtggttaagcgtctgggatatgacacccgggttactgtcttggggcatgtgcagaggggtgggacgccatcagcctttgacagaattctggtaagtcactgggctgtgtggccctcatgccttgaaaccctcaaccttgtagtcctgccccctcagggctgcacttcaccagacagggacttacatcactggtcgcattgcctctccaccagcctttgggctgcagtggccactgacccattcccatacacttgagggttctcttctgttacaaaaatggtgagagactacgccttcctaatggtgaggaacaatatctttttgttttgttttgtttcatatatttttaatacgaattttgagataattgtagattcacatgcagttgtacagaataatacagaggtagtcccacataccctttgcccagtttctttcaatggtaacatcttgcttaactatagtacaatatcatcaccaggatattgacattgatatagtcaagctacagaacatttctgttaccacaggatatctcatgttgtccttttatagccacgtgtactttacccccacccatccctcctcattattattattattattattttttgagacgcaccattgcactcgctcccaggctggagtgcaatggtgcgaccttggctcactgcacgctctgcctcccgggttcacaccattctcctgcctcagcctcccaagtagctgggactacaggcgcctggaccacgcccggctaatattttgtatttttagtagagacagggtttcaccgtgttagccaggatggtcttgatctcctgaccttgtgatccacccgcctcggcctcccaaaatgccgggattacaggcgtgagccactgcgcctggccctccctcctcattcttaacctctggcaaccactaatctgtctctttgtctgtaatttttaatcttatgtatattatataaatggaattgcataatatgcaaccctttaggattggcttttttttccactcagcataattctctagatgtttatcaaaggtgttgtttgtttctatagtttgctgttttttgcagagcagtactccatggagtggacgtattacagcttgtttaatcattcaaacatttgagttttcaatttttggctattagggataaagcgactatgaacatttgtgtacagctttttgtgtgaacttaaattttcatttctgcagagtaattgcccaggagttcaattgggttgtatggtagttttttgtttcttaaaaaaattttttttcaaagatactgcccaactgtttccagaatagctgtaccattccatcagcaatttatgaaccacctgttttgtttgcatccttaccagcatttgggggtcgtcactttttttttttttttttttttttttactattctgataggtatatagtggtatttcttttttctttctttctttttttttgagatggagtctctctctgttgcccaggctggagtgcagtggcatggtctcagctcactgcaacctctgccccctgggttcaagggattctccggcctcagcctcctgagtagctgggattgcaggtgcctgccaccatgcccagctaattttttaaatttttagtagagatggggctttcaccatgttggccaggcaggtcttgaactcctgaccttgtgatctgcctgcctcggcctcccaaaacattgggattactggcgtaagctactgggcccagcctttttttttttcttttttttttttaagagatggagtcttgctctatcacccaggctagagtgcagtggtgcaatctcggctcactgcagtctccatctcctgggttcaagggattcttctacctcagcctcctgagtagctaggattacaggcacatgccaccgtgcctggctaactttttgtatttttagtagagacggggttccaccatgctagccaggctggtcttgaactcctgacctcaggtgatccgcctgccttggcctccaaaaatgctggaattacaggcatgtaattccaaccttagacactcagtttaaaccctcttatcctatcttcactggaagagcaaagcaatctcctaccttgttttgtcaataagaagggaatattattaagccccagtaatcctgttgattaccatagtgggcatgtttctctagaagtaagtagaatctttggggttccgatggcaagaatacagagtcatcaagctttagatgaaatctgtttggggaggtaaagcccagtaagttctttgctgcagttcttaattgtgagactcagtcttgtgatttggaaaagggctcgagtatcctgactctctaggctgagccaagatggggcagcctgagccagactgtctttgttctctgggctcctgcagggcagcaggatgggtgtggaagcagtgatggcacttttggaggggaccccagataccccagcctgtgtagtgagcctctctggtaaccaggctgtgcgcctgcccctcatggaatgtgtccaggtggtaagtactgatcctaaacccctttcttaacactctcaagcccctgccttggagctcaaggggcatgagactatgtctaaggccactggtataggagcaggtggaaaggcaagatggtatagtaagagacatgtggggaaagaacacagtgggctttgcataggagctcttaactaagcttcagtgttcccatctgtaaaatgttcctaaggaaggtgggagattctacatcctccttagtaatgaaacccagtatctcataatatacaacctcaaacctttttatcttgtctttattggaagaataatgctatattcctcctaactttattaagaacaggagaatattattaaattctagctgggtagcttttgtctctatgatttctatcttgaacatgtttctctgaaccaacacgaggttactaatgctaacgttgagggttattgtaaggattggagataagctatattagcatgtgatacagtacctagcaaatgttgagtgctcaggaaatggtggcctttattatgaaggaatcactcctttgataccacagagcgaacgtggcggctgagagcgagaactaggctgtgtggcctggttctgagggctggtctaaatactccccatctcccggcctccttctctctgagactcaggagtcccagttacctgcagccttgcttggaaatgtatctgtaaaagctccaaagtgaaggcactgccccacagagctgaaatcagtagttgagaagcacacagcaggaatcagtccttcctaactgggttacctgtaggatcttcatttactcatgactttagaggctgctttaaggccggggacctgggtgtggaatggaagatactatttatctgtgagcattcttccactctgcccatacttctaataaacagagcatagtgccaggcacggtggctcacgcctataatcccagcactttgggaggccgaggcaggcagatcacaaggtcaggagattgagaccatcctggctaacatggtgaaaaataccaaaaaaattagccgggtgtggttgcacacgcctataatcccagctacttgggaggctgaggcagaagaattgcttgaacccgggaggcagggggttgcagtgagccaagatcacgccactgcactccagcctgggcgacagagcgagactccgtctcaaaaaaaaaataaaataaacagagcatagaatcagttcttttcttttgctgctcattacttagacaactcaggaaaaacaaaaatacttccatgaaagtttgggggcataggaaaggtggggtgtagaatggacaggatctagtcacaatcccagagatgggcagagttcgactgtgggatggagttccagctgtgcagaatcctgaccctggagttgaaactgtcgctgtgctcccccctcagaccaaagatgtgaccaaggccatggatgagaagaaatttgacgaagccctgaagctgagaggccggtgaggagatgacgggaagctcactagctacagaaatcagaggcgtgaacgaagccaaagatctccatggctccaggcccaaaacatgagcttctgctgcttccttttctgattctctctgcagcaagttcctgcccaagaaaattagttgtgaggtgactgggaggctcagttcatctcaggggtgtggtccctggcatcaaccttttataatctgttatttctatatgtgagccccagcaagatgataagttcctctaggcaagggacagtctcttgtgctgagcatagtgcctgaagaagagtactgagggagtgtttgatgaactagtggcccttttgcagcccctgccctgtccctgctctgccccagttctgtcctcagaggtttgccctatggaacttccctctgggagcaacacttcagaccaggatctccatggctgctggctgtggggaatggcctgaagacacctctctctatttgtacttcctacaggagcttcatgaacaactgggaggtgtacaagcttctagctcatgtcagacccccggtatctaaggtactggcaagttgacttgccctctccccttttccttctccctcccccagtctctcttcataaatgctaccacagtccatacaacataagccttgccaacttctctgccccactctgatcttcagtgctgggtccctggccctattataatgatttcctcttaaccaccccagataccagagcccccttcttagtgtaccctggatatctctaacacaagacccatgcccacttcaggactggcaagatagcatgcaaagaatgggaaagagggcttatgtactttttctctgggaaaatatgggaataatcacatctaagtgtatctaagccacttcttccactggagtagtggttctcaatattaagtatatatcagaattgtttgggttgcttattaaacatgcaaactcctgggcccctctctcagaggagattcatatctgggtagaggccaggaatatgcaggtttaacaggctcccccagtggattctgatgcaggtgatccaaggaacacacttgggaagtgctgctctggaaggtctctcattcattgtataataatgatatctgagatgggggacagcagctttatttattgatctgtgatcaagaattttgcttccatgtatgtggtagccagctgtgctggcattccttgggagaggggtgtgtgttgtgttgtcttaggcagatatcctgatccctggatgacaagggcttagagcccttgccctcctttactaacctcctccctgttcccctgctgggtttctgtcctcatttttccctgcttcctcctgtatagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcaggtatggggactattctgggacctaggagcagtcatggggaagataagtgtagcaagaatgacctgtccattctcttggcttcctctgttcctcactacctctctctcctctctcagggtccaggcagaagtagatatttaatactagggcagtaggaacagcaggaattactgcagtgaaccattgcaaacaacatgtcttatttaattctctgtcccaaagctcagcacagtgcctggcataggtagatgcttaatatttgtgaatgagcagtaagggtagaagaagttgagtgcgtggggaaaagctaatacctggtgtaccttttccaaccaagggggatccaggggtagggttagaactcaagcagtggcaccagtcccacacaggcctcctagtgctttagccttgtgcagagctctgtggcttatccccacagatagaggaagctggctggagctatgttgggggctggactggccaaggtggctctaaacttgggactaaaaggtaagtagcactgcagaggcacctcctcccagtcacctcttaaagttgcccttggatgtgggttcattatgccatggtctgcttcaaccaccctgttgtctgggtcctccaccctcaacctcacagttgctgccatgagggcagacatgcccatctcaacatctttagcagctctggcaacttagagctccagtatgtatccttggataggactgagagggtgggctagggagggcggcacaggtcaagaaattaaaaataaagtgcctctaactctagcttttctccccctcaattttcctgtctcttccccaaattccaattccccttcccctccccgccatcactgatcaactaggactctacccaagaagagctttgaacagatcagtgccaatataactaagtttaacattcagggccttgtcatcattgggggctttgaggtgagtgcctgccaccatttcttcctctctccctcctacctcctctccctctccccaatcctgcccttgtgctctcttcttcttaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacagtgagagcctatcaccacttcccatcccttttggccaggattataatccttaaactgagtgtggtcccaaacagtgagctactctttatatcaagcaaatgggaatgtttgaaaatgattcttcagctgggcatggtggctcacacttctaatcccagcactttgggaggccaaggcaggcagatcacttggggtcaggagttcaagagcagcctggccaacatggtgaaaccccatctctactaaaaatacaaaaactagctgggtgtggtggtaggcgcctgtaatcccagctacttgggaggctgaggcaggaaaattgcttgaacctgggaggcggaggttgcagtgagcagagatcgtgccactttactccagcctgggtgacaaagtgttcagtttcctcacctagaaatgcaccagtaccctgaataccaaatgttttgtttgtttttttttttctttctgagatcatgcagtctaattttctgagcagtagaaaggataggtacagctttcttcccaggagagacgttctgcagtgaggttggcaaatatgcctgttaccctaaatgcaagaacttgatgagctctaagggccctgctagcctatggagaatatagttccagggtttaattaatggcaaagattaaagagtgataagaatcaggcccctgatcatgtctttctaactataacccattgtccttgcagacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggtagctggccacccagagcctgctagatagctctcccctgtctccagactgtttccacagtgatctgaactatgagagctcaagttgaggaccgagctgattggtctgtagaatcctgtgaagaccagaaagagcactatgcaggcattctctggtgtcacctcatatgcatgaccgcagctactgttgttggaatgctgattttgagtcaggcgacctggtgctaagccctttatgggcatttttgcattttatcttcacaatagacatgcaaagaagatactatctccatataacatagaaagtttagagaggttaaaaaacttttctaaactcctaagtgagcagatggtttaagtggttgagaaagtcagtgatctttttactacatcatgtctccccttcagatttcccttgctgtcattctgcttttgagagagatactctctcaaaacagagatataaagtgtcaacactgacactgtgaccacaagtcagccctctgaggcaaggggaaccagaaaggcttggaaagggagattggagagggtgaggggctgaacactgacagttactgcagctgtctgtagtgctccctcttccagttctgtctcatttggagtcattgtttaaatttcagtccacactgagcttcttacaggaattaggcacagttcaggcccaggattgtaaacaactctcttccatgtgtctcttccttcctggagaggtgtggtgtggaagatgatttatacccaaccttatccattcccagttaggcttaggatttactctttcattttcaggcaaatgttgaacatctggtgcaaaagatgaaaacaactgtgaaaaggggcttggtgttaaggtacctcatccatggtttgttcctaaatgaagaagaaaaataagctttggctcaaacccatagaatggccattgttgggacaccctgaggaatctgtagatataaagggagggggccagcctatcccttgaatccttggaggagataaaaattgaaaggaaagaacaaaggcagaaatgggggatgggaagccaaccacagagtcacaggcttttggtctccacctggcaggaatgaaaagtgcaatgagaactataccactgacttcattttcaacctgtactctgaggaggggaagggcatcttcgacagcaggaagaatgtgcttggtcacatgcagcaggtagggaagacaccgtagtcatgcccttcatcagacagccatacctgccaacagccatacctgccaacagccactgaggcttccactggccttttccagtcttctggaggagcctgtcagtgccatcatagagcatgggcctgcagtctcttacagtcatagaatcaaaacatctttatcctggaaatgactttagagattatatggtctatccttttcaaaagccctcatgggagggcttttcaaccttggcagctttgccttttggggctggatgataatttgtcatgggtggctgttctatgcactgtaggacagttgcacagcatccctggtctctacccactagatgccagtagcacctccctctcactcccaattgtaacaaaaatgtctccaaacattcccactttcccacctgcttcctcttaattcaaaggaaatctgtatgatgttttatattaattctgaggtgctaccaagggcagccagattgggccacaaaaaaaacacttttatgtcatcattgacagtgatcaacaaaagctgctgggctgaagaggggcaggcagctgacccattggccaataaaactaaaacaggatctggcagctgtggagctaaaagaggggattgtggggccaatcatctttaattagttgttattatatctgatacatggccaaatttgctgggccagcttgccttggatcctggcactgcctcagggcaccctttcatagtttgacttctggattcctgttttgggctgtaagcctggggcccatctttctttttttctctgtgtgtctagatatctctgccacttcattagagtccttccctctgtaatttttatgtttctttctccagggtgggagcccaaccccatttgataggaattttgccactaagatgggcgccaaggctatgaactggatgtctgggaaaatcaaagagagttaccgtaatggtaggtggggtgagagcgagtgccctctatagaggctggttccccagtatagaagctgactgcccatccctcattgcagggcggatctttgccaatactccagattcgggctgtgttctggggatgcgtaagagggctctggtcttccaaccagtggctgagctgaaggaccagacagattttgagtgagtacatctgcttcctggagtggttcttttccctggtagtttcaagctctactgtcctcaacctgttcactgtctttaattcttttttttttttaaggagtaacacctgtattcttacccatttcagatgtgatgcacatgtcctaaatctaacctcttctgtctaacttcttcctataaacctttggtagaagttgattggggtgctaaaagattatatcatcatctacctcattcctctgtaggcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtg

SEQ ID NO: 37468 - DNA, 5177 bp, Homo sapiens; identical to SEQ ID NO: 37093

SEQ ID NO: 37469 - DNA, 9024 bp, Homo sapiens
cgccccttcccagccccaagggtctaggatacagtctttgtagatgagcgggtcccccttggaggacagaatgaagaattgggaaatcatggccgttctggagagtagacaagaagacggcgaaagtcgggcctgccccgccctgcggccccggaacaaaagaacgcgtgtgcgctggccctttaagagcgattctcctccgcccgcgccagctcggaccgcgggaaacccggcgcctgcactaccccgcccggagattcccttccgacgcccgcaccgcctccccgtcactcattctaggcccgcacggtgattggcttgcggctagcgggaggtgaagaaggccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaagggtacgggtctacgagcccgggagggcgtcctgcgcggggagcctcccggggaacacctgttggtgtgagctggggtcttgggggaccggggtcggcgggttctggggtgcgcgaggccagaggcagggtcgagctgcggcctggctaaggcccacggggcctgggaagcgtgcggggggccatcgatgttgaagaaaagctagtaatcccacctggtaaaggtgttagggtcgtggggttgggggcttgggggcgcgctaacccggctgggggctgcacagggaaaagtcgcgcccaggacctcaggagagtcttaagggctctgggctcccgtgcccgctttccttcgcgcttttgggcattcccaggttcccgcgccctccccaggcgcgcgtaggccccgggggcgggcaggccggggccgctgcgcgccgggattggccgtttgaggccgccctccgagcggaagtggagccgggcggaagtggcgcgaggaggctggagggagtgtcgtgtaaacagtgtccttccgcgcggcggccgcggagagagctgcggcccgggggggcgtgcctgggatccggagcttcgctcgggcccgggaaaggcggcagtgggctgggatcgcggtgtctctgggtgtgatggccaatggctggactggctcccgccctgggcggaggaatcccgagctgtgaagcggctggaatccgggcccatgtgcttctttgtttactaagagcggaagcgatggcgggagcgggggtggggtgcggtggcggggtgcggtggcggaggtcccggtgaaatcaggggctaaggggacccaaagaaggcgggggatcataggggtggaaagaaagctgagaaccttgagaccggagtgtgaggggccaacggggaagggcgctagaattttaaactaaagtagggaccggaattcccctggggagatgttggatggccctgtgcactgccacgggctctttattcttcgctggttagaaacagacttgtgaaaaagagttatgcccactttggggagacttcggtaggtttatttaaatgctcatattattaattagttcataggtcgtgttttaagcgaaaatgggtatctaagatttgtcttaaagtttgtgtcttacggttttacatttcatgttacagaaaaggttaagaagttcttacaagagttctaccaggatgatgaactcgggaagaagcagttcaagtatgggaaccagttggtaagtctaagattgggtaaagggaatggggagcggggtgcttaaggagccataagcagcagcttggcttgttttattaaagacataacaattagagggtttgagggctgaaaagcgagtatcgctctgtgtggcgctgcgttctcccctgtggatgcccagagcctgtgctgagttctcagtgatgcattttcacatatgaacactggtgagcaaagtgaatgtggctctgaggtgtttctgtctcttccccacttgaggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtgagtggttagagaacaatggcaaacaaagggcgaggcgtttaagcttctgtagagaggctgctcagatactgatgttttctgagcaggcagaaaggaggggcacttctgcctggtgttctctgtgctctcctttccccatcctgttgctcttttttttttttttttttgttcttctcctttaggtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccggtacgtgtggagcaagaagcaggaaagcacttacccattagttgttttgtagagattaatttgatcctgtgatgcctattgttttatttggttgtaaaagttgcctgtgtgttcgcctttcattcttgggtatgtagtggtctttctacctattttctgggtgtttgttgttgacccagagtaagttcagagggttcttgacacttacaagatgtctgccatgaagagaaaatgtgattcaaaggaccgacccaatggggctcttttccttctgagttcctttggtgtttctgttctcacatcctagatccagtctcccactttcatgcctctgatcatgtgcccaagccaggagtgccaaaccaaccgctcaggagggcggctgtatctgcagacacggggctccagattcatcaaattccaggagatgaagatgcaagaacatgtgagtttggggtacgtggccctgggcaggtggatcgggagtccacttgaatcctgtagtcacttgtggaatggcaggaagaaagaagaacaaaagagggaagtgcaggagggaggtggaactagaatttcctgggagccttgggaaggggaaaggaggtctcagcacccctgctgtgggcttgtctgtggctgggtagcctgggagcctttgagtgggatgcctagggagggaaggttgggtccttgtccatttctcctagtcttatgtgcctttccctcccctagagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacaggtaaggaagagtttgacatgaggaatggatcatccccttttccctcacctactcattctacccacacagagaaaagagcagcaaaaccccaaacaaaacagaacccagggatttgtcaagaaattgttagggaatccagtgatgggcaagttgaagggattacatctgtatcctggcattttcctgcccaagggtttactctcagaaacctacctggaagcccatcggattgtgaagatgaacaagagtgaggatgatgagtctggggctggagagctcaccagggaggagctgaggcaaattgcaggtgaggggcaggggagagagaggaaattccgtttacatcctagctcccttttcccccagaaaataaaacaaccttaacttctctacagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggtaagaagaaacaagggagaggctcagggtggatgaagtcatttaggaggaaaaaaggatgacaagtgtccctgtaggtcacagtatgagtggacatcttgccttcgtggacacagggagggcttagaaatagtgctgggtgttaggggtaggcagaactcaaaattgctctgttgttggccaagcactgggagaagagtcattccagggctgccttcccttcctccaggcaacatcaacatctgtctgatgggggatcctggtgtggccaagtctcagctcctgtcatacattgatcgactggcgcctcgcagtaagtagttgggctttgcgggaggtgaatatagtgacagacaggaccacagtgtttattcaaaaagtaggggtgcatgtttgctcacgcctgtaatcccaatgctctgagaggctgaggcaggagaatcatttgaggcgaggattttgagaccgcttccatgtctactaaaaagttttgtttttgtttttgttttttttgagatagaggcttgctctttcgcccaggccggagtgcagtggcgctatctcggttcactgcaagctccacctcctggggtcacgccattctcctgcctcagcctcccgagtagctgggactacaggcgcccgccaccacgcctggctaattctttgtatttttaatagagacggggtttcaccgtgttagccagatggtctcgatatcctgacctcgtgatccgcccgcctcggcctcccaaagtgctgggattacaggcgtgagccaccgcacccggcctaaaaagttttttttgttgtttgggtattgttttgttttttgttttttttgagacggagtctcagtcacccagactggagtgcaatggcatggtcttggctcactgcaacctctgcctcccaggttcaagcaattctcctgcttcggcctcccgagtagctgggactacaggcgcgtgccaccacacttggccactttttgtatttttagtagagacagggtttactgtgttgggcaggctggtctcgaactcctgacctcgtgatctgcccgccttgttatcggcctccgaaagtgctgggattagaggagttagccactgcgcccggcctctactaaaaagttttaaaaattggttgggtgtggtagtgagtgcctatagtctcagttacttgggaggctgaggccggaggatggcttgagcccaggagccaaggtttcagtgagccacagttgtgttctgaagagaaccagtgggaggggaagggggacattgccagtgccccacagatcctcgggcatctcaagaaggcctggtggagggagtggaatgatcccagcgcaggcctcgcctccctggcccgtttgttgtcttttgcttgttctctttcttgttctttctctctcatggttccttatttcttctcttccaggccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggtgaatgaagctcaacacccaaagagaggtcccctgtaatgatctgtgtagggaggaggagaggtgaatcagaaaacaaattccacgctcctggaaaccccagagcctcccctttgcagcaggggctggtccatggttctcagggaaatggtgggttggggctgaaatgctgatgaggatttcccgggaaagcttgtccctcctacactgtgaggaagtggcagagccaaaggagggacacctaagaggacatgggtgcgtagccctaaaaagggtgttccttctaaccttccctctgtccaggttggcccagcacatcacctatgtgcaccagcacagccggcagcccccctcccagtttgaacctctggacatgaagctcatgaggtaggagagctgggtgcgggtgggcaaacgttggcgtgggccgtgcgagcctcctgaaaaagtgcttattagtcttagggtgtgtgtttttcacaccaccacttcccgctacagacatgtccagagcctcagatcagcttttaagtggaaaattccacacttcatatcatagggacacaggaaattttgtttcctacactatttattttttttgagacgaagtcttgctctgtcacccaggctggagtgtagtgatctcagctctctgcaacctctgcctcccagattcaagcgattctcctgcctcagcctcctgagtagctgggattacaggcgcacgccaccacgcctggttaattttttgtattttagtagagagcagtttcaccatgttggccaggatgcccacctctgcctcccaaagtgctgggattacaggcatgaaccactgctcctggcccacaaaaatatttttaataaaattaccttcaggttatgtgtatcagttgtatatgaaatacaggtgaatttcatgtttagactggagtcccatccccaagctatctcatgcatatgcaaatactccaaaatttaaagtttaaaacacctgctcccaggcattctggatgataatctctatcgctattttcccatgagcctccagtgttctttccggtttttactcccttttaaatattctgtaaacagttctctttaaataaaatatatgttttgccatgtcatgcgctcagaggaggggtctggatcctctcttaatgacagacggatttgtcttacaaaggccattttcccgaaaaaaataggaaataacttggaggatactggtgggggctatacgtttggtgaaatccatcagtgatattcaagccaagcaaataatcacccactaatttgtgttttccacttaaaattcttggaggggaccatgttaaatggggagccctggtacagaaaacaacatgggctcatattcactcccttccccatctccctcttctgcttccccatgaaccttcccccacaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggtaagtgcccaaattgctggagggccatctgttttgacccttaaaggggtagctccttaccgtgctctcattgccgcctccccacctcccgctccagccctgccggggctaaagtgctgacagtgcagatagtggtcctctccgtgctaccgcactgtgggtacttgctgctccagcagggcacgcacagcgtccgtggagggaaaggccttttccccacttcttaaccttcactgagagggtggttggggtctgtttcactccatgtgtcctagatcctgtgctacagaccttcctttctgtcctcccgtcttggacctcagtcctgggggctccaaagtgctgttcgtgcaggtagtgtgattacccaacctactgctgagctagcacttcccgagcccccgggacacgttctctctgccaattgtcttcttggctgagctccccaagctccatctgtcatgctggggagcccagtggcgttcaaaagggtctggtctccctcacaggacagctgaactccgggactggccagtgttgagaggcggagacttgggcaattgctggacgctgccctgggcattgcacttgtctcggtctgacagtgccggcccaacactgcggatgctggggggaggggggattccactcctgttttgtgagtaggcgacccatgggctgcccagccttaaagccagaacaagggtgtcccctgacctcgttccactgccctcctcccgttcccatctttcccccctaccttccccttaggcacgtctgagaatggtggatgtggtggagaaagaagatgtgaatgaagccatcaggctaatggagatgtcaaaggactctcttctaggagacaaggggcagacagctaggtgagtggtttagtgaaggacaaagctgtgtcactttgtcttctgtggccatgtgtctgaggttggcctcaattctaacactggccaccattgttctctgttgatgtcgagcattcctgtttgtatcctgaccttacacacccactcatttccttcaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 37470 - DNA, 188306 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaaggtaagggcgtgtctcgccggctcccgcgccgcccccggatcgcgccccggaccccgcagcccgcccaaccgcgcaccggcgcaccggctcggcgcccgcgcccccgcccgtcctttcctgtttccttgagatcagctgcgccgccgaccgggaccgcgggaggaacgggacgtttcgttcttcggccgggagagtctggggcgggcggaggaggagacgcgtgggacaccgggctgcaggccaggcggggaacggccgccgggacctccggcgccccgaaccgctcccaactttcttccctcactttccccgcccagctgcgcaggatcggcgtcagtgggcgaaagccgggtgctggtgggcgcctggggccggggtcccgcacgtgcgccccgcgctgtcttcccagggcgcgacggggtcctggcgcgcacccgaggggcgggcgctgcccacccgccgagactgcactgtttagggaagctgaggaaggaacccaaaaatacagcctcccctcggaccccgcgggacaggcggctttctgagaggacctccccgcctccgccctccgcgcaggtctcaaactgaagccggcgcccgccagcctggccccggcccctctccaggtccccgcgatcctcgttccccagtgtggagtcgcagcctcgacctgggagctgggagaactcgtctaccaccacctgcggctcccggggaggggtggtgctggcggcggttagtttcctcgttggcaaaaggcaggtggggtccgacccgccccttgggcgcagaccccggccgctcgcctcgcccggtgcgccctcgtcttgcctatccaagagtgccccccacctcccggggaccccagctccctcctgggcgcccgcgccgaaagccccaggctctccttcgatggccgcctcgcggagacgtccgggtctgctccacctgcagcccttcggtcgcgcctgggcttcgcggtggagcgggacgcggctgtccggccactgcagggggggatcgcgggactcttgagcggaagccccggaagcagagctcatcctggccaacaccatggtgtttcaaaatggggctcacagcaaacttctcctcaaaacccggagactttctttcttggatgtctctttttgctgtttgaagaatttgagccaaccaaaatattaaacctgtcttacacacacacacacacacacacacacacacacaccggattgctgtccctggttcaagtgtgccaagtgtgcagacagaacatgagcgagtctggcttcgtgactaccgaccataaacccacttgacaggggaaacatgccttggaaggtttaattgcacaattccaaccttgagctgcgcgggttccaagagccaggcccgtacttgctgttgatgtcattggcttggggagttggggtttggtgcccagcgcggtcgttgggggaggggcaaggcatagaacagtggttcccagaccttgctgcacattggaattacctgggattaaaaaaaaaaaaatcaaaacaaaaaccagtgtctggctcccgcccccagacattctgatttaattggcatggggcaagacctggacttgggattttttttaatgctcttcatgtgatctgttgggcagccagatttggggatcactagacggaagaaggattgttaaagtctccggagatgttacttgccaatgctaagagctctttgaggacatctggaattgttacaatattgccaaatataggaaagagggaaaaggtagagtgtgattccaataataaaggattccgcttttcattgaaggaactggtggaaaggtttcttctctgctgagcctgcaggcccgtcctgcctgcctggggtgcccgggagacgcgggcctgctccggagactgctgactgccggtcctgttagtcaggtgtcagccctgtctctgccgaagagactcttctctttattttaaattaaaccctcagagcaccaccaaagcatcacttttctccctccattggtgttctcattctttgatgttacttgtttgaacaccactattagtagttggagatttgttcctgagaaaaatataaataccacttaatttgcctgtttgtcccgcattcactcaaaacagaatgctcctgaagacaagagagagagtaggagaacagacgctattccattacagtaacataaaagactggattttcaggggcaaattattaaaataggagatgagctcttttaacagaaatttgtttaaggcctgtgtctatcaaattcagtggattttattcaagatgcactttgtttagtgggagttttgtttggttctgggacatgctaacttctagacttgctgctcttagaggtaatgactgccagacaccatttcatgagtcctaatccccacattaagcataagaggtgcacactctcctcctatgggggaaactgaggtacgaagaactaaagtgactttcccacagctggtgggaggcagacgggaaattcacaccaggggcttccaactccagatccctctctcaacttccaaactccactgccttgtccgagttctggtttcaggagatccaaatcaggtgtgtgcaaatgtctaatgtcagagctggcaaggggaaagggcccagggagccggctcatgacgatgagcctgtctgaagcttcaacgcgggctgtccggcagtctgcattcctgccgagttcctcagccctctgttgggtcaccttccatagaggcagcttagtcctcagttcagtgagcatggagtggagactgcttgaggggtgctgagcaaagccctgcctcttacaggatgaaggtgctctccagaagggacactggaaagtattccaaggcgagtcgaattcccaactgagggagctttgtggaaataagcccgcccagccccacttctggagacgttcccattcagtaggtccgagctgtcttaaagagaaaccaaagtggggatattaatggtatccaaagtgagatctaccccaccctccctcctcaaaggaggtcagatcaagaaagcccaagcccggcctggcaattgggacctttcttctcactccagcccagggtgaaggtggacaagtcactttgacccttcaggcttctgagctgttgtttctgaattcagtgaatatttactgagtgcatagaatatgctagatattctgggctaaaggttgaagggggggtgagttttaagggtttctgctcttgcttccagattgctttcaaatctggaaaggacaccagtggtttgtgtgttagacccacactgccgtagcacagaatacaagaaactggctgagagctccaataggcttttaacagtaatttctggcttcacgtatttagtttcataactcatgatttttcaaaaacttctggtttgaagacaccgattgccgaaagtccattgtgctgcataattacacttggtccacgtgacagcactaacatgttctgaaatgtttttagaagtagtctcagcaaagatgaaggattcctccctgtttgaaaagaaaatattctttgttttttctttgatctaagctctaagactagcagctagcatctgaaacttttttgacgagagtgacaaaccaactctaatattaaaggcaattgatgattatgggcactgaagggaaggtaaccccaggctggtgccccggaatagggatgggtcacaatgttgaggacatttcgcctgttgcagaacccacctgcaacacagtgtggcccttgccatgtgacttgtgtgtgtgcctgtgtgtctgtgtgtgcgtgttttaattttgacttcataagtactctagttatgagcttatttaacattgggttttactaataggggtatgtgttgagaaaatttcaaagttttagaatatggttcacccacatgttgcttccctgtaaatataatttttaaaaccagattctgggccgggcatggtggctcacctctataatcccaaaacgttgggaggccgaggcaggcgaatcatgaagccaggagtttgagaccaggctgaccaacacggtgaaacccagtctctactaaaaatacaaaaaaaattagctgggcgtggtggcaggtgcctgtaatcccagctactcaggaggctgaggcaggagaattgcttgaacccaggaggcagaggttgcagtgagccaagatcgcaccattgcactccagcccgcgcgacagtgtgagactccatctcaaaaaaaaaaaaaaaaaaacagattctgttcctcagatccattccatttttgttttcctttatcacttatggacatttgaaattatggtaataaacattgttagtctcagttaattattactggtttattcttgaaccactaatccatagagaatagagtgtaaatcttaacttgttcctgtaggccatccccattaaacatcatagtgttttctcattcgttctttttcgttttcctcctacaggaatgaattttctaagaaaattccagcagttggctctttggacgacatctctagattgtcctccattgggcccataggcacaagctggccagtttgaatttgggcaagaatccaggcattggaacttattcaaataactagtttgcctgtaattttcactttttcagagtcatctgataaagctttcttgctacacatttagatagatacactcaatccagttgtctagaaagttccctgagccagctgggagcaggaggggtagttggggccaggaatattgggggtgtgtttactgagcccctagaaagtaagtgctagatttgacatttcaatccctgaaggccctgaagttcagtatcaaatgactggtcctgtggactgagcatctgtgaattgcatatgcttagagtaaattttactcctaccagtttcagcagcttgctttagcaagcagtatggaaacactaacatgggggagtagaatttctctctctgatccaagttttatctcattctggtgggttttcaaggagagactcggagtccaagtgtcctttctgaatatatctggaacttctcattaacaaaagactcaagttataatttaggggacaaggcacccaatgagaatgccttgcaggcagccctaagtacacctgcaattacaccattactagcgcggcagcacacatggccctgacttagtttaaataattacgtaagtcaaccatgattgtttgccctttgcatagaagggcaagtattggtacctgttacaacttaggcttttttttctttatgtttgagccatgatgagtgatttacactgttgcatccatatgttgagatgtaagaataaattagacttggtaattgcccttaagtgtctggaagtcaactggggaaagagagctagagataataagtgtgaaacaatgtcacagaatcaatgacggaactcttcccaggacaaaggatgacttttgagttcagtctttgcctttaattctacatggggaggagagcacgtttagccacaaatggaagggattactcatttgagctatttggttatatgattatttccccagagaataggatgtgcagggcattacacaagcagtgccaatagcagcaaagttcttgagagtgctagtaattcaaatggcaggaagagaaggaataaatggtaaggctacctacagttcacagagagctccatcctcactgtggctttggattttgtcctgtgtgaaagagaagtgactgtgaactgacatgctgtgtttggtgttttagaaagatggctgcagcagcggtttggggaatggactgcaggagtggcattggaaacaggaaggttcatgactattgccagagacagaggatgaagcaggagcaaggaagattcaggacaggggactccggggctgatcaggaggcagaactggttgataagtatatgtagcagcataagaaagaaagaatcccagattgacacccaggcttctcacttggaagcctggatagatactgaatgcaatcacaaaggctgggaagtcaatgggactgcagggaagggaagggaagggaggagaagaggaagggcaggagggtccaatatcaatattcagcttttagatgtgttgagcttgaagtgctcagatggagaagtccaggaggcagtagaatacggtggtccagagcacaggagagcaatgtggcttgagttgtcatttgctcacatatttccgtgtcagttacttgtcttagatcacagaacaagttctcctctcacagtttcctggctccacctgtctcatgctcaccgtcagcatcgaaattgagccacaccaggggttctggataccagcttctctctaggtgaggctgctatagtcagcagctgattagttgcagttatcagcaactggtaatataatatattgtgcatataagtgtaccagaagtcatgtttatatattgctgcaaatactcggaatggggatctcttgttccctgcttaagaccacatcacattacttggttttgtacgctagtggctgaaccaaaaaaagtaggagatgattttttttcttttttcttaaagcagtagcttttgaaccttgaccatgctttctaaccagctgaggggcttttgaaaaagagggtgccttactgtgccccagaccaggacaatcagtatttctggggaatggagcctggcacacacacatttcttaaagctcccttggcaattctgaggagtggattacatgttgtatgtagctcgtaacgaaagaaatcttgtctttgctctcagacccccatttcttactcatctcatgagctccttcgagatccagaaacagttgcatatttcattagtaaatcagttccagagtcacattttatttcacaagttagtccattaaaagtttcctgcagtgaggaaatagccagaaagaacactccacccctcctcctttttataactatagggtctggctcgacagagcaggagcatcgccatcttggacaagcccctcattctaaagttcaccttaataaaaaactgcctaaattcaaactgcatcagcctaatggctaaggtcagcatgaccataaaccacaaataacatctccaaccggaaacattcgaaactcctcctcgaccagagacatgctagtcccgagataacccccctccagcagggaagatgccagtctcgggataacctctctctggccggaaagatgcctgccccaagataaacttgcctcctcccagagatattccaaccctgccataaaacttctccctcaaacaggaacattccaaaattctgataatctccctcaccctaaaaccaatatatactcctagtctgtaagagaaagcgctcttgaccaaaattcaccaggagtgcctcccaggttttaactaaagaaaacctctctttaactgccaaaaaaaaaaagggaaaaaaaaaagctttctgcagtggctttcagcgggcccagcatggcagcagcacctgagaacctgttggagatgcacactcttggaccccaccctggcctctgagtaagacactggaagggcaggccccggtctgtgcacacaagtcctcagggagattctgactgatgcatgccagattttgagaactgctgatatactccaggcacatcgcatgctgggatctagatacaccaagggaacaaaataactgcacttgtcctctgaggaccgacttaccttttggaagggctgagaaagagagacacatacaagatcactccctgtaatgcaatgttttataacagatgtgatttgggatttcagtgggagcccaaaagagggactgactaattcagcctctgtgacaaggggagtttctcagaaacagaatgcttagctgggcctccaggcacagggacaggaatgaggaaatacttgtaggccctgtgctccttcagcaaaaccctcagtttcttgttatttttataaatgcaaacatcttattaaagtagatgctaaggcattagaatttcctgctttatttttctaaatgaccatgaggaaacctggaatgtcaaagataaagtgcaacacattctgcatttaaaaattaaaatgatcctttttaaaagtagcaaccagatgtgaaaaattggactggagtccaggttatagttgatagctttaactttctccccaacagcaacagcacaattttccctaaaatgtgttatgaataagtaaaatgactacttcacatcctttaactcttcctacagaaatctaagagagaaatgaaacaaaagtttgcacagttctagacacgataaatacatgtgaaatcacacaactcagaaaatgtcccttaaattaattgagccattggtacttgtgaattagaagagacatctatgttctgatccactgttgaaagctgtacaatgttacctatttatttgcagacatcctttggaaacaaataggtagatttgcaacaaataaagagtggagtacagctgctgacattaccttgtatattcatgcctttatgtaaaaaaaaaaaaaaaaatatatatatatatatatatatatatatatatatacacacacacacacatatggaggtaaagaccactgcttgctttgcagttgttttaagagcattcatgaaggattttattttataagcagaaatgtgatatctgacgattttaccactacatgcttgcaggccagtgcacagcagatgacgtcatgattgttttagcagtcctatcgttttacttatgatgtcattacaaccctttgctaaaatttctttcctttactccaggttttggataaaattgatgcattgcacatagtctctctgataagacaaactggcatttgtatgtgaaaaactgtgcatgttttagtgtctctgctgatactcaaattatccattattttagtgctggaataaaaacaaaccacttagtgaatttgtgcaggtccttaaggacaggcaaaggtgtcctgagattttctgatcattgtataccaaattttagaaactttttcaaaaacatttttttaatttcaaaaacctggttttgtttatttaccagcaatcattgaatacctgaaagctttcaggagattttattacaatggtttctattcacttacaaaattatctcctagttcattctcatacactgtaagccattgtaaatgcttcaaattgtgccgaacaagataaactagacaaactattttaagtttgttctagtgctaacttgcaagatctaatggctccaactagatttttaaaataaagtatattttaatatattattagaaagttaagcaattatctgtttataggtaacaaaaaccctggaaccccaatgtcagatgtcatccacttttgattaagtccaaacatatgacagataaacaaaagatggttggctgggctcagtggctcatgcctgtaatctcagcactttcagaggccgaggcgggcggatcacaaggtcaggagtttgagacttgcctgaccaacatggtgaaacccgcctctactaaaaatacaaaaaaaacagctgggtgcggtggcacgtgcctgtagtcccagctactcaggaggctgaggcaggagaatcacttaaacctggaaggcaggggttgcagtgagctgagatcacaccactacactccagcctaggcgacagagcaagactcagtcaaaaaacaaaaaaaaagtggtcattggagaattattgtgtcacctgttgttttttaatgtactaattttgagaggcttttaaatagagtgcactatagaactttttcttggcttcaatttgctacaatgttaatagagaatcagaaaccttatccttatagatgtttcttgatttttttaatttctggtgacatttatgagtgagaatagtgtattgccctgttttctttcttactcccctttcttcttccttccttgctttctttcttcttcccttccttctttctcttcctcgctccttcttttttacaagctgttatgaattagccttcacagagaaagaaaaatttttataaataactggaaatgaaactttgcaaaggactgcagatgaaaaactttgtcaaatgactgtaaaaatatactatataattttcaaaagttagaaagtaccaaacacactcagtattcatggttatacaagtatgcatacacatgtattgctccctgaaaagtggtgttgttaagggagtttttcttagtacgcggcttaacatatttttttctgtaatttgttgttagttataatggggagagaaaacaggttagagtctcccctctcagtttcaccttccataaaacagctaaactagacgatcgtcagactccttccagctgaaaacatctgtaaaattaaaaacaaatctaaatgtatgcaagatatgtatttaaacatgctggtaataagtgtgctgtccctataatttagatgctaaaacattgatgtcataataataacaacacctcgcatttgtacagcacctcatagtttacacaatgccttaacattcttctctctcagcctcctacaaccccacaggattgggatagctttccagattgggaggtgagggacccaggctcagagcgattctgctgttgtccgtaatcaccaggctggtgatcagtgggcactgggtgctctcctgctacacagcactgtctctcaacatgcaggtcaaggttacttattcctccttcaagacgtcattgggttttttagctatggatgccccatcacttttagttctatttgtgaatcaaaggctaaataaagtattcctcaaaatttgttatacttctgttactaatgcttaatgtccctcacaatttctgtatatttctgtgtatttctgctctgttttggttcctttcccaggtttcttttttgttatgaagtagtttttagactcaagtctcttctgtatgtgttataactgcccattccataagatacagggcagtgaatttgtgagccttgaaaatatttactttagaaatgagaagtatgacttttcaacgttgtgtcatcaacttctgtaaattttccagacctataaatacttgcagaaaaaaaatgaaaggagaaggcaacttgatttagcagttgggtcagttagcaatgcctatggcaagctgtagtaattcccttacatagatttgtaagactcatttctatgatttaaatgaaggcatacacttaacctctttagggtgtgaaacagcttttacaaaaagagacaaacttaagaaacagtgtggccctccaagagtgttcattttccatatcataccatttgtaataagctattctggctgggatttacttgcaagcattggcttttaagaagagatggtttcacacatcaaattattcacttggaggcactttctgggttgaaggaatggaatggagagtgcggcagtgagtagatctctcagtgacggtgatgtgcctctcccagaagaaatttcaaaatgcagtgttcattttcctccacaagaaaggaagaaactgttttgttattgtttattcctaacatagtggaaacttttcagtactctggcagaaatttcccaaaagcaattttctatttcatgattataaagtagcaaaggaaaaagtcctgcactccagctgagcaatggatctccagttgttatctaggtgctgcaggtttagagaggattgccaggagaacacatcgatttttcaggcctgtgatgacgtatctcttgttgaataagtaaacccttccagtaaacagacagttagtatattgatttcagggtggctttagccactgaacctgtaagtcttgcaaaggttacttgggcaaaagcatcattattttaccttcagtcaacaaaaatctacctggccaaggcagaacagaaagttcagcaatttgatgaagtgggacaacatgaagaatcaggtgagttgcctactttttcacttcactttccacctttagagattcttgtttagatgcagagtagtgacgtgcctggtgtcagggagagagttgaatgagaaaagtcccagaagggcagaagacttgggtgattatctgagtccatctttccttatcacatgacagagttcttgaagtcttggctaggaattctaggcttttagattctttgggcaatggctactaaatgttcataatgttgctcagttgcaaaaacaagacattcaaactatagccagggagataagtagtcacgaactcaaggcctaaattctgctgatggagccgatgagaattgggtgctaaggcaaagagagttgccaatattatattcttcggggttttttgtttttattcgcattttggaaaaggaaaatattagcattcctctgacttaatattgagaagacattgggcactctttttcctcccacacttgtcttctttcactaggtgacaagggaagaggtagcatgaggtggtggtcacaggtgagaggggctgttgtgagcacaggcatgttgactgcacattggtcacctagtagaagttttgcaggcttggtgacttctgaacactgttttcaaggttgatttttagttgagagaacctctaggtaccacgtaatgttattaacagtagtactgatctcacaatcgccctatgtcccattcacaagatgttctgccaagccataaaaggcccagttaagtttaagagaagtctcaaaagtaacagatgataactaattaatacccagtgattttgaaatgtagacatcaaacataccaattcagtggtatcatccttagaggcagacagaggatgattaaatcattcagcccatctctgtctgaggacgcagcttagcacagcatggtggaggctaaatgggccttaagggaaaaaatgatatctgaagatgcaatttatttcaaaaagagtttgctcccgtgaattttcactctctatgtagaacggcaccagcacacacttttcctgagcctttgcatgtgtggcaggcagcggcctggcatcctggggaactgaatgaggacgcagatgacccggacgtgttcacagtttgacacatctgactcccagatcagggacagctagctttgctggctggttaagttgatgattccatctttgcctggttctctgactgtctcatgctttctgttattactattttgcagcagatatttctgctcatttttcaatcatatatgcatcctggatggcatagagttgattctcctaacaaatcagtgtccctttgtatttttttctggccataagatagaatatatatgtcatttattaaaaatggagaaaatgttcaggagtttcttgactcagagagggaaaagggatactcagggcactttttcagccaggaatttactacctttgcagggtaaaggggactcaccacgctggaagtcaaaataagccaccagtgccaagtgttcaaagcccttagaatcacaatgctcttaaagcaaagtcttcaacaatgcttgaaaacttccactggttctcagtatgtccaaaattgtcatgtctatgaatgattttctcaatctgaaaatttttatagcaggctaaagaatgagataggtcagtgtgattctagaactaatcattaacattcaatagatgactattttattctagaaaaagcagcaactttctatttactctctattttgagggtaaattctctgtaagtagaaaaagcaaaatgtggacatgggactaacatatgaatatacaaagcaaatgtaccgaaaaaatcttaagacctgccttgtggtgttttttgttttgttttgttttcattaaagtgacttgttagcctcttgctccctgtgaagcacagggaggtgacgtgatgtgcacagggcagactctgccatatgccctggccttgaactcagggccccctggggactgcaggggatgctggccatgctgagcaatgcctgtgggtgtcagtttcctcatctgcagaatgagggtaggcctggtgcttatttcatagggtcgcagaggggattcagtgacagggtggtgtagaggctggagcgtgccccatgtgtgcacgacagccttccaactaggggaggcgggcctgggctctcaccagagagcctgtgttctccatggctacatgactttgccccagacgtccttcccgtggtctggaccctgggaagtcgccaagagccagacaggagaaaggctccacttggctctcctctttggtgaccatcccttgcctccatggcgggactctcaggtgacatcccaccaaccctcactttgcttccctggtgggtctcactttccctcaagagtgttgcttttttgtttcctgcatagtcctgggccagttttgataaccctcttcatttcacttcagaaaccctgatgatttcttcctgtgctctttttaccttaggacttttactatgacgactgtgactggcccatttcttgttttttttctcttgctctgctttctcccccatcatcactaaagcagacatggcaatgatggccatgcacactttccaagggtccagctgtagatcttcatggttccccaggtgcctggaccatcttgtgaggagggaggcaaacacaccctgcctggagcacttggccctttcggcaatgttttggcttcctcaagtgagaaaagaatggatttgtattccccctctgcattattgtttttgttttgtttgtttgttttgttttgtattgagacagagtctcacttttttccccaggctggagtgcagtggcccgacctcggctcactgcaacctccaccttccgggttcaagtgattctcctgtctcagccccctgagtagctgggactacaggtgcccgccaccacacctgactaatttttgtatgttttgtagagacagggtttcaccatgttggccaggtgcccattattatttgatctggaattaactgagctactgcaggaattgcttgattcactgatgactggtgttgagccagtacacacccacacccaaggactgtgactgtcttctgaggtccatcctcagaaattcctgtctcttcacctagtgtgtaataaggcctgcgcgtgttatatggaactgtaaaaaatgcgccaaccatctgtccttcctctttatctgattacttatcattgttctctaagttgcaagttaatagactgatcataaattaatgcatgctggagacttgctgtttcctactagcagcatataaaagttatttttaaagttgttttaaatctgtgagtaaaaataaattgctttgctgcaagaaacaccaaacatggaaaagctaacggttcaaagttaataatttatcttatggacatcactagtggcatagttgctttaaacagtgagaggatttaatagatatttgatttgcaagtgggatgaagggtggtctaacctttgtcctgtgtttaccttccatgagatcctagaggttgtacagcacagtagtggcatgtgacacacttgagagtgcctgttctgtttggaaacctggaaactatgaagggaagtggccttcgagcttaacacataagacttgggaggcaaaaccttttattctctttaaatattcactttaggataagcatttttttaggtgttaggaacagggaaaactgtgtggttaggaaggaagaaagaagaaagttaactgttgtacattccctaggtaatgtttttaagcattgttattcactttcaaaacacattttatttatttggacttaatattttgatcttattttttcaatttcttttaatttaacagacaggatgagtttttttatagttgtattacttagaaattatactaaaaatggccgagtgtggtggctcacacctgtaatcccagcactttgggaggccaaggcaggtggatcacttggatcacttgaggttgggagttcaagaccagcctggccaacatagcaaaaccccgtcttcactaaaaaaaaaaaacaaaaaaaaaactagccacgcatggtggcaggtgtgcctgtaaccctatctactagggagactgagacataagaatcacttgaatccaggaagcagaggttgcagtgagcagagattgcaccactgcacttcagcctgggtgacagagcaagactctgtctcggaaaaaaaaaaaaaaaaggataaagaaatcatactaaaaacaaaacagaatgctgaccaccttatagaaatagaaatagtggtttgctgtgatagcaaattttcttgttaactttttatttttaaagaattgcacattcacaggaagttgcaaaaaatctactgggaggtcctatcccccttcccccaacctcctccagtagtaacatcttagtagcaaagttttgtatatttattttgatatcattatctaagtttgacatcattatctaatattaacctaagccaaaagcccactattttaattatctagtgatgcagtgttatagaactcatagcctttcacagcattatttggaagttaattttcttaagtgaaatgtttttggtctttaaggtttggaggccatggaggcatgaggagaaatgggatgagggagagagagctaagatagataaagacagagatggggagatccactgattcgttgaacaaaccagatacttccttatagtttttggattaacttacatgagctaagtttatattctgttcagatcacaagtggtcaagtttgtgtgtgtgtgggggggggggggtgggtgtgtgtgtgtaccactctacccatcctatatttattgtcctgtatttggtctgttctgccttctttattttcaggataggtgtcctaaatgagggtctttggaaagctggtgaggccatgttgcccgtttcaggtgttccgtgctcaaatgtattcatttcttgaaaaattcagggagtgcacacttttgtacattttcctatgtgtatatgataccattatataaatcttaaaaatatatatggttcacctgaatccccagccatttggtagagaagatagaaaacctacagaggaggctaagattttattagaaaattcagcttctcgacggaggtattggctttaaagtcaaggcaatgcatctattctttcttttgatataactagctaaaagatctcttaaattcaaagtggccctcatcttactgttactgcaatttactcttaattacaaattatataaaaataggttttgaaatactgtagcgacaaagtaacatacctctgctccattacacagataaaacctctaaggaacacctcctctcttaacaggcattaaccaactgcagaaactgcagaaggacagggctatttgggaataacacagctcccttccttgtctgttccctcccattgtcaggcttctgtggagccatattcagagcaacatagggagggggaagagaaaatcaaccccttggtgaaggaaagctcccaattcacagagcaaacatgggtactcttgtttgtgggagctcccagggcctcccagctcaccgagcattctgagccctgatccttacactaattgtattatgcaaccataaatgatgtctgctgtaccagcggggacagtttattttaatagattggtataacttggcagaatcttatctgcatgtttcatcttggatttttagctcaattcaactcaataggcatgtgtcaaatgtctactgcagactgagcactgaaaagctgctgggtacagggttacatggatagaaaacgtagcctctgacccctaaggagcctgtaatccagatccccattctttccatcccattctcccaagcaagaatttacctaatgtggtttgcgagaatttaagagctggaaaggtggtcacgagaagccggaatgggttcgctaaaatgtgtctatatgattaagcataacgtagctttgcagcactcttcacagcttcctcagagccttccgcacgcggtgtctcatttgaatacttgtgtgaggatagcctcatacccctcagtgagctcttcatggagtgatgcagtagacagcaagcctcacacttctatgctcacggaagaccaaatttgccttgaaaaatctttatagtctcttcacatttctaagttgacatcaaaaatcggttaccataaaatcctaatagttgaagagatgtaatttcaattatttggtaaacctgaccttcattgtcaaagcaattagtcaactcagatttactttctcccagataatagattctgacttctttttttctgattaaaaaacttaacaccttcctcaggagatctatctcagttctgaatgctgattctaactaagaaggatatttggctacatgctgggaagaggggtactgaggcacgccgcgattccactccagcatttccagttagtcgggtgcctctgcactcccggtgttccggcgcccagttagttgtgtactctgggctgtccctatactggagtcctaaaacacttacgactgcagatagggggaggtttttcaaaaccttggtctgaaaagccatagaagggagataggaaagcgggggggtggagccacagtacattcaggtggatccgtttttggaaatagtacaaactggaggtgaaaccctggaaattgatctgtcgttcacatgcttcatgccgagtccttgtggacccacagagacacactcgccccagtttgaaggctgctaacttgattctgaggacaccagtgaggtggtagtgtgcaaatgatgtgtgaggaaactttggaggagtctcaccctgcctggagcacgtggcccctaaaacagcgcagcctcccaaagacagaagatgtggactagtgagaagccaggtatggtgactgctgctggatgaagcttgtcccaccagaggctcgcttgtttcattgagcacctactgtgtgcttgtgggatgcaaacacacgtgtggtccctgccctcaggttaataggcaggggtggaacagttatgaaactgctctaaagtcattttctcaaactgggagtgacaaatgtatccacttggaaaagattgagaattttataagatttttaaatttttgtttattcacattgaggagaatctaaattcttttgaacttatgtatagatttcaccattttatagtaataaatcagtcctcctgtgtgtgtgtgtgtatgtgtgtgtgtgtgtatgtaaacctcaccttgcaatattattattttaaatagccacttgcatcttaaggaaattaagaggacaaaagaaaagctgctgttttgtatgtatccacatatttaccagctgcttccctgccggcaggtgctctggttctgcactgcctgttgtcccttgcctgaaaatggttgcctccaatattttgctcagttttctgattgtttacagtggcagaggagggtagatctggtaccagttagtaattgccagaggtggaagtctgtggatgaaatttgtataacatggaacgttagttccacagttaatgctactcaattggaacccatggaaattattttttggtgaaaagggcccatgcgttatgaaatttgagatccatcactttaagtgaatgtaggccctggatacagtgggagctcagaagagcaaatcagttggtcaccttgctcaacgtattttactaagggcatcagtaaggctttctatgacctgctccttcaatgcttggttgacatttggggagcaaagataaactaaggattctaagttctgtcctgtgatgctgtaaggggaatctcaaacctctaggtggaggagtgcagagatgaccaggatggtggaagcctgcaggagagctgaacacctgaagacacccagtgggaagaccaggacctttaacgcccatatctgctgctcaagactggcagagagaagagggtttgtgatgagaaaaggtggtgaaaggcacaaggaggcacagagcatgtcaggtcccatatcccaaaaggaatgtgcttgggtgagggagagctcctccatggctggaggcattcagagaccaggcagtcgcttgtgggtttgtgattagagtgaggttcttttataaagggagtgagaagagaaggtctgtggatacttgagtgtatcggtaattaagaaataaattgtgtacatcccatttctttccacattttcctgggctgtcacagtggctgcaaagaaagcagtccgtgaactgaactgtgatcccagacaggcaagcacaccaggaatctcttctcagctgttgataatgagggagcgctggggagagaaatggggtcctctttgagtttcctctgtgccgatacctttctctttgttaaaacagctaattaaacactgaagcagtatagctctcttactatacactggtagtcatagttctcttactgttctcttcactgacagttctcttactatacactgatggtgacgcagaaattcagaattccccgcatgtgtcccggtttgaaagccactgtgctttgctgtggattaggatcagacagttgagtcttgttccaacaaggaaagttgcttattggaaagttttgctgcagggagccttgagttctgcatcaggcttggaagtgggctctgtggaggtcagaaggaggatcccccacccgcagcctcaagaaaaatatgaaaagtggattatgcctctgtagctatattgcctataaactttctgcagaatgacagtattcatatcctacattttttcaaagcgatattaatcctgagacctgcagctaaagtcaagtagaatttagggataattaataggaggaaggtggggttggaagatctgcatgattatagtcctctgatataactggaaaattctttccattagcaaggagctttggttaatataaaatggacagattaaacctaggcaatttattttactcattgctgtatttttatttcagagctggttgaaaatattacaaagtaatattttaaagtgcttatctaaactcttactctgcattttatcattgggttatgaaatgactggggaaagacttttcttgcttttatttctcagtgtctacttataaacatgttttttgaactactgtttttgtgacaacatgcctttttcccagaaaatctcaggttaacattaaataggcactggatgtttatctgatcttgtttatagaaacacaagaaaattttaaccttgtatatactttactcaattaactaggtaagaggtcattgaaacatttagaattccactctacatttcaataattatcaggtgaaagctactgcatctacatcagaagatgtttgtaatttatttaagaataaaattagctatgcaagaaatagtatgtggagtcctatgtggaaatcacagaaaccctgacaacttgatgatctttccgcaagctaaaaatatcactctggatcacagcagtagaggactctgtaaatttaatctgtgtgtctcctgtaaataagtgcattagcagtacacaggtggtgtcagagtcagtgatgatggatagaaattctacataaaatccaggctcagtggctcatgcctttaatcccagcactttgggagtctgaggcgggtggatcacctgaggtcaggagttcgagaccagcctggccaacatggcaaaacctcgtctctactaaaaatacaaaaattagctggatgatggcacatgcctgtaatcccagctattcgggaggcggaggcaggagaatctcttgaacctgggaggtagaggttgcagtgagccgagatcacgccattgcactccagcctgggcaaaagagcgacactccatcgcaaaaaaaaaagaagtaagaagttttacataaaaacgtggagtgagcccaaggtgccatttatccagcccatacacatcgtaccatgtacagagtggacaccagataaatacattgactgcatgccacaaacatatatatgtaggcaccgttgcattcaaatacacatctgcagccctaacacatctttatttgctaacgagcatcaatgtatttaaaaacaaacatgtttaaactagtgaatgattagattataatgatcttaattcataagttttctcattggccttttgtatacttcaattgtaatacctagaaaaacagttatgtccaaaggagtgaataggccttatctgaaacaggtgagcgtgacaagtgttttcttacttattttacttttcagataattcatccttaaagtacattagtttaaaagtactgtttaaggaaacagtacttggattaaaacttgaatcattgttaaggaaaactataccttaacttcatgtaatcacaattaaacctcttcatatagaaggatctaagaattttctgcagcattcaccagcaccaaaaagctcagagacatatatttctttctctgtatatgtattttaaattcaagttagtataaattgacaggcaggtcagagtaatatatgatcttctgagtccccttagtaattaaaagaaatgattatttttgcatgaaatatgataaagtgattttaagtgcctgataaaaagtcttaaccatgacaaccattaaagattacatcaaagaaaaataagtttgactttcatttaccttggaaacagctattaactggtaacctcaagaaacaccatgaagagtcagtttgctccacacatgtcttgtaaaagtcaaataactggtggttatccagtaatgacaagaggtagaagttacatccttgctgtctgattgaaccttcccagagctggcacaaggctgggaagaccataggtgctaaatgaggaactacttaaagaaagaaaatggaatttcacggacaagaaaatccatgtccatttggttctgtgacccacatcctttgtatcctatgcttttttacacttggtacatggttgcaagattgcccctgttttctacttatagttccatgcagcatggatgtgggaaaaagtctcctctgcaaagggggttaatgcaggtcactctacgtatgtgcacgaggtcgttataaagctcgaaaatatgggctcaccaaccaggtgatttttttaattatccaaccagaagacataacatataggggaatcaaaagaaatctctgagtaaaataatgataacaggtcaaactttgcggtcccacgtgaggctggagatgcgtattgtcttgactttgcatctacaagtttaacaaatgatgctttctcagtttacctctggaaatggaaattagcattgcaaatgacttcatgaggaggtagaagctatctgtgaatttcctttcgctgtgtttacgatagactctcacgtctagatgtgtcatgtattatgttaaattggtatgtcttgaagttataaagcacagccctctataagtatatatattccacctctttcaaatcggatggtacctatccttcaaactgctatttaatgactgtctgctatgttcaaggcactgctctcaatgttaatacttgatgagatcgggcgcgttcaaggtggcatggccgtagactcaatgttagtatctgaaatatggcctacgagctgagttgtgaatcaagttaatagattttcggaatgttaaggtctaaaccagtagctcttaactgagacaatcctgtcctcatctcacctgggagacatctggcaatgtttggagaaccttttggttgtcacactggggcatctagtgagtagaggtcagggatggtggtaaacaagtttttttgtttgtttgttttgtttttgagacagagtctcactttgtcacccaggctggagtgcagtggtgtgatctcagctcactgcaacctctgcctcctaggttcaagcaattcttatgcctcagcctcccaagtagtagctgggattacaggtgtgcaccactacactcagctaatttttgcatttttagtagagacggggttttgccatgttggctaggttggtctcgaactcctggcctcaagagaaccgcccccttcttggcctcccaatatgccgggattacaggtgtgagccaccgtgcccaggctaacattctttaatgcataggacagcccccaccatacagaggaatccccagcccagaatgttaatagttctaaggttgagaaacccaaggttaagccaagtcaacttatctatcttctttaaaattgcataagaatgcagtcctgttcttcattcctcttgctttgcagttaatgatcctttgcctggactttctaagtgcccagaagagcaacagccagcatgcaggatggcattcctgaccagttgcacttggcctagcattccaacctcacctgcctcagcttgttcaacctgaaaacctaccaagtgaaagcaagagccacgtgaagacgccttagttatatgcacccacccagacacttgctcagaaaggaatcagtggggccctggccttagaaactggctccttcactgctgtagaaacaacataaatttaacataaaacacgtgcttttcttttttcttcttactttttcctgtcttggcaatgcaaggatgccattaggtaaagaaatccttcaccacactaatcctgcagagccagaagagaaaccagcttgttctaacccagctttgtcatggagagaaggcagctgctccagtctgaactattctttcttttggtagcagcctgcccaagggtgaaagtgtgtttaatagtttgaattacacaagtgaacagtaaatgtatgcctgtttctgctttatgggactttgaaataatgttgtttgtgccaaggttttagattactatacctaacaacctagaaaaagaaatgaaaaggaagccttctgccaggcagaggtcactacgggcctggagctgggcacctgactcagcagctgcccagatccccagagctgagaagtcaccatgcatttgtggtgcttcgagcgagttaccagagtcctggaacagagcagcacacctgcggggtgtccccttggcatttgggcagggcaggtgaccaagggtcttgttggaactgaagtccagcttgaaaagcaaatctggttgtgagctagagtccagtaacacttgtttcccgccgccccccgcataactcgtgtgtcctaaaatacaataatttcttgaacttcagtcacttatgcctataagcgggcatacaacaggggcacaataaatgtttgttaagtgaatgaattctttcagaactagatgggatcttagtccaactctcttatttaacgaggtccacagaggttctgcgattgtctaagaaagaaggctgtgttcatggcctttgttgtttacgtggccctgtgattctcttggctccgtgaaagtcctgatgcagacattccggccatctagaaaggcatgcagacaagccatccagctggcatgatcctgagtccagctttctttaaaagagcttccaaaactgcttaagctttgactgcacaaaacctgcatcacctccagttgagaaactcaagagaataagtaagttatggagttggagaccccagcttaactactagttttaaaatagtgaaatcaacattttcaaatctttgacttcactaagatttaataaagtttattaatcatatattatgagttattgctctctctttatgtctgtaatgcagttgctcctctctgtataaattaataagttttagagatccaaaatgagaattttaaaataaattacgtatattttaatcaagtttaatttgactatatccagctaaacaattgattgaacttcacttgcttttctatgacaggttttttgttcttagtaaaagaccccagttttctcacttgtgaacagaaggggttagacttcatgacagctaaggttccttccgtctctaacaaaagtggcctgaagagaggcttctagactatactcacggtgggttcttgggacctcagagtcagctccatcacttaagtggctgtgtgattgagtggagacacctcaatctctttgtgcctcagtttcctcacctgtcgagtgtcaacatgatggcacctaaagctgttgagacttcagaaaggtaatgtgtgaaaagtgaaaagtgcctggcatccaggaagtactcaataaataccaactattttattgctgcagctgttcttatagatgtgatttctagaacattgccttctaatagggtagccatgggccacaattgttggctgttcggtgtttcacatatggttagtccaaactaagatgtgttgtgagtctcaaatacacactggattgtgaagacttaggacaaggaaaacaatgttaataaaatctcattgataacttttaaattaattacatgttgaaatgaaaatatttgggacatattgagttaaataaaacaggagattaatttcttctgtttctttctactttttttattagtgtggctactcaaaaatgtgacattatgtatgcatctcgtattacatttctattggacagcagcgctctagacagtactatgggtagtatctgtggggaggttctcagaaacatgtcgcatgctcttttagaaccttaaagtattcctagtctcctctacttccagcccttggctcttgggcctcagtctttttacttttgcggctgtgtttctctgaaggcttggcattagtagattgaaaagaataaccatctagggaaatgtgaattcagtttctttctgacattctgctctctacaaggggatattatgtacacataaacctacttccaaaataatgaagtgaggcctaattccttactcttcagagagcccactgtggaagtgtcactgaccttgtgtatgggctgcccttcatggctctgggagtcattataaagggcagcatttggcgtggtgcgtcctaagccagtgtttctcggctctgttccttagacatgtgttagtgttaatagatgttcttggaaaaaaaaaaaaaaaacagcattctgaggtcaaacatgctcagaaagcttggaatctgcactacgcttctcgtacacatttcatattaaagattttggaaagtcctgcaatacagagccctgtctaatattgccacaacccacaattgctcaaatgtaaatagatttgagtttattcacattcagatcacctcttaaggccccacctcccaatgctgtcacaatggcaattagatttccacatgagttttggaagggacattcagaccacagcaggggaaagcagggtacttgctgctttgcaagtgtgtccacatctaattaatagtacagttcttactcttggtgtgtccggtgatattaaaaattaatgtgccttatttagataagtaacataaaaatcacaaaatgtatgccttagatttatatgtatttataactagtctatttcctgaaaacagttgagacaccttgtaaaagttaccggtacgatagggccattccaacaaagctgtaaagtggtgataacacagtcataaagaagaggagatagctctgggagaaaaggtggcccagaaaccagctctgagcctcatggctgcaggcaaggtctgcaggttcctggtcctgattgcaggccatttgctgccttgagtggtggttacacaaggccagccctgggggtatcacccagaacacctagtacacgaatttcagtttagaggacgaagcattactggagtattgttatgcaggaaaactttttcctaaaaatgccctgaaaagagagtagcctaatgcattcaatcaaaatgtttttaagtggaaaacatattgtgtgtacttgatctggcctgctgcttttaaaagattaaaactgggactgggcatggtggctcacacctgtaatcccagcactttgggaggcagaggcaggtggatcacctgaggtcaagagttggagaccagcctgaccaagatggtgaaaccccatgcctactaaaaatgcaaaaagttagccaggcttggtggcgcatgccggtaatcccagctagttgaggggctgaggcaggggaatcacttgaacctgggagccggaggttgcagtgagctgagatcgcatcattgtactccagcctgggcaacaagagtgaaactccatctcgaaaacaaacaaacaaacaaaaaaacactggggccaaagaactctgtgtgctgtatcacctaaccacatttcatgacacggctagagaagaatcatgcaaataaaaatttccaacatgttcgtaaactgggaaagtatttcactggggagtgagcagaaaagtaatactataacctctatatctagacaaatgtgaattcagtttcacatataaatatataagtgaaaaaatatataaatataaataatatgaaataatggttatctcaccactttctacatcttttgtgaatattttatagtgctcaaatatattagtgcactagtatatgtacattacattaaataactaatcatttattaggaggatgtgcttgttttttgctaataaagatgataataaaaaaatccttagaccccccctcggtttgttttcagttaggaattagggatatttataagaatatctttaaatgacacatgccttgctctgggacgaggcatctgcatgggtgacacatatgtgttgtgtgtacaggctcccagcatttccagggccctgctcagaatgtaggccttactgattcttacagagttacaagcgctggtgaggttggcgaagtttaggtaaacacagctgggaatgccccatggcctctgggtgactttggacatcactgaactttacccttagagatgcatacctgcatcttttttaccctgatagggccttccatgatgctttcaaagtgtttttgtctgcttttcggttaatagactttcacagtagccaattgaatatattggttaaatgcatctctttatacacagactggattcaaactgaggttgtgtctctccctggctgtgtgacgttgggtatgatccaagtgtcagattactcaacttcaaaatgaggacagagcctttcccttctagggctgccaggaacattgaatgagagagtgctggcagcttagtacaggtgttcattgctcttgtatggtactgtctgtggcacggctagataaaatacagtagccactgattcaaatttcaactgaggagtaaaataaactgaataacttagaaaagttttcttcttttgaatgactctaagaatttaaggagcatgtgagtgttgatggctctaaaagggtaacagagcccaactagctcagttctcagcatgaaaatagtcatatggcacagactcagtggagtgggtgcacttcaataactggaagcacagatgccctacagcagcatcaaagatggcactctaaactactttcaatcctttaaaataaatggaaacgcacatttagtatgcatatgacaacacgaaggacttcgattttgctgatgcaatacagttttacaggattttttatactcaaattagtaaaattctgtattgcatccaaattataaattataatatcatctagattggacataggaataacgaccactggtatctgcccagaaagctctaccgcctgtttataagctcctgcaggagacacaaaaagaagagaatttgaatataacttgaaatgaccgtaatctcctgccccaactcatttcattaccaaaccgcctctttcttcattatttctcctgaagcacaaatctatagagaactcagctgccagtctctcccactgcactcagcagtgaaagggttaggcctaggcttttcaaacagaccagtgcttgtatcagcccttaaacatctctggagaaggaaatgggatccttctttggtaattcatttttgacagttggggattaggtgttctgtatctggggggccttgctgtcttctctcctcctcctcccactgcagaccctctcctcccctcccctctccagctctctgatgactgcttcatgctccttccacctgaggactgccagcacagcctattgcaggaacagccaatgaggggctggctgtgctcttttatttataaaattataaactcaagcaaaatctagactatgtgtccccaagatcagaggagcacaaatcccttgcttacagattgcatggggggcacattctttaaaattggtccctgatctagactctagcctgagaatcatctttaagttcagaatttccactcatgacctcacatctgtgggctcccacattgtcttccaaaacacacatggcatctggcatcaccttcacccccaccctcagagcctcatctccctgcaggtagatagtcaaggcaacctcttcactcttctgccaagcctcctctcctcagctcttcccttcctctctctttttgaaaatatttttaattgtggcaaaatatacacaacataaaatttaccatcttaatcatgtataaaagtggagttcagtggcattaaatacattcacgttgttctatagccataaacaccattcatctccagagctcctttcatcttgcaaagctgaaactctgtccccattaagcaatggctctgttttcctccgttcccccagcccctggccaccatcctcagttttctgtctctgtgagtttgattactctaagcacctcttataagtggatcatacaatgtatctgtctttttgtgactggcttgtttcactttccataatgtcttcaaggttcatccacgttgcagcatatggcagaacatctgtccatttccaggctgaatggtactcttttgtacgtgtggaccacatttcatttatccattcatccacgggagggcacttgggttgcttctgctttttagctattgtgaataacgctgctatgaacatagctgtatgcctttgtcttttaaagcccaaatctgatcaagtcactccccagcttaaaaccttccactgctccccagcagtgggataaaggccagtctcccctgtaggtctctcccgccagccctgctcagtcttcttgcttgtcatccttggctaggccttgcattgccatagccctctgcctctgttcacgctctctcatcttggagcatgagccttccatcatctctaccagatgaactctcatttcttctttcaaaaaataaaaaacccaaaaaacccagagatcccaactgtcctggtgtctgcatagtctgcagcacacgccccctccatggcccttcctccataagcagaatcactcctcactgttcctgcagcacctcctgtgtgcccacacagctgtcctgcggtgggctgtgtgtgtgagtgtgccccctctaggacctgagctccttctggagggtgggcacagcatccattcattctgggaatcctggtcggcaccatgctagaacttctgcaagtgagtgcctttggtgctggcccatgggagagctgttggtaaggcatacttttgcagattccagttgctgctgaggttgttgctctttgcacaagtttcttctagtcaccagtgaagtgacatgtgtggcaggcatggcccagggaggctttttcataaagaagaggttgaatctttggggctgtggtttgaatatgtccctcaagcttatgtgttggaaacttaatcccaaatgcaatagtgttaggaggtggggcctaatcacaggtgattaggtcataaggctctgccctcatggatggcttaacatgtttagtgaggcagtgggttagctattgtgagagtgggcttgttagaaaattgagtgcagccccctcttgcttgctggctaccatgctctcttgcttttctgccttctgccgtggggtgacacagcaagaagaccctccccagatgctggcaccatgccctgggactttccagccttcagaaccacgagccagacaaatttcttttctttataaattacccagtctgtggtattctgttatagaaacacaaaatggactaagacaatcttctttcatcaagttagggtaccaacctttaaagactgccagtccaaggttaaaggaaacttttcaagagcagtccaaacatgatctggccctcagctactctccagggtcatgccaccctatcacccactggctcacacagacgctgaccactgcttagtttctcaaactgaagttttcctcctcagagcttttgcaaaaccttttctttgcctggaaaactccccccacaaatctttagttgtaggttccttctcatcttgcagaattattagtttgctcttcaaatagtctctccagctagactatcaactccaggagggcagagttcttcttcgcttccttcacccatgtgcccactgagtccagaactgtatagcagtttgattgaaaaaatccacagggtggaggatgagaggaccctggatcccagcctcacagcctcttacttcacctgtgtgattttggtcaagtcctttattcttcctgggctttagttttcccttatctaaaatatgagaaaagttcccctctcctgggtattctgggagactcatgtaaaaggcactgagccagtgcagcacatctatgaccaggaagggtcagcttcctgccttgcatgagacacacattcccttcttcatgcacagttattcatgagttaaatatgtattgagaagtgggttctcaggagatgatgcatccacagcattgtttgtatgcctctgtctttgatgtccctgcctgagtcgcccactttagagcccttctgttcttcagaaaccagacttttctttcaatagtttcagtaatcaatcgatcaatcaatcaaccaatcaacagtgataataatcatgagtgagcccctgcccgtgctggctgtgtcctgctgaaggcacactaagtgctgcccttcccagaagcctcaggaagcttgcgaagctcaggtgcatggatgcctggtggaatgaggaagggatgcagccaggtagagaaatgccctgccatcacttgcatcagcatctgtgaagagctggccaggcttttgctcacagtggttgacacagtcaaggagcaagggccccgtaggagaggggagtcaagggctccgggtgggaatggagctgggggctgatgctggcttctggagcactgtaatgtgactgagaaaggtgaaggagccgttctgaaaaagaagaaggcaggagctcgcacagctcttgactcatcttgacttctttttcctgcttcatccaagcaggtcgactctctcgtgatctcagagacagagtgaagtcatgagtgggaggggagcacagaaaataagaccttgattcccagcattgggagactccctgctcccctgagtctcggaaaatagcacccttcaaatgttttagggatccagatttgatgaagagatgttattttggcttttagattcttaggagagatttgtctttctcaggtcaggaagaaaatgctgcccgctgcacattcttcgggacagactcttttaattattactagtttaatgtatgttttgcttagttaaggaaaacccctgtggtttcttgacgtgcttcagtattctaactcacagctgattcagttcagggggctggggagatgtcctcgacctctggaaaggagggtgcatctctagaaataaggctaagtatgccactgacactgtctgcataaacgtgtgtgatctcaggtccaaaggatggggcctggtctaagccagggacgtgggaaatcattttcctgtggcaacttgtgaagaccattctgtgaccttggtgtctctgggccttctcttagattttctaagttggctagtcagtggagctgccatccctcctttgcccatgttctactcccagagttcctccaagaaattgcggagcaatgcctgtttcatgagagctgagtttgctgtgtcttccacttagaaacaacactgtggaccaggaggacacacagctcccagggccatcaccacacaaagtgaaggctggtgaatccgaggcttctagcccttgccgggccaggcccgcagcactccgctccccaacccagccgctgctttgtcgcaggaacctcagcagggcagggtgtttcctaggaggacatccgattcccagccattcctttcagtgaatcacctgagctcacattcttttttcttttatttttgaagctcttagccaatctgcttcgcgatgaaccagttttgcttgaagcagacaaacccgattgtcaggagacagtgatgatttcttcagtctctgaggaagagttttcattttccccaattcgcaaaaaaagtcaggtccctccctccctccctctccgtagaatattttccatgtgtgttaacaatggctgagcgtggtagatgccaggaatttctgtcaaccctcaaagaggaaagccctgcctaatggtctgcccgttcttgttcactccctgccccaggctccccacccgccttctttctggaaggtataaaggctcctgcttatacctggcactgcacgcttcgctccctctgatctcctgactgtcatgcccagtgtctcagcctatcattctacctctaactcgaccttgagtgaccttgagcaagtttctcaggattccacctccaagtcactctccctttgggatatgcagcactaagttaagcttgcctggaaaacatcacttgaagctggaaaaccacttttaacacagcgggaaaagctatttgttcagacaggagtggggtgggtctgggcagagcactgctctaacttggccatgccgtggcagcagctcctttaatgccactttttcctggcgcgcccgcggggcctggagctcagaaagaggggaacgctccctcgtctctcaacagttgctccagacaggtcagcaaacatggaattcagaatgttcattaaacactggctgtgtcttttgtgttcaaaagcaagacactctctctgaaccatggccccacagagagtgcagaatgtgtgaaacctgccgggaaggtctggaccccttgcggggcagtgggcagcaccgtgcctccgttcacaccactcacatggctgtgcctctgcttccttctggcatggctgcttcttcctcaggtctcaaccatctccctcagatgctctttcccatgtttgtggctacaggtccccgtgacctgcagaggcagagcactcaccagcagcccagcctcgttgcgcacccatgtttgcatttgcaggccctagaaccactccaagctccgtgtggcgagatgcaccctcctgcccttcactggggagctgccctcctgttcacagcggcacctgagtcacacatctggagccatcctggactgcctcatttccccgatggggggtttccctgacttcatccatcctgtcttttgggtccccataataactgacatgggtcggcccgtaccagcccctgtgagaagggctttaactgccttcccaccccctgctcatcttagagtctctctatagtgctgctgaaagaatctctaaatcagtggttctcaacctcagccgcacattgagaatcacctgggacccttaaaaaaatcttaactcttggtccaagaattctattacaatcggtctgggatggggccctacaggtatttttttaaagctctccagttggtaatgcatagctagagttgagtatcgctgttctaacgtgcagatctggtcatgttaccagccttttaggtggtcttctttggctttctctatctaaagttcaaaaccgaacatgtgcgcattcagtgcacccattttcaactgtgcattaacacattcagcccaccagcaagatttatgaaccattttctgctgttgtatataacatatcatatgcataatggcataggttattgttttcttcaaaatatatgagatgtgagtccttctacgaactgactcacactgattgcccaacttcctctctcgaggtctcatcctctttccctgcagccgtctccctcttgcacgcacacacacacacacacaccacacacacacacacaccacacacaccagggtcgatgccatctaccctggacttcatcttgaactccttcgagtgtgagtcattactcctttgtgcacctctgctttctcttctcaagatgttcacctgcttgaggtcagttccttgagcgtcttccacttgccatgttcaccacagtgctcaacatgcctgaatgcatggatggcgacttctcagatcctcagtctcctcatctgggtaataaggcattgggttggcgggtccatctggtttcttccagctctgagagtgcatttgctctgtgattcattcgttccacaacacttcaccaattaaagagagggtacaaaaggtgaacatccttggctcccagcagatgctcctcaaaacctgaaaaatcagataggtgagggaagattgaatgaaaggcctcttatgattctgcagcaattttggtggtttaagaactctatggaaaaatcatcagtatttctggaattgaagtaaaatggatagtgagcctctgtgtatgtgaaggcccgcatctggaacatgaaagaacctgtctgatgtgttctagtcaggaaagcaggtagccaatactatttatagaatttacagaaactgaagattttgtttctactgattttcaaaatagtattatgtctgatttttttcctcagaaatatacttcctgctcttctcaacaaactcatttgaaaatatgattagaacatgatagaattttactcatttgccaactgcggttcccatttcacatattgttagaattctgcatggtggctttgccctttaaccactaactgataaatgatgtagttagcttttaaatgtgtggaaaaatataatttcaggttcaaccataggtcagaagtacacgtgttttgttagtctatttgtctctcagtcatctcatggaaaattctcagcttttggtatggaaataattttcttgaaggcaatatttgttgagtgactgacggaatgaaaaacgccagttgcgtaagtgtgaaaaagatctgggtgttttcattggatccaaattccacatgagccaacaacagcgtggtgtggaggctggagcacattaataagaacagtgtcctaaattcaggaggtaatgctctgcccatgccctgtgcagctcagacggtgtgtgcagtgcagtatgtaacccagggcacatttcaggggcccacagggagctgcagcttgtaaggtggagtgcagccaacagagcagagagtcagaatccccgcagagtggttgaaggcacaaggatgcgcagcaaggaagacagacttataggtggtgcgactgccatcctctggtactgaaggtgctatcatggagggagggaagtagattgaccctcctggctccagagtacggaactcagacaaacggtcagaagcttacagggaggccaattttggatcaactttaagaagaattttttaaaagctagagcaatcctaaaatggaatttgctctttataaagttgcgaatgcctcaccctggaattgcttaagcaaagttgggacgggcagttgtgagtaatctcctttccaatccatacccgcaatcaccagaaacgtggacttccctgacactgagcacctcttaattaagcatctcataagtgaacaaaacccagcccttcaaagaagtcactttatttatgtgtgggtctgcagcttggatttcttgataatgttaaataaaactccatctactcttccacaaacacttcaagaaacctaagacttttggccagagtaacaccgaggtttgagagaaaggatatgtgtgtgagaggtgtggtttcattagaacatattatttgacttcatgttgaatcaacacttttgtgcaaaatgcagttttaccagcctctttccttgttttggtcacataatttaacttaacattctcggtacttgattttctaacataaaatgggattgagaggggaattttgaagttcccatggtctgtcctctacattctgacagctcattatctctgcggtattgttctcacatttaagtgaggttagcggaggcagaggcctctcaggcctgaagatagcctctgttttcagggaaatactagactgtgagatctgtgacactgaagcactaagttcatctcacaaaagcaacgtgctctttttaaatggttgatcaaagttactttcaaaaggaagtgttagtttttgttattagccgaaacaagagctgctttaatgtagtatatttaaaatcatatctcaattaagatgttattcaaatactatttgacccaccaatctcattactggatatatacccaaaggaatagaaatcattctattataaaaacacatggctgggcacagtggctcacgcctgtaatcccagcattttgggaggccgaggcgggtggatcacgaggtcaggagttcaagaccagcctggccaagatggtgaaacctcatctctactaaaaatacaaaaattagccaggcgcggtggcaggcacctgtaatcccagctactcggaaggctgaggcaggaaaattgcttgaacgcgggaggcggagtttgcagtgaacagagatgaagccactgcactttagcctaggtgacagagcgagactctgtctcaaaaaaaaaaaaagaaccacttgcatatacactattcacaatagcaaagacgtggaatcaacctaaatgcccatcggtgatagactgcataaagaaaatgtggtacatatataccacgaaatactatgcagccataaaaaagaacaagatcatgtcctttgcggggacatggatggaactgcaggtcattatccttagcaaacgaataagaaaagaaaacaaaataccgcatgttatcacttataagtgggaggtaaatgatgagaacacaaggatacactggggcctacttgagggtagagggttgaagggagagaagcagaaaaaataactattggggtactaggcttagtaccagggtgacaaaataatctgtacaacaaactactatgacacaagtttacctgtttaacatacctgcacatgtacccctgaacttaaaaaaatttttaaaaagatgctatgcaataaaattctcaattaagaatttaacttggtaaatgttcatttaatgatctaaaaatatgtgtctggatggctctagcaaaaaaataaataataagtttctcagagatggtaaggctgaaataaatggggaaaaatctgaattgtaatcctttttctgttggacctggtgttggggtttcacacttgtgggtgaatgtgggcctcctgtgagcaccagcacaaaagactaaactgaacaaaagattaaatgtcacctctaaaattctgtgcaacaagacttccagccacagaatgtgcaactcagatttccaagtaaaaacacaccaggaagcagatcttagatctctgttatctccttggcaccagctggtattcatcctcaatgctagctagagttgaaataaagagtgaaagaactttctcttttattacttaataaacttccttttttgagctgttttaggcttacagaaaaattgagtggcagtttcagggagttccagcacggcccctgtttctttctcatggtccctgcaggtttcccctattattaacgtctgtcattagcatggcacatttgttacaattaatgagccaatattgatacattattcactaaagcccacaggttgcgttaggggtcattcttggtggtgtacgttcttcaggtctggacaaatctataatgacatgcattcaccattactatatcacgcagagtcgtctcctggccctacaagtcccctccttccccacctgctcactcctccttcccaccctccccaaactgtggcaaccatttaacttttgactgaatggatttattcttattctgccttattgtatgtacaccatattttaataagataaaataatagtctatagtagacttctgtaaatactcaatgaataaatacttgcatgaatgcaggaaaaatcaatcagtcttgcaggatttcttatgcgttacatcgtccttataagaaagcagtcattctcaccgagatgtgctgagcagatactggacatgttctgacccagataagggctgggtggaagtagggctggagacacagagacccagtgccaacttccaggacctcggaagaactgaaggcagagaggtcctctcagtgtggactgggcctctgctggcagccaccagcgggcacagagctgatgtgtgttatgccacgtggggaaaacctacagacgattctgagaaaggctcacagggacaccctctgcccctaaaagaacaatttaactctaatttatttctgtcactctgcattttctgacctttcccaagtgtacagttttatatgcatttaactgccaaattgtcatgtgagattatatggttatatttcattaatatattctagtttgttcagctgttcttactgggtgaatttgtgtggtttcctgacatttttgtttttagtagtgcctcagtagttttatacataattacgtttcccttctggattatttccttagtatctagttcaagaagtgaaatcgctggattcttgtggtaaatttttgaatttcacagtataatgctgattttctcaaagtctcacattctaagaaagtataatgaggcaaaacaaacaacaaacatcttaagttgattttttcctagcatcttttccttccatctttgcttgtagaatctagactatttcatgaacccaagatataatcagtatccttcttcagtatggccaaagtgagtttctcattattttacctccccttcaggaaatgacttttcatcttgtgttttgggagccatagatggttctgggcaggaaactggctttggatagacccagcatgtagatggctatttggccttgctcccagtataacgatgcagttccctgtgaaagggtatgagtaggttttggggctctggataccgtgtggcctgaagagacaagggctcaatgccaactctgcctgtttccaactgtgtaaccatgtgagcgtcaaaaatcatggacgtgctctggttaacactgagtgggagctcaacaaattattatttttaattgttacttggacatggccaagttgactacactttatgttctgctacctgccagtctgaaagtgacgccacagaaggtgaaccgcatgttgggagatgctcctcatctgcttaaatgaggtgcaaacacagcccatgcgcctgctcttcatgactgtatctgtaccagcaatatttgtattggcaaatcacatgccccagtgggaactacttaaggggaattcaatggatttcattccttttatgtaattggccacttagtaatagacgtgtaggtctcttgtgtggataaggattctgccttttatgtaagatatgtgttgcaattcagctttcaggtcccagccccgggaaggctccaggccttcacaaactggcccacccacgagaaggaaagcaattgtccaaatgtgggtagcttttcttcccactgttgtcagctgcttccaattagcccccatatacataatcccagtttgtgtctgtatcagtacaattctcccatgtcaatgtgaattttaagccacagagggaaaggggacagagaatatgctttcattcagctctcctcgtctcacacctcttgccctgcatgcatttctttgctctgattaaacgagcattttataagccacatttgctgtgtgaaaggcaaagtcttccctcccacggatgacggtctccagggatgtgtgtgtgtgtgtgtgtgtgtgtgtgtgtgtgtgtgagagagagagagagagagagagactgtaaacatatatctctgtgaaacttcattttccatatgtgaatttttggaaccgagacaaatggaacttagctaaaagatgggaaaggtagactgactctgacttaatctacttaacctaccaggcaatttataacttgatggcctaatttttgcagcacccagaagcaagcctgtttcagcacggcaaaggctcagctgctaagtgggcagcattgttggaggtgagcagcttaggctgactgttcatcaaaggaccaagcgcttgaggttcgctcatcgctggaggccagagtggggagggccatttaactgctcaaggccatggaactctactgtcagtttcagggaaatttgggaccctggagcacaaaccaaaactccaattaaccaggagaggaactcgatccccaggagataagtgaagagtaagaagtctatctttagaaacaagagatgtccaaggctagaaagatggggaaggagggtggaactgttctggaagtgggtctcaatctcagcaccagcagctctcaagactttctagagaaggaaacttcatttctgaattaaaattagtcttcaatgacatggcagggatttcggcacactctcttgcgtcataggccactgtgttggaggcaggagtgttggctttggaggcatagagattaaaattagagtaacacgtgagcactgaaaaggttaaacagtagagacatggaggactcccgacccccatgtacccctttcttaaccctttaattaagatcacagccctagaaatagcttgcaaaataattaactactgatcatttataccttagtgcttctgtgagcatgttttctctttcattgctgctcatctgcatggaaaaatgtgcatgggtttctgaatataactccatggtgcttgcttccattatatttgtgccatttggatcataactgataagcaaccaaagagtcccatattactgcacgttcccatcgctattttatgtgaaggtggtcctgggggctgttctgaattctcagtttccttttttcccctccccagttctttgaaaatatcagaaacggacttgtggcatctttgaaaagctacttaaaatgtgctgctgtgctctgaacttgaaaatgtgcttttaatacaaagtttgtgcagcccttgctgctcatacgagatgaatcttaccatgtggtggatgcccgtctcatgccaggcactgtgctctaagcccattggtttatttcagtgcttgaaattggctttcgagagaggcaccacggttccctttttacaggagaggaaacaccagaggatcagagatggagagtctttctccacaaactcacagaccccaaaggcaagctcagggttgtcagcttccaaagtctgcctgctccaggacctcatgttgcatctccattctcttcactgagggtcaaatggaaagaacacatgggggtcaagtttcagaaaataagagaaatgaagaaatatgtgcccggaagcaagaacgaccgacctcattaaactggctcccttcacctcctctcacatctttttctgccttttggccaagttttctctcccccgcatttcctccttgatctcgtttgaatcctcttccctggtgaagtcatttaggttcaggctcttattttactttggtccataatttagatcgaaccacatgtgctgatgtgattgaaacgatgtggaattctctggacagagatagaattatggaggggttagtgtgtgtgtttaagattaaaagaccaggtgtatgggaggaaatataatgaacaaaaaatagtattttaaatgaatactaaacttgcactcatggaaaaagttctcttcccatgaggttctcgcaaagcattttaccatcagcacacgcagtttttctcagttttctgagatggggccatcttgaatccaacagacaacacacagcatcagccagactaacacaaaggacgtcatgggcatggacgtaaatactggtgtcaacactaggtctgcacctcgagaggagtggagcaaaaggatggagtggcagatgaaggtatgctgttcagaaaggaggcagaaatgaaaggaagaccatcagtgcgctccacagcttgaggaccgtcctggagggcaaatgccagctgctcacttctgaaaagaaaaattccagtgaaatgagtacagtcattcttaggattactcacttgatactgtgtatgtctcttcttggcttctcatctccacacaaaaccctcaggtggtaaaaatctaattaaaaaaattatataaagtcttgtagatttattagcctgaacataatagattttttttaagcacgttaagtcttccatggactaaaagaaaacttgtaaacctaagagaacctctatttttgatatacaaaataatacatttccttaaactatgatcttgatactagaattttaattaaaaaatacctgcagtttatatgcaaagttatagattaatgcttaaaaataggttgtatgtagtatccacaggtcatgtttgactgtcaaatagatgtaattttaattcataataattgtgtcgtgttcttccccactagaagccaattatgcaagcttcaccattcacacatggaaaataatttaatggagtactcattgcaatttcacttatccagaattggctgttgttctcagagcagcttgtgttgccttgttaaggagaatatgttagtatccagacatccagaaaggatcctttactgtttcagagtccattttccccacttttgaaatacacacacaaacacccattcatgcaaaccaaacagagattgtaaagtgattccactgacatttatgcacttcttttttctctttggttcttcaaactctcagtcagtgcgcatttactcttaatttagatacggtttaaacctaattagaaaccagaagctcttgtatttccacaaaggattatgacagccccaagaaaagatagtgaaaccattatataacaagataaaggcttcttaacaatacaaggatggattttctcattgatcttagccttctgaattttagaaattgccatttcaaagtctaaaacaaaggaaaatcagggaataaaagaatggtaagtagacacaaacctactggctccatcatttctgttttagcaaataacctgccacatataccaatagcccaagagatgggcatgtccctgcatttcctggtcaaggtgacaacactgcgtcctcctggaagaggtctgccactcaccataccacaaaccaaatataataaaatcagaaggcacactatagtgaattttttagaggcatgtattgaaaagcatctcaaaaagcattctcgaagcttccagaagtcaactcaagttatctgaaaagtgacacttttgatgattgctcgcttaatactgggagagccagatgaagattcctccccacttcctcagatgtgcaactctggaatttcttagtgttactggagattcctgctgcattctgggcctttaatgcataaacactgagatgttctaaggaaattactccctagggaggagaggggtggacgaggagtaagctttgctggtgactcatgcgctgtgtggaaactccctgcacaagtgagctgcgcagggtgagtctaaagggttaatgcactttcaaaagcctctaatttgttattccagaagagtaatttactcactagaagtatctgggtggctactaacacatttgtgtctttaaaaagatcagttttattttaagattaaaaatataaagcaagagctggaaagtcactaaaaactgacagccagtttcccattttcaagagtatttattaaaaggttctggttgcagaaggaataagaaatggcttgagatcatgacacagtgaatcatgttgtaaacatgttagctatggctgtgaattcaaccagcgatgagttcaagcgtccccagaaggtgttgggggaattagggacatggctgtgtttccccagagaaaagtggccattttactttccctcttcactaacatgcttttgacatgcatggcagagctgaaggcaaggggaaggggacaacatagtaagtgactaagtggcttttttttttttttttttgccaagtgaagctgagtcatatggcctctgtcattccaaaactattctctacggctgcattcctttcgctcttgccttcctttagaaccctggagaaggcctcctgaagcctggccctattatgtatcctgacaaagataaacttttccaaaaagctgcatgttgtttctagcacagtttttcctcgcagtgactacgtgatgaaagtaccatgcagaggaggtgtctgactgaggcgttcgtggtgtgtgacagagtcccctgcacaggacagccgcactcccctcttgcgtcctttcctcccatgtttgcaaagcctctttccctgtcagcagggggtgttctggcagttgacatttctgaaaactacagcctacatttttaaaaaatccagtaagtgaaaactaaaaaattaataccgtggtcataatagtgtggcatttgataactaatgaggcactgtcgtgccagctattattttcagacatttacagtccttttttaaatacaaagaaatatttggtgtgaaatgttccccgggagctggtgcaagcagaggcgacagggcaagggagcttgggttgtagcctcgaattcctccggccagggctaccgtcagcctgcggcacacaagtaaatcaaatataaaaccaaaatttctgtaagcaaatcagtttctaactcactgtaacgaattatctttcgcacatcacagaggcatctcttttcactgtcgagtttggtttgcttggttacaaaaagggcagttcaaaagctttggttgctattgtgaaagtcagctgaattccttccaccgtgctggggtggggtggggttcacgcaggttctcttttgtcaccaggggtgctgtggattcacaagtaagcaagaggctcctcaggtcaagcctctggctgctccctgaggtcagctgcctagcttctcctcctctgagatagacgggaacaaagtctttgatgtgtgcatttctcaagcttgacaatgatacagctacataaaaacccatgatttcatatagatattccaaaacgtaaaagtaaaccatgcatccacagagacatggaattacagaactggatgctgagctggtcacttgggaggcaggcgtccttgccattggtttatgcctcagccccaccatgcagtggctggccaggtgacctaggccagtcctgcatcctcggctcctcacctgcctggtgggacagtgacatctctcctgcagcactgctgtcagggtgagggaggtagggcgcagtttcagaaaaccattgggctgcacctgcgtgagcacagctgcaggagcaaaagtcagaaaggtcagcaaaggatttcaggagcaaaggtcagaagaaaccctcaaggtggttgtgtctgcaggaaagtgctgtcgtctcctgcaatgctttcaagactattcagaagcacagtgtgaagggagagccggagcccatggggaaatgactccagagtgttccacgtgttggaaggcatctgttggaaaacggacattcaagcaaatagttgcctgcatagacaacgcagaatgactgggaaagccccaacaagttacctactggtaaatgaggtgagaagcttaaagtgagaaccccattgctgcctctttttcactttaaaaacatttaagttttgaattatggtaaaatacacgtaagatttactactgtaaccatttttaagtgtacggttcagtagtgttaagtatattcacattgctaaggaaccaatctgctacttttgtttattaattttttcctgaggggaaatatttttaaattttaaaatatttaattgacaaataaaaattgtgtatattcaaggtgtagaacatgatttcatatgcacgtacattgtatactcattaccacaatcaaagaaattaacacatccaacccacccatagttgccattgtgtgtgcgcggatgtgcgtgtatgtgtgtgtatgtgtgcacgtgtgcgcctgtgtgtgtctgtgtgtctctgtgtatacgtgtgtgtacatgtgtgtacgtgtgtgttcctgtgtatgtgtgtctgcgcacgtgtgtatgcatgtatatgggtatgtgtgtacgtgtgtacgtgtgtgtgcatgtgtgtatatgtgtgtctgtgggcacaggtgtgcctgtgtgtatgtgtatatgtgtatgtgtgtacatgtatgtacgcgtgtgcatacgtgtgtgtgtgtgcacaggtgtgtatgtgtgtgcctgtgtgtgtgtgtgcatgtgtggtggggacactaaaaatctctcatcacctttttagtcaaaagaacagttgttttggtttggctcttctgttttaaaatatcagaacaataataatttcccacagacaaaatcctcaatcctcaccatccttctatttcctatattcatcataaacttcatgcttgatgttgaaattgttttctgaaaatagagaatacaaagaggagattttaaaatgtcagtggcagccccacactcctttttaatcttatttcctgatatcttgagtttacttggacgtagagttttccttgactatggttatttctggtagtagcagctccagattaggcaatggttttcttcagagatagcttagagtgagccccagaacaaggtcaatgcgaagattgcttgtgtctgcgtgtccagggcacagtgatcctcatcactagccggggggctccgtgaggatctgctcctggtcgtttctgttctgtatcttctctgcagcccttactgaagccgttaccaactggcacaattcaattcctactgtacccatcatgcacagatggctgaagtattgagaacgctccagtgaccgggaggcaatagtctgtccacatctaagaacacacttggaataaccttagagaagagagagagagagagaatgcatggttagtaggttatcaaactcctatgacttttcacaggaaaagccctcatccacaccaactttaggaatgtgtagaaagaagggtcagggacaggggtgagtggtgggcagagcagttggagggcacagggaaaaggcatctggtcatgtatttggagtaggaggtcttgctttactattgaattgcagggacactttgggaacagtgttcacttctttttgcaaccatttcttcagagaaaagtcatgatactcaagtcttcttacaaagcagtttgaggctttgagtaccagactgattacagagatgagtatgaagcattattgtagtatttttaagtgaaattcactaaatgcaaataaacctagcaaatgctctatggttaatttttttctaaaattcagataattaagacaattcattctcctgaaactgctgttcatgtaaaaaggaattttatcgaggtggcccttgagtgccaaacagcctgtcctcagctgcaaaatgagtcgttgatgatcctccagcaagggatactttttagctcgtgtggtgattgctgcacacgggatatgtgcagcaagtatctgctgagctaataataaacagcctcagacagaaagacagtgggcacaaggtcatgcttaaaaagaccccttgttctactgcatcccagctccccaccatggggcctcacaggccctggtgaccaagcacatcagacctggttcttgctcagtcctgggagccacagaacccagcacgtactttacccccaagaccagactccagcttggcttttgtcctcctctccaggattggtgacctcctaggtcgtgaagctgtgatgagcaaagacacactcctctccattctcccaacttcaggtccctttgacagtgtcagcaggcatttaaatagcagaccacccacagcagggctggtagatgcagtgaactcaggaagatgcctgcatagactctagtgttaaagacagaatccttacaaggaacccccatagttacctaactgctgtctccagtggtcatagaagtgtgataacccactaatcatcattctctgtctctctgtctttctcatacacacttacacacacatacacacaaccttgttgcttaattttcagagagtctactttcagaaaagccttcaggaatacatcatgtacaaaactgagaaattacctgaagtatctttaaatttagtaaaaagttgcattgttttttgaacatcacacttgaaaagtacatgaatacaaacatacttaggaaaaaaagctttaattaatttaaaaaggagaacaatgctatatgctgtatcccacctttctctgaatgttacattttctcccctatcccaggctgcatctaagaaaactcagagggaatatgctatctatcttttccgagcaatgaaagctctgggttttttccttgcttttcagggcacaatacttctctttcttcctggttagacaggataagttctgagtcccctggtatcatcagcttacttcttctctgttaaatattcacaaaaaatcactaactttcatgcctcagcaaacctccactgcctaaaatatagtgaggtcattcatcttcggacaaattgccccaactacggtgggaaaagaaccaatgtgttggactatttatctaatttttgtttagttcggggatacaaataaatgcatagatacatacaaacatgcgtacataatagcagcagcagcctgtgaaacattgacaagacctggagttggaagaggactttgccatcctccagtccaacagttgcctgtcacagattagacgactgggatgtgcgcaggcgattatttgcaaacggccctgagtcccccagtttatgtcttaattcgcagccagggctgattgtagaagcaaatttgcaaacatgtgcaagaagaaatcacacatcctagagcttggatttcctcgtttcttgctatttctatccgtagacagaaccattgctgagctgttaaatttgtctccttcccctataccagtcttgaaaaaggaaaggaagtggagcaaagaaaaagaaattaataaagccggcagatcctaggagaatcttatttaatccaagctttgtaaagttttgctttattccatggcaacatgggtatacacatcccaccggctgtttcagtggctcagagcaggtaaggcctgtgccaaacgccgctagcaggaggaacaacgtggagacagccccagaggtggaacgttggcccttctgtggctccggtgtctcaggacctccctaaagcccagccctgacactgagcaagtttccaccactgttaggaagaagtagaaaggaatttggagggttggtgttactgttcaagagctggaaggcttctgcccccattcccattccattaattgcgtgaggtagagaactcatagaagataggaacacatatgctgatttccaaaattgcctttgtatattttcacgtgaagactttaggggcaaaagaaaagaagcaagcattttgaatatgtgtttcaatttgccttctgttatataaaattgtattttgcctattcttttttcattattcggaaccttcaagaaataaattaagttctctcaaaaatgtgttttttgaaaagaggactaaaacagatggcctggctgtgttaaacacagggaccagaccagcacccacctctccacctgccctgccttcactggcagaattgtgatccatcatgttctctgttcaatgtcatcatccctttcagagcatgggtctcttcctttctaggcagtcttaccaggatgcatgggtgtgcctgcgtaggcacacgcacagctcccaaggactctaaaaaaagatatttttctgcttatatactaataatatgttagagatttatgtttcaaattagtacagaatcacatggttctctccaaattatatttgagagagaaagaatagaacaaaatttattttacaaaaatactcagtacatttagggcatatacaaagatgttccagaatgtagcttatctctttaaagacaattaacacagtttctgggcaaggcaaggcaaaatattcagtaacttagcaacaccaacagaagacagccaatattgcagcacatttttctcttggattgggtcagagagtactgcagagaaaatggagtagagagacctgaaatactttcgcacacactgtggtcagtgcagcgtccactgtgtgccacagtaatactagaaactccctggttaggccttggaatccagctctcatttcgtatgtgacctgcagggaagtaagttaaatgcacacgttttatcaagttcaaatgcaaacttaattttaaatgtatgcaacatcagtttaagcgttgtagctattactagcaattgtacctattactagtctgtactctgcacaactttggagtatactgcctactcaaggtggattttagagctctatttgtggcattatatcacggacaaaagcacgttcatcagagtcagaggaatgtggtgcaaatcccagctgtcccacttaccagctgtgggacttgagtaagctcctgaagcagctgcacctgcattttctggtgggcaccatggagctgtcagcagtgctttcctcagagggctgcgggctggatgaggtttgctggtgcatgtgaagtgtcaatcattgctctcatgagtggtgatgctgatgccgttcccttttttagggaagtgattttcccttacaaagttaccaacagtttcatgttggcccatttttctattaattgtttccactaataggaccaacagtggtagtcccatcattttattactgcttgtcgtagcacaagcagttgcttcattgtgtttagataaatattgacggctgcttttaacagtctgctgttttgtctccttttgaggtccttaaagtaatccttaaaaagatagtgcagatggaaagatgtctggagtcagtgaacctgccttctttcctgtgtgcttgtcagtttctaaaatgccatacacaaaggactttcatgatttctttttaggtacatgattacagttcaattcacttcactgtctggaaaatttccttataatcaggatgaaatttctcatgttagcctttcacatttcactacttttagataaggaattctcaggctttgctatatctgactgctcttggaggctgagcttttggctaactacctgactactttgtcgtttctcttcccttggaatgaagcaaatatctaacttctcactcattgtttctgctattttaccatttagtcatctgtgatttttctaaatactgaaagacttccctcaattcaaactatgtgccggatcaaggaaagggcagttggatattgcagacagcatagtgcaattgtgaagagtgtctgcttaccagccacgctgccttgcacaagttatcaagcctctcaacccacttcctcaatctgtaaaataggtatgagtgtaggaccttcccaggggatttttttgtgactatagaatgattctcagaagactttcaggcagtatgtgggtgaggcacatgctggaaaggcttctgcaggtgcagtgatcaatgcttttctcagtgtgtacatcccataatacagacacgttaccagaaactccctagccaggactttgattgcagctcacattttgtatatggcccatagggaaatgaagtgtgtattttttataaagttcaagtgttaacttaatttggaatttactatcaaatctcagttgttatgggcatttatagctattaatacttcgtcccatgtgtcccatgaggaaaccaaggaacagaaattaaagttctttctggagtcccctgaatctcgttcctgttcttttgcaccctgttaattacatagagacattcacagctcttctgaccttatcagcgttaaggaaaacagaaaaccagcgtgctatttgttctgtcccttagtcaagccttctcaacatatatttttcttccaagattttgcatgtgcacagggatgcctatcctctacaagaaacacattttaggcaaattataattaaaatgctgtttacatctcttcacctttagaatttaaagaatgatcatttcttagattgcatctcagacacacccttcccctagtctggagagggcgaggcccatgggtactgcaaacagcctgacgttgtcaggggcggtctcaacggctcattcaccacatctgcctcgcgaaggctaagccatgtgctgttacccctgctgcgctctggctcattctaaggtacacgctattaaccttgtgagaaaacaaagaggccagccccacccttcctgctcactctgagtcacggtgaaaatgtttcaggatctcgggttcgaccatgagtcctgtccaggtccaggaggaaattcggaaggaccacatgttcactctgagatcccactttcatttccctcctggttgagcagcattaatactctggctagatttaaattctggctttctccagttagaactgaaagttatgacaatgtaatcaaaatagaatgtgggtttacagctggccccctggcctggtttgtgaacataaaacagaaacagaaagtgtaagtggtgacatcatattctctcattcaatgtgaaaggccaccgaagtctttccagaattatttttgagaataatatgaatttttaaaaaatacctaattattttaaatatcgtcttgcttgctccccaaatacctactgttttcaacttggatatacgacatgattaaagaatatctaatatttgggaatgcatactttaaccttataaactaccactgtaaatagacagactcattaaagtgaaaggacattttaaatcaattagtaagcaaatcaattaggtggcaaagacaagattatttttccttatggtagttgaagaataatgcttaacctgtcattctaattaccaagcacggtgttctctttggaagatcatttcaacaaaacattattttcatccagaatttgaaccttgagattgcatggtattttagaaatctattttagaaatctttggcaaaggttactattaaaacaatcacattcatggaaaatcagtataagagcaactaaaataactcacaataccagtaaaatcactttgtcatcttcttaagacttttaaagagcatttgtaagtaactgaatagaaggccaaagggtgtgtaggtagcccagaccatcagtgggcagccagggccagggcaggggccacggttgcagcctgcattcttctaaagggcagagcaaattaaagttgaagcaggagctaaaaaaaaaaaaaaaaatgtttcaaagaattccaccaaccagaggatactacctaggacagtttgggcctaacttatctgtgaaggcctccagcttcctccacaccggtggccacttttcattcactctgaacccttctttgtatggaggtcattttattaattgagctgtgaccaacatgacagaatttcctgttttagggcttttataatatagatagtttatatctaatttcagaatatattcactggggaatggacttagcaaccactaccacaacaatgcaacaatgtgttttggaacaaatttaccaatctgaatttccccctagattaggtcacaggaacattgcagctgatgtacagctatgttcctcctgaaacttggagacacatcctcttgagctgggttataatgggccacccaaagctcgagttcctgtaatggatacactcaggcagcagaacctaccaccgtagtgaggacagcacccagagccctcagaggccatcacaagtgcaccacagctgccttctctggcacgctcagagctacacagtgtactctgggattggaactctttatttttttttcagttgatttgtaaataagattgcacaaaaatccatgcacatcaactctccaaatcagaatttgctgagctaaaaagagcattaaattagatgggctggctttcaaggggtgggggtgcaatagtggaactctgcacaacagttctttacaaagagacaagcaagcacatcgcgtggaaatttccattcaactggaaatgtccaagcctgtttacctcaattaattgtccttgttcacttgtccagcctagcaattgtccattagtaatttgttataaatgagacatttggtattaaagcatctctttgggatactggtatggtttattataacattctgttagtagtgttgtacaagcttgagatgtattaatacgaaatccaagctgcatgagggctttatttttcaagcctacaccttgctgaaattctgaattaaaatatgattctcagtacaaatgaataaatcaacagaaatggtaacgcatgtcaaatattcttaaaacccaagaaagccttgtaacttccttcaatctaatgggaaatgcaggcaaatacaagactgatgtccttgagttttattatcaagactcaagggcaccagtaaaatctagtttcattggttggaaaaaaaatcctgataagcactgttaggcatattaactttaatgattacaatttttaggacactctgtggcctagacttagaaacacaactaatgtccagaaaaagattcctctttttattccatcatctgataggcctatttttacacatacacaccaaccaaaagtagccaagcaaacaaaacaacatactcacaccccttcgcctattatcatctaggtgattttcaatgctcattgcaatgaaacctacttattgtgcatggcacccacccccactgaggaatactgtagtttctttccctttgaacttcattagtagagcacatggttcattcactcctgaagagttcttcgtatgtcagaatatatatactacaacataatttccatcagagctctgaccacccgcttatctattttcataatgcctgccactccatcattagctgttgtcatgtaggctatcaataaatatatgacaaataaaacagttagggaatgagggaaattgactagcagccaaagacctaagccatcctctgcttggacattagaaaactgagttcactacagtcataagatacacaaaggcagaatgtaagccatacaaaaatccatgtcaatcccaatatgtgagtacaactattgaacaccatgtactaatggatgagttggtaaatcattcaatgtcttcatgaggtcaattacagattattatttagaccccaaagattccaaagatggtatttcggtcagatcttcatcctttgtaagcctagcagaaaatatggcagttttattgactactattctttgctgggtgtggtatttttaaactgagacatcagtgtgcctagcacagggcctcaagcacacagaaaaattccttgataataattaaataaaatttcagcaaaaaatatcatcttaaggctgtgaaattatcttcctgtgtggctaaaatagtgaataaaattcagcgcaatataaatcatagtacaatttcatcactaaattttctgatcttgatcttgtcattttacattggaagtaaaaatgtgtcctcctttttttctctgacagtgaaaagtgtgtgtgtgttgtgtgcccttttgcacaccctgcctcacacttgctggtctaattccttccagcatgattatgatataattaaatgacagaaatgtttacttccaagtggaactaagccagggtaactcagggtagggcagctgcttgcaccgaaagaccaagactgctagagaactaggaaacaggcggtgcaagaactccaggctctcatggaagagcgggaggcttctatggggctgcagaaactctttggtgcttggggaaaaaatgggttaaatgctcttaaaaaagaaacctgggagaggtagtttccagatgcaggcccgtcttttcttttaaacagaggcagctccgaagagctggacattgaaccctgagcaggaactggaggccgtcagcgcagctttgtttggcgagcggagctttgcaagggtgtaatgctgcaccagggagacgctatctgcagggaccggtgacgccgtgggtgtggagggggaggcagtggctggccctcttggggtaaggtacgcccaggaacagtttagaataacgtgcgcgagtcaaagggaagaagaagctcctgcagaccttctgggcactgtgcagggtttgctcctgtccaccgtgccgtgttcctgtcctggggtatttgggtgtgtggcgtgtggggaggggagaaggagcaaggcggcagggaggggatgaggaccaccctgtccatgggacaggccctgggccccgcacacaccccaagccccgcgtcccgcgtcctcactgtcctgggacaccccccaccccaccccaccgccacagcccagagcggtgccaggaagccgcctcgacgcagccgtatcttgaggctccagccccatccccagggtaccacgccacgtagagacactatttttcacttcgtgtttgtcactcctaaagcatgtgtgctagctgcaccaaccctgggatgcctcggtgcatagggtttatgtgcgtcctcctccttccctctgagctggtcccccgtggggaactgctgcccagactgacctgcgtccttccgcacgtgcaggaaaatgtccacgtgcacttgtcagggtgggggccacacgggcaccaccactgatcatctgtgggatcgagttactgcccatgcagatcccacgtgcagggcccagtcgctttggtgagagagtggacgctgtggtgactccacggtctgtggctgtgctcaggaggacagagaggggacatcctgagatggtttgggcagcccgcggatcctgtgcatgtccccagagcgtccactttctccatggagcagtggagtggcgttgctgagacagaaagttcaggttctccactccccatgcagcccccactcccctgtctccggccaggcacgcgtctggggtggagactcccggtgcccggggccctccagacctctttccccaccccagggagcaggcgggtacttctattccgtttggcttcagaagggaaaagagaacgtaagttcagggagttctcgtccattcctctcccgtgggccgggcaggcagcagggacagccttcaggagccaggaggggctcgagctgcgaggccctggaatgaggcaggcatgggctgaggctggagggaaagccccgctaaggctgggcgggggcgggaaaacttaccaccaggggactcgagatggggaaggaaaggtcagaagaggagaggccaggcacggggtgtgggcggcctgcagagctggagcaggtgctccgcccagagccaggcatgcacactcagagtaggtggcctgtgcagcggggaagaggggcgggtcggcgtgctgctgaagatgcaggagctgcggcctgctctgtgcgtgctgaaggtgtggtgagaagcacttacaaaaagaaatggactgtgttaggattgcacattttactttgtttctcccaaatacgtgttctttgaatttttttccttccagggccaggactggagtgatggttgagacaggcacgcactgggtcttgtctgcatttacattttgagattttgttcagcatggattttatggcgtttttttgtttgtttgtttgttcgttttcaaaatactgcacggtttatcgtgaagacagggtcctttgctgccgtcttaagttttgggcccaagaacgtgccccaccctaggcccgggcctgctggcttcatagctctcatcattcccacggaaccttaagacctgaggacagaaaggaaggaaacaagcccagtagtccgtgaaaatccagggtcccgccactccaggtgtctgcagcagagctgaacacacgtaggctcttgccaggaggggcatttgtatgtgctgagcattccttatattctcaatatgacgcctttgaaagatctgtggtttgcaaatatttactctcagtccataacttatctttccaacctcttaccaggctcttttgctgaataaaagttttaaattttgaagtctaatatatttttaatttttttattttatggatcatactttttgtgtcaggtttgagaagtctgcaccaaagtatgtcctgtggttttcccttaggtcatcttcaacaagtttcatagtattttgtttagatgtaaatctgtggcccattttgagttagtttttgcacaagagttgaggtcaaggttctttttttgcctgtgatgttcagtggctctggcaccatttgttgaaaacatgatagccaatgtcaagacttaatagttataataatcaggagcttttgtttctttttgttttgtttttagtaactgccagtcactgcttgtggtatacatacacaatggaatactattcagtcttaaaaaaaaaaaaagaaggaaatcctgtcatttgcatacctggaggacattatgttaagtgaaataagccaggcaccaaaagaaaaacattgcatgatctcactccttcatggaatctaaaaaattgtattcagagaagcagagagtggaatggtggttaccaggggctgggaaggtgtgagcttggggagatttggtgaaaggacatagaatctcagttagacaggaggaataagttaaagagatctattgcacatcatggtaactgtagttagtgacaatgtattgtatacatgaaaattgctaagagagtagattttaagtgttctcaccacaccaaaaaaaggtatgtgcagtaatacagtcattaattagcttgatgtagccattccacaatggatacatatatcaaaacatcatgttgtataccataaatatatactgtctctttatgtaaatttaaaaataagataaaataaatgttattcacttgtcgtggatgtggtggggacaggtgtgggatagccctccctgtacaactaggacccaggggtgatctagtgacactagccatttatcaggacgtatgggtgccagtcaggatgataaagcttccttttggccactatactacttagaaatgccctgcaaaaggtgcacatcaaagattgaaagctcaatcctggattttaagtgcttcaaaagtgcacttaattgccacatttttgtcaaacattttcccaggtagtatttttcctcatgtaaaacaacagcaatttaatttgaacagaaagcattttgaaacatacttttggcagggttccttgcagatcagaatggaaatgattaacagggcaattatcaatcatggacttttggcggcagaaggaactgtattgtttggtacagtctgggccagggccacacaccgtaacggagatactctattctgtggacggttggagggggctgtgctgagcagggtaactgcatcttttcctagactgttcacactgctgccacgaaggagtcttgtttagactggacctggctttcttcttcgcaatgagtgttgcagactcccgacaaaggccaggtggtaaagtgtggtgtctgtgagcgagagcctgagatgcctgagctgacctgtcctcagccacctgccatcgtgcagaggtgagagcagcccctgaattctgcccctcggtctctccatagctaaagcaaaaccatccttccgtgctcccaggacaagcaggctattaccaaatcacccactaaccctgggcgaggaggggccatcactgcacaattcatcagtgtctgtgacaggaagagattgttttagactggtttttttttttttatttgcaagcttttttctctctccaaaacgtgctgtcagtgtgttctaatttactctgtaaggaattctggagctaatcataggctcacaaaaagcagcacaggaaagtttcccagataacatctatttcagtggctttcaaacatttttgaccttaccaaagtaagaaatacattttaatatcatggcacacatacagctgtatctaaactttcataatactgcctttacgatatcactctgatattgtctattcttttctgtttatttttctttttgttccttgttatgctggttgtgacccactccagtgatttcacaatgcaggctgggtggtgtcccacagtttgaaatcccaatctagggccttcctctcactgtacaaagtaggtaactggggacattagtggatcagtgatcaaaccaaagttatttgatcttaccaagtgatatcaggatgagaaagctgttagagtgtcagatatgtgaaggaacttgggtcattcctgatacctcaaagagaaaaaaggtagtccttgaacacctcctacttgtaaaggatgcacaatcctacatgcccctccctttcctttcctcccctctgtaccccacccctgcccacattttcttcataagcagctttggtgttttggcttgtttgtttcccttgtctcctacctgtgactttatagccttttggagactcacagcaatagttgtatttaaactcagtgggtggcatccaaggctaaaaaggagattgcctagacacaaaaccacccaagggagaaagcaggacagcatcttactatgattgtttcttgtttcttcctgtctcataaggattattacccagggttttcatttttttcatttcatggttcattttcgctccagtgtagacatacaatagaccactcgtccctgtggctccgggcagcagcctcatctgagaccctcctgagacatctcgtgcagggcagccgtagtgtgtggcttccccagggctgctctaacagatcaccatccttgccatggcttaagaagctgcagatttatttgcttacagctctggaagccagaagtccaaaatcaaggtgtcagtagagtctctctctctgaaacctgctgaggatgatgcccctggcctctccccagcctctggtgttcccagcagcccttggcattccttgccttgtagatgcaaaactccgatctccacctctatcctcacagtgagttctcctgcatgtctgtctctgtgccttcacattcctctctgtgtgtctgtgtttccatctccttatgaggacacccatcactgaatcagggcccactctataccagtaagacctcatttcaactccattacatcttcaaaaaccccattctcaaataaggttacttcacaagtgctggaggttaggacttgaacataccttattgaacaatccaactgatgacacatagtaatttatgcactcgttcttggagacgttgactttatttagtagcattaaccatggcaatgtcaccagcatcgctgacagcctgaagcatatgatctccagaatgtatttcaatcatcatgttcacttccttggtattctttagacaataactcagccttgaactccagtaaagggtttccctgggattttcttcttgactcactccactgtggcctccctcatccaggactgtaacagacgcctgacgtcagtggtctagacctctctgctgaatgtcatctttggtgaatgtcttatgagaaaacacatggttggtcactcttagaagggcatgaaagcctgtctgcagtataaccaaaacaggcacatggcgaggcacactgtgcgcatgtgtgtacaattaatatcatggttttaaattattttcaggccaaggggagatctttgctgcatctactgaagaaagcgaatctttttcttcctgaaaaaaaatggctacttattagtcgaatttgtgttttaaaaatatgtgaactaatataatgcagacatgcattaatgtttaaatatactggaagtttttggtaaaatgaaacccattgtctctgttgattactttgatgagtcaagaagtaacatcctgggaatgattggccagtttaaatgagtgcctcaggtttttggaatacaagaaatcaagaggaagggattagaacatataggttagcaagattgggatcctaaaatacagacccaaatgaatggaacaaaatcagggaatttattaataacagggtcaaggccaaatcagtaacaaatatcctgagtggaagaaaggtggtttaacaaatgcccctatgaaagatagagattggcttaccatgatgagatgtaagcccaagttatgaggttggcacacaaaaccacaaatgtcatagcttaaaacaacacacacttcttatctctgtttctgtgggtcagggtctgggttctcagggactcacaaagtatgttttcatctggagctccaggtcctcttccaggctcataagggttcttggcagaattcagtttcttgaggctgtaggactgaggtcctggctcctagaggccaccctctccataagcagttcttagcatggccgcctgcttctccaggcccagtgggaaagcatgtgcctccaggagggctcagtccattcttcatggcttttacctggttaagtcaggcccactcaggataacttcattttgtattaaatcaaaaccagctgatttgggatgttaattacatctgcacaacttcaactttgccatataacctaaccatgggactgatatttatcatgcatttgggtcaagttgcattaagagatataataaagctggacaagcttctgttgattagaagagttcagttacaaggctacacttgggaggaatgtttacaaactggaatggtcagaggatggggaagacacttgagaaaagtcaagtgacggatgaaggcaaatgtggatatttatctgggagaaaactaagaggagttataatagctgtcttcaaatatttaaagggcttttattaggaagaggaatttggcatattggattttgccttcagagaagtggagtcctgagatgctcttagccattcattccagcctccagggctcacctgctgtcttctgtccaggttctcggtagcagggcagtacagccccatccgtgatcttccatagtcaggcatattgtcacactcagtgagcggagagtcaaccgggaggaaggcacagtttctctggaatgacctacggaatggtacgctcaaatgcaaattctccttcccttccccagtccttgtccttcagatggtaatttaggagctgaaggtcagggcaccagcagcctttggaagcctacaggacaacagtcagcctggctagaaaaaaaaacaatgtcacaggcatgttgtgtttaatcacatgaaggatatttgcattgttttccaactgatgccagcagacacattgtcagtggtatcatgcctggggtatcagagttgacattgggttgccccttctctgaggcattcatgtaaatccttttaagtttataaaacctccatgtggctcctgcatgcttcatcatttgcatgtgtctctttttccaggggaggcagcatggggagcaggatgctggtgggctccaggtgcagagagcagggtgggcgtcagaccccaggtccactgtgcacgccctcttgtagagcccgttccgttgtccatgagatgaggagtgttcttatctctaaagtattatcatgaaaacctaacaatgtagaaagactaaagcacatgggtggtgcttcataaatagtatttctcccactttctgaaaactcctgctgaagtaactgcacaagaatccttgaacatttagaattctggttttagccataccataaagtcagtagtgcgtggtggaattctgctaacgaaaattgcgaaggatcaaggcagagtacagagctggtgtgtagcgggtaccttctgtctgctggcactaggtattttacacattaaatcagctcgttctcacatcagctcttttaaaaataaggaaatgaggagccacagtggcccaactgatgcagtggcagaagtagaatttgagcttgtgcagatgtgcctccgtgttttgtctcctgagcatgctgccccaagtttgacaataccaagatttgtactggaacattccctcccatccccaccccctagaagcccctcttcctcccttagatttgacacatagtttgaaaccactattaactaccttatgagagccactgtttgtgaagtgctgactatgtgccaggtcccgtgccgtgcaatttttgtgaattatctcgtgtctacagtgcctcacaatttctctgctcaatacctccatgttactgccgaggaaagggaagctcagagagagtaagtaatttgctcgagttaaagagctggccaggacagccaggggcttgcaccccggagccttcatccactacactgtcagctggtatctcaaccagccattacaggctgtaaaaaaattatataagatagtctatggtaatgcagaaaagtgaggttattttgctccctttccctttgaagaaaaaagccctggaaagacatatcacttgagtatgggaaaaaatgaagctgtggcttttctgtgagtcaattctttcctggcagcttcttggaataagaccaagtatagcagcagagttttctgttttaatttgagctgcagggtgactttttttcttctatgctttcatctctctgtggcttcttttgcctcgttaatttcatgccctgcccaggcgggctactgtgctgcccagtcacccgggtctggggcggccaccgctggccagcaggcaggccctccagaggcagaggtggccacgcttaggtcgctcccgctgtggaggcggcacacttgggtggcagcacagctgtgatgtggcggcagctggcagccccatgggaaagatgtgtgaagtgtggggtttgacgacccatgggagaacagactttcttcctcttcttgttttcccttcaaagccgtgagtcaacctcaaattctctgtcttttttctccaccccctcgtgcctctctccctcacgctctgcatctctcattgcaagcttgcatttttttgcacacaacactatcttaatatttctcttttctgcaggcaggaaatgagaagtcatttttcagggtcattcaggaagtcatccagagttataatggcccattatctactggtcagagtttacttaggctttcactacttccactgcccacttgaaacagggaaaaatattttccccccgcgctgtgagtgtgctatttagagctgaccacaagcggggggaagagaggatggctcggatgctgcatttccactgagaacacaaggctggcaaagcttgtctgctgcccagcaagcacttcaggctcacaccattttaggttcactttaagtagtttctcaattgttaaaaaaaaaacaaaaaaaaaaaaacctgtactctgaggatatgcttataatcccatagctaacccagaatttcttagagaactgatcaacatcagcagtggcacttactgaaaatgcacattctcaggccctgcgtagggcctactgagttagaatattagagagcaggtctcagaaacattctatccggcagtcttattctatgcacccgaagggataagagccatgctttcatgaaacatgggttgtgtgtaaaatgtttaaaaggtatggcaaaatgtgtttgattggcaccaaggatttctggttcctcctagaatcattaatcaaactttgaaggagaaataagagagtcggcattttcttgcacattctttgtgatgttgtgatgagttggaaacttcccgattgggtttattagagcatgaacacccaggcacccagcttctagccagccctgtcaggcagagtctcctcgaagatgtggaaaggactgaccaacagctgaggcctacaggaacctgagcaggcaaggggagaggcaccccggaaccaggagcaatggccttcccaccctccctcgtcctctcctcttctccttttggagttgcaggccacagaaaggaagtgacatgagtcactttgggccttcttaattccttcatcaaaggcagcacaggtgtgtatgtgtgttggtggctaattgaggtaggcccacagaggagataacagatggacatactatttcctttcttccattctgatataattcagggtataaacacacacacacacacacacacacattctcacttctttggcatctaccacacctgccccagtgcccatttctctcccacctgaataaaaagcccccacaaagcctgaggtacatggaaaggagcagtggtctggctcccaggagtgtgagaagcagccatgttttcagaggctgtattccacttggacttggccctacgctgaaggtaggagcggatgggggaggcccccttcgcacaaagagccccatgaaagagtgcacagtccagtctataaaacagacgcagaaaatgtgtgtaggacttcttcctgaaaaagagcgtggtgcgtccagtacctccatgttcatggaacttcccagtctgcagtttacccttttgtgcaactcccttttggtaaagccctggtcacacttctggttgttcagattatacagggataattccagagtgattttaaagtcaactgccaggcatccgcacttgcaaattagatgcctggcacatgcttgtgttaaggtaataattcattacaatacaaattacaggggagttcctctgggcatgcgacctttcccgtcatttggctttccctgtgattatcaggggagcttccatcgtgctgctaatgggaccttaaccatgtgtcaacccatggctgtaatgctgacactgttttctttctggaatgaaaggccttcgcaattgaaaccaaaatgttatccaactcagtcctgtccctttgacgatgaaaacatcaagttctggagactggccatccagcctccctgcctcatctcccacgccctccatcattttttgtctctacttacttatttatttggctgtattttacgtacatcatgcaaaaatattcctctttgtaaaaagtataatgatttcaggaaattagagggtaaaaagcaagaaccatgctttcactccactgtcaagagttgtggaagaatccttccagcattttttctgtgtattttacatacatacaaatatatgtacaaataaaggtcgatcatttaggttttgtttatatttttgtatatatgagcttatgtcattcatacatattgttttgcctcttgcttttttttaacttaattttactttgcttgagagctttttgaactgaagtacgtgtaagtcagcctatgcatgtaatggctccctcatcttctgtgaggctgtcactaaaaaggggatttagcttgttctgggctttgcagcccgtacactgggcactgttcatacgtacttctctgtgcacgcaaaggagggcttgctagggaggcctggcagagggtgccattcaaataggattttcaatggaggaatttttaaattttcagttatttgaataagttttaatatatatccagaaccccaaatcatcaagtttgttttcttccacatctgtccttccatttctgaactattttaaggccagtcatgtctcatccaagaaatcccatcctttcacacaacactatctccgtttcatggttatgaatctctaaaagcatgatttttaaaacataatcacaatgctgtcatcgaacttaaaaattagccataaatctcttatgttacccaacaaccagcctactgacacatctccagttgtctcaaaaatgtgttttccattgtggtttgtctgaaacatgatccaaaagtcagacccacctctcacctttccctaacctgccggagcccatgtttctttccagccaggcttggagaccaccacacgggatttgcttcttggggcctccctctaaccagctatgcaggatgccctctttcctgtcaatacaagctgctcaaaggactcattcagttcaaattcacctatgtgagcctaggtgatgctacttatttatttatttatttatttatttatttatttatttatttattttgagatggagtctcactctgttgcccaggctggagttcagtggcataatctgggctcactgcaagctctgcctcccgggttcaagtgattctcctgcctcagcctcctcagtagctgagattacaggcacgtgccaccacgcccagctaatttttatagttttagtagagacagggtttcaccatgttggtcaggttggtctcaaactcctgacctcgtgatccacccacctcggcttcccaaagtgcttcatgttttcaggagctgtacgtgcatttttagttttgatgaccaggtcctttttctgttttttaaagaacttcaaatgatctccagggtacacagcgcttgtgtgctgatgaaaaagctggcagtacaaaggccaccagccaaggtcacacagccaaaaagcccctgacctcgggccccttcccagaccctgggtcttttgctgccacatgaatcttcttcaaggtcctatgtgtagattttcttgacttggccatattatttaggattcagatataataacaaaatagatgttaaagcataacatgaaggcatttaaaagggtagaaagcacatgatttactaaaaccataaatcttatgacctgaaagtttcacctaatctcttaaaaaataccgtactaaaccctgattgaaaatcagagctcagacatacagcctgagatgccaaaaaatggccaggcttgtctgttgagaaagccatatgtaactaactgtttggaaattcaaaatatatcttatcattttaaaaacatctttcttctaaagacaatcatcttggcttcaggaatgaggctagtaaaaagtgaaatactcctacttgtggaagaaatcctcattttaaccatgaagaactgaaaaatgcattctgatgttgatggacccaacctatatttgggtattttatgatgtacacaatatacttttgtatatgagattgttattaaatgtgactttgctttttcaagacatacaatgttcctccgggggtcaggcactgtgtttagcactttgtcctgacctcatctgacttctcagctgtccctgagaggtaccagtgtgcaagatcgctgagttggcaagtgatagtgacaatattttcaccccaatttctaatttaaagaccccgatttctagttttgttttgtattggatttgcacaatttcacgttctgaaagaggatgccctcaactttgcaaaatgggccttttgaatgaaaaggatcagtcatgtcaggaaaagcgctacaatgatgaaatatgataaataagtcagtctttcatctgtaattatctactatggggtaaaaagtgatgaaaactaccatcttgaaaggttctggtgatagtggttcctaatgcagtgaaagatgtgtaagtcaaagatttgtaaccagccagggaatgagaggcgaagccatagctggtggcgggggccacatctgggtgtggggaggccacagttgggttgggggtggggcctgcagttatccacacccctcccacctcccttcgacagtacaggcttcctggttaccttccagagagtaaggccagggagagttgaataagttgagaaatgtcatgtcgaagctattggtggaaagagttccattaattgacaatacaagtccctactacattctaaaatctggtcctgactagtggcaagccgggcccaggagtagcacttaaacaatggcaggcttgtgttgctggcaggatacttcagcctcagaggagctgtgtgcagctggggagactcacactcagaggatttcaaagcagagggcatctcgtagagcaacttatccaaaccctgacccactgtaaacacacacacacacacacacacacacacacacacacacacacaccctgagagagagaaagagagagagataactaaagagagagaactaaagtttggcaaaataatacatgctctaatgaaggtttattaatgattaatctactcctagcatttcctagtccactctatctccttaaaaaaaaattctggttgcagcccactaacttgattgtacagctgcttaatggatagcaggctgtaattttcagagaactgtttaatgcgggctacctctgttcttccatgctgcttgtggttcctgctctgctcaggacagaatggggaggaaaacaggctctgcggcacaatattggcaagtgaaattttgtaaaccggccctcccttccttttgcatttggtctgaaaattcaattagatgctgagtcctacaatgtatttgagaagcccaggagtgccctagaggatgagactgggtggctccctgtcaggttgaacatttgccttaattactttggcaagatttgcatcagtggtattagtccctgcctcacttggaggcctgcacttaagtggccacattcaggctccaatttcctggtgatttcatagtgtagggcacttgcaatcaaaactaggcttaaagcccaaccctcttacattttacccacccccacaaatgcagcaaataaaatgactctgattttcattccctagacctcttttctatatttattacattattgttaagacagtttttgaagaaagctgttttatttaacaaaatagctttatggaatcaacttcatatatcttctccgccagatcaaaacaagctcgtagtattagatgtcaccgagcaccatgacaggcagatgaacatcatccctgtgcccggctaatgatagctcggcctgccccggcgtcagccgctcctggcagggccagcgggcggtgtgggaccggcaccgtatctccagcaattcgcagataacaaatatggttctgatgatgttactaaagatctgtccctttcaagattggattagacattaggaatttggagggctttttattgctagcatttttaagaataaccaattagagtattgattctaaagtctgaaagccacatggacagagttcatgtaattggctactttatgtgcctcttcctagattgccctgcattttcaaaacaagagcctttctattttaatcaaaagaatccagaatgaaatgaggctttgaaaactcagcctatgtttgtcttgatttccttaactgacatctagaagaaaatatgagctcaggggtccgctgggttccttccagcgcctaagcctgtaagctcttcctgctggaaccaagctttaaatgcacttgtcagtcatgtcccatgagaatagatactgccttccatgtttttttgttctgatttccgtgtttgaaatgatgaaaatcatttttctgtgctttttaaaaatggaattgcttttgtgttgggaattgtgctgttcatttttactctacctcgttttggaatcactaatgtggccaatttatagccaaaaatcagtatcgtagagtgagcaatgaatggcatggtgactgtgtgagcgaattcatgccctccctccccaccgctcgccccgcgtctcagtcctcagtgatggtaaacagaatgaggaccttctcccgaccgtgatgcgcctcagccctacttcccttgtcctttcctatcataaaatcttctttcatagaaatggtcatttctgttcatatctgtggactgtaaataacaaggaagtcatttttgaggtgaaaactgcacttagactcattccaattttgatggaaacttttagctggtggatggcattttgttttgtcttagttttgcaaggagttatcttaatttagggagatgaaactagtctgtgatccgaggtctcacttccatacatttctctcgggcagtgtggctgcctgaatcatgcctggatgccacaggtgcttagccagctggtcctgtcgtaactgtcactggtagctcagggagtgcagaggtgccagcagacactatgaaattggcctcgtaaagcatcagttatgttgtgatggtggcaaagctgcaggcgagatgggaagtgcagccactgagaactcacagtagagcgtgtgtaacgtaaaaagatgaaacccattgtacacagctgtgtactgcctccttgaagtcaaatttcccccattaccaaggaaaagttttttctgaagggggctgcttgacaggatgacatctggtgatatcatttattcctttggaaatcaatctgtggaagtgagtttccactgactgatgaggagaaaaatgaattggcttcacccagcatccagcttcttatcctgggagagatagctcttggtctgtcatccacgcagctgcctggtgcaagagccaagtttgtgcagcctgcagagcactcttcctgagctgtgggctgccaggtcggggggcagggggggcctcactgtgcagcctcctgccacccactgatcatctggggagactggcctatcctgtcaggagacgcagttgcccagacgttttcaagggcctaagatgtaggcagttgatccacagatttttggagagtccttgagttggagattacaggtgacctcagaggagggagtgagaacatctgggtcatgggtttctactaggagtccacagtgaaaacaagaagaggaatttacgacaagacagtccagcaacttcctttctaacttctcctttcacatatgctggatactccaagactttgcatttacatggacatcacagatccactttgagagaagtagggtaaaaagaaataaatacatagtgctttaggtgtatttctatacatcttaattgatatgggattacattttcacttgtgtttactgtacagactctagacagatcctgctcttttgcaggtaaaacaaatatttcttaaaacctagaaagacccaaaacaatttaacagaaacattttggaccattttggaccttggcagttaggccccagtgcagcagcggcaaccataaacctctccataggtgctgaacccaggtgatccctggcaccggcagccttatgtcagggctctcttatcgctggtttttatttctcctaataaaagtgattaaaagattcatcttttaaagaaagcaaggacacagaggtggattctccctgacgctagcacagctcatgcccaagccactcctgcagggctctggtctaagtgcaaaagctggaaaagctgcaggtcccgcaagacacagagcaaccctgcaagccaggtcaccttccctcttctctgctgtccgactggccctccaccatgtgacattcaaaagctcaagttacttaacctctcaaaactcagcatccttttctgtacagtggggaagatactggactgttgtgaggattaagtgaggagagtggcccaatgaggttgacagttattactgtcattgtcattatttgccttctcacaggcaggcgtgccacagtcattttactgaagctgcttcagtgggtcctgaattaggccctgtcctttgggagagacagtcctggttcaacacacagctccctgcccagggcagcttgggagtgtgggccagtttcgcctttagaaccacaattctctgatatgtgcaatgagagaattaattatagactcaaaggattgcatgcagacacacacagatacaaacacatacacacaacacacagagttacacacagacatgctcacaatacacagaaatacacacagacacacgcacacagcacacagagatacacacagacacacacacacacacacacagacatacgcacagatgggcacacacagagacacactcacagagacacacagatacacacaggcacacacacagagagacatacacacagcccacagggatacacacagacacacagagacatacctacaacacacagagatacacacagtcacacacagagagacatacatacaatacacagagatacacacagagacacagatacagacacagacagacatacacacagacacgggcacacacagagacacacagacacacacaggcacacacgtgcagataaggtaatattagctagttcaggaggagaaagagataaagataaagtaatattagctagttcaggaggagtgaaagaagccttgtttttctccactttttatagaagagaaagtgaagattcgatttgaggtgagttcagcacaaaagcgtatcccaggccctctggctccaactgcagccctttctacctcattcccagaccccacctaagccttttctcttcaaaatcttctcaggcacactgatacacatacctcagatttttaattctccggttgtgttcaccaggtgcttggtcatgattaagaattccgtgatgtgtaccccatgtgtttaaatttgctgctgagttaactttgtggcggcctgtggactagacctctgcacatgcaatgcagaacggcagggccagatttgaaatcctgctatcttttcggctgccttgtaaaaataacatcaggcgatggggatacgatgccagaggtcacctgtgataagttctgtttatggccattttacttctaggaagacaggaagtgtcaggatctcagggatctaggaagccaaaatgtttttccactctgaaataaagtgactgaccaggagttcccggccacgcagccctgtgggaactgccgcacggccacttttatgaagtggacacgtgttggtcccactgaaaagaaactccccacccatggctccctcacgctgcagcagaggccctgccacagcacctgtcagcccctgccagcttgcaggggcgcaggcgcagagcggtttgtgcccttgctggagccagggaagggcacagggtccctcctggagtcatgggaggtgcagccgaggttctatattaaaatacagaggctagcacatgtgcttggggaatgcagctacagtagtggaatgaaagtgctgtccgttccttacccccccagctcctcacctgtcctccacacgcatatccctggctccctttccctagtaaggagactgaattgaaattgtggcttgcccgaggctgcatacctgtgctctttctgaagcccaagtcactggctctagaattctaacctgtgaggaagccactgaggatgtttgtcaaaatacatatttctgtgccttgccccagttccacggcccaggaatctgcagttttcacaagcacccccaggtgattctggtggtgtctttgcacttcttcaaggcagtactgcctggaacgcagaatcccagcctcctctatcctccttgcctaatggcctggatgctctcagatctacaggggaagggaaggtcacacagtcatcgcaatagtaacctcagctgataaatcctcccccataaaacttattccccagtgttttttaataggaaacaataaaactgtaaccagcccaaatatccatcaaagagaaaatggagaagtaaatcatcgcacattcacctggaccagatctattgtaaagccaataatactgaagccccttccaaggccctgggagtcctaacagtgcactggcagtgtctataatttatattatgaaatttgcataaggaaaacattttgtctcatttgtgcaatttctccttctaaatatacgtgtcactttgtacctgatttctataagacccaggacctacaaaccctgtgtctgcccctgcagccacccagggaaggactgcacagcagcaagacagattgccatggagcatgttgtgcccaactagggacagcgcagatagattctgtaatttgcctaacaatgtctataggatgatcccatttgtcaaaaaaaaaaaagaactgggctttattgatgtcacctaaatgcacctaaacttcttttttgccccatgctcttctgtactcttgatctttccccaaatttttaaaaacatgacactcattcccttatttttcctacttagaaaagtgtagatggttttatcataggaagttcaaaaaaattaaaatataatgaaaaatactcaaatagtgcctcacaacagtaactactgctaacataaataaaatccatatttcctctcatacagaccccagagttgctttgcctgacagtgtagttgatggagaaaataatctttatccttagcctccatctggttgcagaccataaagacagggaaaaaatgagggtgttggtagcttcgttagaaactgaaagctcactgattttttcaaaacctaaatagcctgtgtttctccaaataactaatttgcagccttcggcagccaggactggcagggatggggctagggggactggggagaactgctctctcctgagggtggtctgacccgacagcacgcatgaccttcccacagtcaggaactgctcagagacgtgatggcaactccatagaatgaaatactcttcagccagtaaaatgtatttttggataaatatttgctttaaaaaactttactatatgttgttaaatgaaaaaaaaaccttaaggcatcagaaattatgtgcagtaaaatctcacttttgtaaataaatatacctgtttactacgtatgcataaaaagaatcctgagaaatataagtactgtatgcatattgttgttaagtattttttctgtttgcttatctataattctaattttgcttcaaagaacaagttactccggcaatataaaaataaaataactaatttgtcttgtcatcaaacagatagtaagaacaggcaaacctggccctccacactgccagccttttgtgattcaaggcttcagtttcctccacttgttaaaaagattcaacaaagtagttgaaatagtatgtgaaccagtaaaccctaaaaggtgtccagtgttgtctgtgagctaattaagtgatttgattctgactccccgagtcttctgatttcgaagcagtggggagtcagacaggagcctcaggtggcctctcctgagaggccctggaaagtgatgagaacctggcctctggcagctcttcataaacgtccatgttttccctctactctctcactcttttcccagggcctcaaacagaagatgaaaatcaatttctaaaacagccctctgtgtgctctctcgtatctctccttttcacacatcgtggtggtggctttctctgtgttcctctgttgattcagtctctggaattaacggatcaggattccatgcccagaatgctacaaagactgtgcttgagttctcccacatctcactcaattacacagaagtttcagattatgtaacagatgctgtgctgggttaggcagagccatctgacttgttttgctttattttagaccatgagatgggtgagtttttctttttaatgccacattcttttaagaattaaaaacctccacttggctgtcagcattggaaatcagagtgatggtgcaagccctgatgaggacaatgtccttgtctatgaaaaggtgaaatcattgcttgaaatcgctaagcaggacatgcagtcccagatggaggggggaattcgggagctggttggaaaagagtatttggcactttgcagccttgagaggtgcagaagagacaccgaggggttcaccaccagagccaccattgtcagagaggcgtccagctgtgtccacctgggactctgccttcagggcttcttgcctggctgggagctgcacaggcagactcctgggacggtgtgccgacagctctgggcacccccttctaggatctgattcctgaggaatcacaatgtggatttcacaatcacttccagtgtcttttgccaacctctgtgaacagatgtgcaattaaaaaaaaaaaaagaaaggggcccaattctcaacactgtaagtggaaactttttaatggaaaaggataggctaatgaattgaatttgaaatctgagacagaaccgatgcatcaaatgtgctggtgtttacagataatacaaggggggctgcatcttatggtttcaatccttttttaaatttttgttctgagagacccagccagcagactgccgccagtcttgtcagagatgtcagtggtggccactctgaatggaaagcagcatctctcagcatctctgaggcactgctcctcagcggagactgtggtggctttgcctttcagcacgcatcctttctacgatgcctgacagtgcccagggaatgggcagagctgggagctctgaagccctttcacctaaaccaccctgggtcacctgacctagttttcctcccaattttaattatgtcaggcacttcacaaaggcctccttggggacaccatgagctcactgtcatcagattgctccaatcacagctgtggcttgcacacaaccgccatctctgccccagcagatgctgtgtgtaaacagttgtattaattacatctcaaaaacatggttcttgccagatcctcaggatttgggtgcagcctctgaggtgggtgggaggccctcgagggagaaatgtctgcaggaaattcttcccctacgagaggtctgttttctaagttatctaagagctactgcagctgtttactgcagagtgaccctgctcaaagctgtggtcacccaaggctttgaaaggggacctccacttccgccctgggtggagcaccgtgctggagacccacgcctgccaaggcctcattgtcatctccacacgccgtccttggggtgggccactcctgggacacgcagacaggaagccggccacctgagccactcggaggctctatccagagtcagctgccaagcctcacgtcacacatcactgttagtcttggagggctggcggggccctgaagtcaattgaacacttggatgacagggaacttgccactgccagaggcaatatgctccatttttttgacagttccaacaatttttctttaaactgtcataaaaaattgctgctgtgaataccagtgtcggcgtccctgcctcacctttacctggtgcttttccaccacacaaaactgtttctcctcgtgctggccttgggcttgcagacagctgattcttctcctcccgcggctgagcagcctcctccgagcaaccctctgacaactctgctccttctgacaacctctgcaagggctgccagatgtgaacaaggggcccgggcagaaggtatccaggaagactggaaactcgaggaagcctgccctgtcctgtccaccagactttacgcttgcgtcactgggctttgggacctaagtcctcgtcatttgttccttttgcagttcctactgttctcagcacttccttccagcttactgaggtacactcagatgtgatatgccatcggtacagacacagttctgctccagcatttccccgtgttctttctgtcgctctatttactgaattaccgtgaggatgtggagcgaggctgagttctgtattttaacaccattttaattctcacctactgagaaatccatcctcttatcactgtgctttttttaacctgtcacgaatccatgaaatcctatcagccagcctgcatacttccttttaaggtgcagttgaatcaggagaaacttgccgcacatgctgcgtccgggcacagcattggctgaggctgctgccctgacctgtccgctttgtagtactgcccagctatgaaacaggttagccacacatgacctgcatttaggagtaacaagtctgtctgtacatgcacatacagcaacttttttaaactgtctatattttttcctgagataggtatttataatatctccatcttctttcccattttgaaacttagaacaagtttgcctgtcaacagttctccacagcatactgtgtattctaggattttctaaggttgagcaacggaggttcagcaattttgacttaatttcttcccatcccttttccacgcagcccagaagccttggatcacgtggtgaggggaagaggttgtgctatgtcgggaaactctgtatcgaagctcggctcagatcatgacattctcttgactaaaaccctcagtttccatcaaacttgtcactctggcattaaagcctgtcactgtgtggctctgaaaacctctctgaacgtgttccctgcctctgccctgcaggtccctgtgctccacagaagcccacttatgtgacccacccccactcatcaccaccttccctcacccagagcctcagctccccactcccacctgtaagacccctactggaaagattcccacctgcccctcaagattaatctccaaggacatttccaaattcctctccccatctctcagccagatggctttgctccctccaggaaccccagccaccttcgacctccagcagggcactccactccacattctcctggtctgtctggctcatcttacctgagccatgctctccaggtgaaggactatgtctaactcaactctgctttaaaagcagctaacacattgctctttgcatattgttcactcactaagttgaactggacttggacatgcacactgaactgcagcgtctgctgcttcttggtggcccagctcgtcaaaagaataagatttcagcaaaacaatgtaacaattttttttaccaaaagtaatgttaacaatatatggttttcccctgatgtttgcgtcaaaatgctttttggaaaaaacatttttcaactctttagggtcagaattaagcaatgaaatttatataccacatgtataatgtgtatgtttatctaagtatctgttcatttatatatcttaaatagaaattttaaaaatttttttaaaactcctgataaacattctcaggaggcacactatgtaactgttggttgatatacctagctagatggtgaaatcagattttgtttaaagcatggaggagagggaaaaattaaatcttgcagattctgcagtccttaacatctttgaaagaggaacatttcagacaatgtaataagaaggccacgtgctttgacttctgtagattttaaaaatacttctgtatagtttcttcttcctttgaagaagtttggggagtttgggaagatggagaaagatataagaatagactccccatatgggtcatgaattatctttttgcatcagaactcttagtgcagtttcagtattttcttcctcaggagggtgagctgcttccgaatgtcctccccttctttgaggcatcctctgttggtgaactttgagagcatccatttatgaagttgatgacctttcccagtctctgcaagcccttcagtgtgtgtcctctctgagcaaatctgaattgtgtgcttaatacatggaaagggatttgggagggttgctttttaaactgatttcttaattaatattatggtttagttaactagacagtctcattgcagaagtgcataaccataatatgtcttcaaatatatctcccttcctaacaccctgtaatatacttttgtaaagatacccttacagaatgtgatccaccatttatgaacctgcagcattgcattcagagactaagtgaaaagctggcagattttcatttaaagcacaagctaaggaagaaagctggtctagaaggagctacagaagggtaatgcttagggagggaatgatgtgcctgtgggtggtggtagttaaatctaaccaaagaatgatgtcgtgggtgtttggatattggatggtccacattgggccacattctttcaaacataagagtctgtagaaatatgacctgtaaaagactcttaaatattctggaaactgtttcttccttgtcacatccttatatatacttgaacctatgcctaccagacatgacatgtgactattcatacagatttcatcatctctggtttaagaataaaggatgctgcatagaaggctcacatcttttaattcacaagactgaaactgttctgaaatgacattgtttctaaaaattcattacttgcattatattcatttttatttttccatgccagaagggtagaagttcctgtgctcatattaagaaacagcaatgtcaatcgaggcccaactcaaatccaatttataggagttataaagggcgtgtgcctgttttgtctagaagcagtgttgggcagcactgagtaggatagaccacctgttgctaccgataaaggagcagcttctcgaatgctcctgtctggtaggcactatcccgagtgctttggcccctcatccacaatctgtgtggcaaaaggcattgcaggcaattcagtgaggagaccgaggcatggagagcaagtgccatggaattccctaaggccgtgcagggagcaggttgccaagctgggttgaaaccgtcctccgtaggctcccaactccgccgtcgctgctactgtgctggatgatgcctggtagatgcagatgtggagccccatggattctgagacaggccgggtttcagtcctgccctagctgcctattggctggatgaccttggcaagttgactttcgtgagcctcatttgtctcatctctcaattaagaaaacctagagcctatctgtgggggttatctgaaggattccagggatgcatatggcactgtctaccgcatgcggtaactgtttcacaaatgatgaggagcgatttatgttcttagtggaaatatgtcggcgtgtgaagtcccaaagctctgccctgcctggcttgatccagtgcctaggcactgcccctcttcccctctctcccaacccactgtaagaggctaggctgcctcagtaactctgaggggcattgactcttttcatccaaaaattcatgttactgccccacattttttctgttgttttacaacgcagtaggaagtgggcagactgtcaggaaaagtgatttatagtcatgtattgcttgtgctttggcttcatttgatccaatgcagatcagctgcactcagaaaactactcaagtgaaagagaaaaagtaactgaagggggaaatctggatgagtaagaattccagggataggaatattaatagcaagctttttgcctgatatagtcactttatgctgcaggggtgcccctttataaagtgcttgtacaatggatgtttgcttttgattttggatttggagtctaatgaatgttctaaattattattagaggagcttgcggttgttacatgtctgcctttattgcttatttttagccatctcccctgatgtcaaatgctcaggcaagaatgatacattcatttataatgtggctccttcagaaatataccacataccttttggtgtggtttgtggctgagaagagtggggaatgcacaagtggaaaactgcagaaagattatgccttcatcacttcaagtatttgagatgaaactagatcatttgctgttgctttttattctcattctaagtgcttttcaaagtcagcgctaagattttaaaatggttttctgttgttggcagagagggaattactctattactttctgataaaacagagtctttcatgatcaaagagaaccaggctctagtagttccagtatcctaacgtggacactaattgtttccctccttttcttcatgaaaacagcttctgcacaaatgatagccttgtgaactagccatgggcacaactggagaagcatttagggagctttagtgcaaattgagaccacctacacatctgactctacagggtttgacaacatccagggtgaatcacaaaacatcagtctaatcagggcttatatagaaagagtgaaagaactctgatttcatcctaaagattatttatattaaccattgttccaaatgcattaactattttaatttagttgttttgattgttaaaaaaaacacatctgtttggtagataagacataatttaagacaaatgttctatttgataagcttttagaaacaacttatttttattctttcctgtgagataactcagatgtggagaatgtgacaaaattttaagcataacatgagaagggctgacacacatagatttctgtgtgcttacttgaaaacaacaaaatttaagaatttggtataggagttgtatcaggtagtgcagagtccccaggagacctagagacccaggtctgggagcctagcggcaagggctgaatgtgggatgacatcagcagaaactcacagccactgctattccaaaaacccagcagcagctcagtgcagggcagtgctgatagtacagtgcctgcaatcctggagtggatttggatgtgtcaggtacgcacacgctcactgctcccccagcagtacgttgaacagtgtgcgtccaggtgtctgtagggcccctcgccctaactcacaaaaccattctgggtcagaagccaccaatattgtcatcatcctcccttttctgagaaccctagtaagtccctccagtggggcaagcccaccttttcccttcattctgtggcaatatgccttcatttcctaatcagttttgccctgctcattcaatgcaaaatggatctgctttccttgggcaccaatatgtccagggattgtttatcaatcttcagttctgtttcctttacatatccctccaaaaatcaggcctgcactgcctgtgcactccacaatccacaggcctgaaggaaatgttatctttgatgtagagacttaaagtaaaactcttcaaattaattatttcatgcaaaaggctagtcctgactctaattctaagacatgtctcctaaactctggaagtctgatgtatcctattatcaacatttatccttaatgtgatggtttatcatttatcctcaaagctgcattgtaaaatgtacactgtaaagtgtacattttaaagtcggttttaaaaaatcatatttagagatcctggtaaaaatctatcaagtcaagacattaccttattacccatggaattgtcttcaactcttacagttcaaatattcctgaattggctttcacaataaacatcctaaatatgtaagtagaaacatatatattgccaactttgtgccttcccaagcaaaattaaaatacaggaaaagtcagtttgttttgcccataaataaatatatgtgtgtgtgtatgtgtgtgtatacacatacacactcagaaaagatagaagcagcagcatattttggcagcatctggtttattggaactcaaacgttctgattgtgcatacagactagttaatgtggtaacaattatgtatttcttccctgctccttgccttctttccctccccagtttttttcttcctgatagtaggtgtgtacttttttcctatttccattggcaagccacatgacaagcaaaacgatcactcgaagaatattgttccctcaatcaagaaaaatgcccattgggttttgttatttgatgttatttgatgacagagacctattgtttttccatttttctttttttgttttccgtggcacctatggaattaagcaatataaaaaatctattatttcagatgttcacgtctaatgaatttcatgtgaaatactggcagtataaccccaaatagaggaaatttgtgaagagtggatgctgcagggcatgagacatctgcacagagttcatctcttccagcatcttgcatgtcccaagcactgccctgccaggcagagaatgctgcagatcacggcagtgaattccagttgttcagagcacatttgacttccaaattctcaaggccacagatttgaggacagaacaatatttgcatttgaaattggaagattattttttgcacaagtgcctatatgctatatagagtttgcccactctgcattatcttccccctgttcccccgttatctggcacaagctattcaaaagacacgcctacttgtaaaataaatggtttgcaaactaaggaaaatacttaaatctcatgtaaatggtactatactatgtataaaaatgtgaagaaacacagaacagctcatgaacacctccactgctgtataaaagaaccatcttttttctggctcctattggatgccttagaaaaatctgtatttcctctttagttattgtgtttgaaagatgaagttgagacaaaagttctattctttttaagttggcagaacttctgaaaggtgatttttagctgcagtgtgactcattccaaatgcagaaatctctgaccctgagttagtctatttgtcatgcaagagcctagaaaagccctgagtgataagaaatggccataggccattcccacagaattttcaacaaaaatagaatcatgcttatgttctagtcatgacttagaacttataactcatgttcggaactgtccatgttcacgcacaggggccgtatcactccgccagagctgccctgggtgccggtgtgcagaggggtccgagagtgactgtctcttcctctgttgtcgaatgtgtgggttatctccataaatggctgccatgagcatccttgttcacacatttttaggtacttgagtgagtgtctgtggaataattttgggaagtgaaatctgtggtcagaggtttgtgagttttacatgctacattttcagaagttgagaaatagcagtaggctgaaggcaagtcgccatgcctggaattcatgaacactagttgaaagaactggcgtgagttagtcatgacaggagagatggggaagggagttgcaggtaggagggccatcttcaaattctcaaagtatagtcactccaaaccaaaattcgatttaatctgtaggactccattctcaaagcacagtcactccaaaccgaaattcgatttaatctgtaggactccaggtggcagaataagaggcaatggatgggtggaagcgaaacagggccaaagtttgacttcatgtgcaacttcctaaggagtgatttgaactccacaaacatgaactaagcacctcaacacaggctgggcaagttgctgttcttttggagcttacatcttagtggggaaagagaaatgcctatgtaaacatataaatcagcaggatacattgtgaggacggtcattgctcagtgagactgcaatagagtgatacgctggagggggctgcaagggagaaggtgggagggacagcatttagcagaatgagcagcacagtcccataggaagaagaatttattgcctccttaggcaaataaattcccaaaccttgaacatcagaaaggaaatagattaatgtgcacagaggattaaattatgtgatctgcaaagtcatttaaaatctatttccacataaaacatattaatgcaacctaaacaaaaggggtctggataccctcatcttcttcccaagcatcaagtctttctatagttaaactgagatgcttttattcttggaaaattttaaggactatctacagcaatggaagaatcgggtgttgggatgtgttcccaggtaataatgactgcaggctgatttggcccttgaggtgtggcctcatggccctctccaaaaaaaatcaaggacctgctacaaagcacaaagccgactgcaatgcttgctgcttactggttagggcagctcctctttgccagcgaccaagcagaaagcaagacaagacaggttctgaagcagtaattcaaagccttcctcgctttcccatgtgagtcattgctagtcagaatattacctttgcagagaggcttaattccaaatttgctcttaaagggatatcctctcctggtttaggtataaacttttgactcacaggacaaattctatcattcctttgggcctaggattgcatttatttccatgacaaaagggcctgtctggtgtttcagcaaatgaaaacaaaaatataaagcccatctccttttgaatgagctctaaaacagttctccactggacttcagaacaagagggagctctgggctgctggctggttgtgcatttgctgtgggttccctccggcaggcgacctctccgcgctgagaaggttatccggataaccaagtaagaaagtacatgaggaggcacagaaagaaaaatgtgagagataacagcataaacacacagtgtatgttgttatgaggcatcacatgatgagatactgctggggagggaagaagtgaggagattcctaggaatcttatgagaatttccagagacaacaagttttgagcttttttttaatttagaaaatttaccttatttttaaaagaatatgtaacatatcccatgctataaaattctagacatagtagatttaaaacagcataatggaaaatataaatatctattttcttttcctatttatgtattctgtgccagtaggaatgtagccaaaaagagagaaaaggggtctctgcagacatggatgtctctgtgacttgatcactgctaacccaagaagataataaagcagaagcatgtatccaggttgctgcagccaagcctgcccggtctgcggggcgtcctcacacatggggcagctctcccaccccacacactgggaaaggcggacagaggctgggcaaagcccccaattttcgttggcactgaccccgatgatttataggcctttgtttcccatgttaaatgtcttacgatcattaaattatttatagctcaattagcatgtgtccaaaaccaggaagttcataggagactgtgtgactgggaattaaggagcaaagcaactttccagtctgtgatttactgggtttccattctgtttcctgttcggatccggaagtagaatttcaaatattgcttttcatgctttatttgggaccgattttagccccgctctcctttctcttgccattcgctggccattagccaccagcctctgcacaatgaccagctggcccctggcagatcttgggcccaggtgtgaagtcgctggagaagcatttcagggccaagatgggagtgatttcattttccattgacactatgcagaaatgaaggggattcaagtgccttcagaaaagcttccttccagcgaatggagttttgggggttttccagacttgcaactgcttttattcttggaagcatcattgttgctttttccccccttccatttatatcccaggaactgattcagaaaccatagaaattggatttggaatcgctgaatgctagcagacagctgactgcactcttcccaagaaaccctgccagctgggttcgggtatcgcgcggtgtgtgctctctctgcctggcccgctgagtcctctaactctaatggattccttcttacaccaaagtgcactagaactaaagtgttttgcttcattctttagacattttgtggtttagggctcaatcagccagggtatgatttgcaatccacagtaaccggtttcagagcagctgcccagcgaggcaggtttcatctcgcttgctagacgttttgtttttttttttttctaaacctcacaccttttatttattagacttggattccagtttcctgagcctgtttgtgccactgattagacaggcttgaagcagaacccaccaggcttcctgaataaaatgcagcagtgattgtattagggggttttaaattgctcaaaatactgtctaaaaaacactaaaaatcatgttactttctagattgaataaaatcctatagaaatgaattcctggacttgatatgtagcaagctggcattggctcgggagtgagtgggctcagttaagtgagctaagatgagatggtgcacaggcgagcacccacctgaggagtgtttggatgttatgatagccagctcctctgtaaagacctgtccttctatgtcagcagcccagcagataaatgacgtgtaaataccacatttaggagggcttatgatgatgccaattaatggagacctttttgaaacaggaaggaggtgaaacatattcctttgcttctacatcactgtgtgccaggcactgtttacagcatctcgtttaaccagcagtcaccacctgacggatggctgatgtggggtggggtcccagggtgggattgcgtgatgggcttggggtctctggctgatgggtgccagagctgggactggaactcctggcgtgactgaggcagacacctgggctacccagcctcacccacgacgccctcactaagtgacccacaggactcaccggaagcagggcagcaaggtccccctacagaggtccccactgcaaaccgatacccagcttagacagcagttctgcagtcggcgtctcaccccttcgggtctcattgtgactcactttgatagccacacgatttaagggtggttcagtagtgatttgatgagtgctgtggctcagggtcattcccctgcccaagcatttcaaattccagaagttcatgccctgcatggtgggtgaaaagtctcaggccaaccatgagcacacagcagccaggcgactgaggcagctgcccggggtggcacgttgctcaaacccatcatttggagtcaaaacaaacagatgattagctggggtggtcactttcaatcaagagttttcacatcgcctagacatggcctcagaatcaggcctggtgtggccaggggctgatctcacagtagacaggaagtgtggcccgagggccatggctgccccctcagaaggccctgtggagtggctggccgagcctcagcagcctcctgtgaagcgaggaagggtcttcctgccggcctctggagatcagtatgggaatgcacaagtaggaaacgctggatgggaatccctctgccctgtgataccaaggcagtgagtttgtagactatggaattgctgtcggagggctctgtaaccggccaaggtcacacaggtagccattggtagagcagggactggaatcccagacccccaacttccaggactgtgcacctttctttatcccatacagccttacagtcaagtgccagtgcaacacctgattcccaggttccagcctttgtcttttataatgggaatcaaccttatcttgacgatccagagatagtcatcaaggaagattaaattatccccttagactcagagtgaccatatcattttccctccacacaaggacacttttgagaatgaaaaggaggagatgtctgtaccagacgctggatgacaggcaccgacaggctgtctgccaggggagcagcgattcctgtatgttgtagaaagtttttcaaaagtcaccttggaaagaggttttgttccttaaccttctgttaaataggaagctccgtgaatgaaaacaactcccttccctaaacattctagtaatgacccaacactgccaagcctgccagctctgcctcatggtcgtgttgactgtgtgagactatgtgagtgcctgctacacagtacgctttcagtaaacatggtattgcctcgataatcccacaaaaatgtcctattcaaatcacctggcacccaggaaatttccttcttttttttcccaggtgaaatatacagttgaaaacacctgacagcaattcccctctcccatgtgtttgcaggatggtggttttggttcctccatctttgatgtgtacaagtgtgatgttttccccccacagacaagtaaaccacattctcttcacattcccaatgttttgtcaatgtacctccttcaatagaggatcgataaggaaaaaaatcattgacaatctcaattagattcactatttcatccaaaagcatagcttagaactctagtttttgttcaacactcttgccctatgagtgcacagaactttaattctgatacaaacatccctgaatgtttagctttgacagagattccaaggtgatttgataagaagcagggctgtgtttgggctctgggagtttttgatatggtttcaagccccatccaaaacccacagacctctagaaagtaggtgcctgccttcctgcagcagccctggagcctgctgggggctttgagcagctgctgccaagccaggcctcacccgacactctgatgggcacggccatggtggcaggggcttggacgctgccaggtgactctaacttgtggccagggtgggaagcactgctccacagaggtgccaaaaccaggttccttcctgtgttctcacatttcacagcctcaatgtaaaaagtaagacatgggcactctggaatattacaaaaatatagaaaagcatgttatagtaaataaaaggctcacagaattttgtcatttaggaacaatgattattaatatattagtgtgtgtttttgctcattaacagtatatcctgagatatttcctataccatttaatattttaaaagatgtttacactggccacagtagctcatacctataatcccaacactttagagggcaaggcaggaggatcacttgaggcttaaaaattagccaggtgtagtggcacatgcctgtagtcccagctactcaggaagctgaggctggaggatcacttgagcccaggagttcaaggctgcagtgagctataattgcaccattgcactccagcctaggtgacacagtgagaccctgtttctaaaataaataataaataaattaaaacatttaaaaatacatgatgtttaattattagaggactcaattttatatctatgtatacaataatttttaagtttcttaatattggacttttagtacctttttaaaaatactatttttaaaaaaatctgtatttctaactttttataacaaggaacctttggctttgagatgactggggaatccattctttcctatagtatccatgtccaatggacttaaagtattaatcaatgtgtttatgttttgttatttttctggcattacaaaaaattctaaatatattgttaccgcctgtataaatatcagcttttgagagaaggacattgtgtagaaataatgaaacactgcaacttgtatttgtattattcttttttttttttttttttttgagatggagtctcgccctgtcacccaggctggagtgcaatggtgcgatctctgctcactgcaagctccgcctcccaggttcacaccattctcctgcctcagcctcctgagtagctgggactacaggtgcccgccaccgcgccgggctaattttttgtatttttagtagagacggggtttcaccatggtctcgatctcctgacctcatgatctgcccgcctcagcctcccaatgcactgggattacaggcattatattattctttaaattcacatgagaatttagtatggcttcaaaaaataccataagttaaaatatcaccaagactctgttcagacaaaagtatcagaaaagtgagccaggcactcacatagtttatagtttataaaagtgagacaggcatgatctcttaacctcactatagtcctgtgaataaggtttatttacatttcattttacctgccaggattattgtaaaaacgccaagcacattgcctacacaaactaaatattcagtcaatggctgctattttcatgagttcgttttaacatatatttattgtcctctactggatttaagaagttatatttattatcatctaagattttagctattccttctcttaaaaatagattttataatcaatggcagtaagggagagtaactcgcagttctctgaatctcaaggggttcctggaagccttcctgaaggtatagtgaaatttcagcttcacattcccatccatgagctccctgcaaatatcccggtctgctctcaggacccagtgacttacctatgcagaggctgtagatagcacctggagcttcctgtgtgccctcctcaaactcagccaatgccgtcatacagtagcaggcaggtgtctttgctgggtagttggactggatgtccctgggattgcagaactggaatggggagtgacatcaggaaactataatcatcaggacaacatggtttgccataactttaagttttaagcgaccgcagattatgcggagagagatgcatgcccacagccatgcttcccatgtaactggagaggggtctgaagtttgaaacaagtgttcctaggcacgggttacagtgtttgttatcatcatacttgatttagaatggggcacaacatgtggattcatggtaactgttacaaccttactcattttaatacctgaaaacatgctttccccatgctgggaatcgaaagattctcctaggaaaagaaaggcttgacaacatcgattcaaaaagggcatgcattttcctcatttaaataactctaatgtgcaagtagatcccctgacctcaagctcagaagagtccaggccttcacaccttctctgcttctgctctggggccagctattgagattcctgtgcccacgcaatgcgcacatcccacccctggccgctgtccacaagaaatccagttgcaccaagcaccccactttttgcacctctcatttatgtactcctaagagcctcaccacaactcccttctaaaaacatgagttcctgactgggaattcgatgctgcccaggcagctttgctcagagggagcagccttctagaaatgtttcaagtaaactttcaagtataactaaattcaaaaaaaacacatacacacacacacacacacacaagtcaaaggtgtgtaatttggccaatatcacaaaccaattagccctttgtaagtggcacccagatcaggacagctgaccataccagcaccctagaagcaccccgtgctgcctcctgggacagggctaccaccatcctaaggccagcacgatgggccagctttgcctgctgttgaattttgcttacatagaatcctccagtaggtactcctttgggtcaggttctttcactcaacattatgtgttgatatttttccatgctgtgctgcaaaattgtatttcttgcattccataactgggcagttccatcataggagaataccacactgcgttcgtccattctaccgccaatggacatatgggttctttctcttttcttgcagttacaagtttatgaatattgtcccacgtgtccctggtgaacttttgtttgcatttctgttgggtacctcagagtggcgttgctgggtcagagggtactggtcgctttagtagctttgaaagatattgccaaaacattttccagcgcagttatagcaaattatacaccaccagcagtagaaaacatctcctaattgctcacagtaaacccccaaagattgccacatacatcttccatatcaattacttaactattcagcaaatttgaagggaaatatatttaatctttttattcaaatagtttataaagtggaatagagatgtgggtaaaagttgtcttgccacctttttagatcggtaaaagtttgttgaatgcaggcaagaaaagatgagaaataatggtacccaatgaaagacatagcagtctacaaggaggggcatttcccggggtgggggggacccacactctgtaactcccacattcaattagcatgttataggtaagctgcagaaaacgaggcagcttgtcaaagaggaacggctcttggccatggttgctgccctaggaggatatttgatactagcagagctggggcaaccctggaggaaaccacctggaatgatgggagaactcctccagggaacatggccctttaatagatctctgttataaaaaataatcccaaagcagccaccagggcatactgctgcgatcaagtcctaggcggtattcccttctgcgccatagaccctgtgcagagtgccctcaacgaaggagcaaggaagaccaagtctcccgagggtttgcatatgtgtatgtgattctgcagtcatggtgaatgacacagtcagggctgcggaaaagcattggtaaagtgtatatttgaggcttcagaagtttgaaaaggctagatttcctaggccaaaacactgaaaatttgcaattagaacttcagtgctgatgctgggaagactggagttagtttgagacatgcacctgtgcagaactgggcccccagaaaaggagaaggaagggaatccagaccagagtagggcctgacaccactcagactcggcgtgtctataaattagaattgcgttacaattacactttgacattttagtggtttttaaagtgcccagcacaagttaatttttcattaatgaatcctttattcataaaatgcttagatggagattacccttttgagcattttgccagtgcttctgaaattaatggggacctcctgttggaggacacagtctgttgcaataggtgaccactgctctgaatctatgtcacctctccaggaccacgggcacaaccatcacctgaggcatgttggagatgcagatggtcaggccctcctagaatctcagaatctgcattttagcaaagtcctgggtaattcctatgtccattggagtttgagaagcactggtaatctcaaatactttaaaagattactagagtaagataggctcagtaggtacctgaaggcaccatcccaaagaccagagtggtagaagcaggtggaccagcctctgaacacatttctcccccactccccggctgtgtggaaggttgccacctttggggtagtcattcaacaaacacgtgtcaactgtccactatgtgtcaggccaccactgggcactggctgtggctagctggatagacaccatttctgccctccagaaatgtcatgtccactggcacatgacaagtcactaagtcattcagagccatgggtgacagctccaggggccgacaaaggagctgtgatctcacagatccacagagaagtgtcccagggcgggcgggaaccaggactgcacagggaggggtgaagtgacacataagaagtcagcccatcagcctgaaatgctcccccaaatcttcccattcagtgttttctcagtagcaaactcgtgggaaaattggttattttacttaaaaaactcatactagaaagctagtttaactttaaaaataaattttaaaaacatttttattaacaaatcctacctttcctccaaagtcaaggagaaaagaatagaagtgaacaatggaccaagtaagcctaaaactctgctctttcccctgctcattttacagttcaagtgccattcaatttatcctggcaagaagaggaaggcatcatcaagaccttaattttctaatacatctgatctgagaagaatgtgaaagctataaaattaatttttgatcaataactacaggccttttgagagagtgccctcctaatgaattgagtacctatttctccatacacagtgtctatcatgacctacaaacccttttcccatgaggtgtaacagagagagattacagccttggaactggatgtcagactctcctggtttaagacaataagccatgacatagagcctgaaaccaacacaatcttccgagtggttccagaaacatataggggataatgttggctctgatgctgtacatccccaacaaccatcaactatttggaaactagaatttcagcataattggagttggtgttaccctagcaaatgctgtgggaagagagtctcactgtgtatcttctcctgtttaaagcctgaatttgttcagaatgtaatatctctgtttagccactctactgaaactgatctaggaaatgttcaaaaaaaggtatcccaaggatccctttgtagctacatctgtgggattcccctcgctctggcgtggcctggcccctctgcatttgacaatacggtcctatgcttttgtcttcctgggctgcgtgaacccaccctgccctggttcacctctcctcttgacccatccttatcagtgtcttgaaaggtccttctattggaggacacattctgttgcagcaggtgaccactgccccaaatctgtttcacctccccagggccatgggcacaaccatccctggagtgtgttagagatgcagttggccaggtcctccaaaatctcagaatctgcatttttgcaaagtcctgggtaactcctatgtccatgagagtttgagaagtactggtctcatgagttcctgacatacaaatagtgctgaggccagtatgctgactgggtagccagatacaagtgaaaaccttcctgttttttgcaaacctggatggacccgaggccgctgacgtgggccaggacaagctactctttttcagtgtttctgttgcatcgctgtgtctctctgtgatcaggtgctgccctccctggcaggaggactgcagacaggatgaccaagagcactctacacagcctgctctccagtgttgggggacgccacccaccctcgtggttcctgttcatctgcctacacgtggagggcccaagagggctaatatgtgactatctccacttcctggtaccctgtgtgaataacttcacttactaaagggatgttgagcaactttattaataatgaagaaagcactttggtttgacaaataatcactccattttttcatttgaaagttaactcttgttagtagagaaagcaatgtattacaaccacaaggacgtttacatggaaatgaaccatctgcaaagcatcccccattttccttttaaatcagccaatgggtggtggtgggagaaatattcaccagagtatttaacatctatcccccttcctagactgtcagctccatccgggcggagactgttggtatctccacagcacacacagggcctggcacacatccggggctcagtgagcacttgctgaatggtgaacagattagctctcctgggaacgttgttgacacatctcataacactggtttggagtggagggcattcatcgggctgcatattcctatttttaattgtattctccactggttacagcacctacagttataaagacattgttaacattgcttataggaagacatttgatggaaatgagtccaaaggcattacggttagaaactggccaggtgtcatttttgagagattagataactgttttccggtagagtgaattgcctgtttgttgcaagttgggactttgctgggctggtttacagggccaaggggaaagagataagtggatcttctagtgagaggtcatctgttttgaaagcctggaagattccatgaactaaatccaagtcttacaacacagggaagtgtgtcatactgtgcagggatgaagtctccaatttagcatgaaaacaagagctcctcacactgtcctcttcagaaagcccatacaatccaaacttctgaatgcttagctgcttacaaccatacatagattgagggataaaactctgatatggaagagaaggtaaacattttttggcagacattcccaggaaaaggcggctctcttctctcattgctgctgctctttcagaatccatttcaacagaggaggagtcaatgggagccccgtgcctctggcagatatcatatggcgtttcagtggcattgtgtgttacccttcttaggtaacagctcagccattagaagaatgtcctacacaccttctcattttctgtgatgagaggaatgtgaggtactgcccttcgagagctgtcatttgtcctagtagccagcagcgtgactgtgctgtcttctgctctgtctccctgtcagccttctgcccagccaccaccactatagttttgttctctccattggaactcctggttcagagaattaccataaaaaacagacccctagacatacaacactctatcacataatggtgactttgtcttctattttggattactgagctttcttgggtaacttccactaaatcgaagttaatattagaagaacttcctcttactagaatcgaaaagcatttaagtgatgcagtcaagtttgtaccataagtaattcagtcatttaacaaatatatatggcctctgtgcgacagtgaccttgactgggaatgaagctgtcccatgtggggcctgttcttcaaaggcagttccctgctgcccagttcagtccagtggatctgggcatctctctttaatccgcattaggggctctttactgattcttcactatccaaaaagacttggaggggagacctgagcccacttctggaaggaaatgataacaatttatttagataatctttgtgcaacaagtcaattcactgaagagatctgctctctaggagcctctgtgaccccaccataactgggaaggctctacctctccagtcttcgggccacatttctctctggcctgctgtcttcccagcactctcagccttgctcatggagcactctagtcctccgtcgaccttggcctttggtaacgtgatttttcacctggcagctcccatctggtctcactccctctttttgtccagtctgcatgacacagcctcacatcgttagtgttccctcactcccctcttactgcccaacctgcaaagtccatgcctgggccagtgcagcatgtgtcctcaatgggctgctggtggcagtggggggaaccgcacagccacgctgtgtgctgctgaagaaatgcacagcctcctaccctcgccctcaagaggcagccatggctgcgcatttctgcccttctgagctccgctcacttttggcagcagccgttccaacctgcatgggatcttcactctctcacagatgtgctgactcctcctgctgcctcccctctctgtgccttctcactctctgttccctttgccctttctccccttttctcctctgcctacctccaagccatccatcacaggacagctcaagcatcagatcctctgggacactttccttagttgttcagtctgatgaggtgtccctcatcctctcttagctgaaaatcagcagctgcctcaacttcttttccagcatgtctcatgagtattgccacaacagcatctgtcacaatgtggggtagtggctgacttgcttttctgccattcaactgagttccctcagtgctggggccagcgtgcagtgtcttgtattcagtatatagctgattaattgatgaattgattaattaatggttcacactagcacagtgcaaccttcaatgcaaagatctcatcaaaataattcacatggtgggatattttagaaggatgaccaggctagtttgtagtaagaaaaaatcaacaagactaggtcaggaattctttttttgtctacaggcttgctatagaagatattgaaaatcatctacctaattacctttattttatcaggttgtgtattaaatatcacgtctgggggaagaaaatgtgatatgtgattacagacctttcctggtacaacatagtacgtttcagattaactcaaggtattgtggtgatattgcggtcaaagccaggtgattaaagagtcattctttgaaacaaatatctgtgcaatcaattaagaaattaatttgcaaattttatttgcttagagtaattgatatatcattccttttacaaacaaatataaagaaaacttaactaaaaatactgcatatctctttcagattatatatcccagaaaggatatatttttctcctttctggtcttcctttttggtgtagcatctgtaggaaatgcatttcttcatagctaagtgtacctccttgtgaaatatcttcagagtctactggtgcacataagcaattgctggcagcagcttgagggtctccatctcacatttatcatatgccttattgcatgaggctttgcaagaggaggtctagagctacaatatctcatggatatgaatgtcaattcaaatcccagtggcagtttatgagggggaaagcctagaagagaagaaacctagaggaatcaagcaggaggggagagtaataaaagactagagcagcaggtttttcttaactcaaactagaattaaatctctgtgtgtgtgtgcatgtgaatgtgcccgtatgtgcatgcatgcacgtgtgtaaatggatgtgtgtgtgtgtgcatgtgtgtgcaagtaagtgtgtatacgtgtgtgggcatgtattgtgtacatgtatgtgtgttttatgcatctgtttgcaagtatgtgtgtatgcacataaaagtgtgaatgtacatgtgtgcttggtgtatgtgtgtgtattaatgtatgcgtgtagttctagagtctagttagagaaagtgcataaagaaatagggaaattaacaagaaagctatagcttaaattataggaaaaacttttctccctatcagtcatggttttaaaatgttcagacttgatatgtttcccagtgctattgtcagaaaatgtccctatgacattccatactacttcaatcaaatctaaaacctttgttccaacatgttttattgatatgagtatatttcaaatttctaccaggtttttggagaggtattttggccataaaattgactaaattattcaaaataaaaaatgaataagcctgggccaaggcttggagacttgcttaactcagttcttaaattttcagattttcaaaattacaaatttaagctctaaaatcatggtgctgtgtatgatattctttgattgcaacttatggttgaaaaactatagagggctttatgctaagagttgtggatcttaggattttcatgaaatctgcattatcatcatctgcaagtttagatggggcataactgatccaaaggatggatccctcgggggcaattcaactggctgattccagccaagatgacaacagtcaggatccgttcccttctgatcatccattgggtgccctgatttcctctacagccctagctgaaagaccagacactatctcaggctggctgccccacatgccttgctccacaccaaattcacagtctataaacctgagcctccagtgctcctactaccatactcactcgaacattcccgattctgacctggagatgtcaacagctacttgatgccactctcttctatctttctgtagctaagccatccccaagtttgtcgattcaccctctttaacccctgtcggggtgtccattgtgccccttcaccctgccatctccctggtgcactgttttgcaaagttcagcatacatgagcgtcacctgggaaccttaataaagtgcagatgttgattcagcaaatctgggatgccctcgggctgcatttccagcaggctcctggggatgtccccgctgctgtgctgcagatgacactctcagtggtgggactccaggctctgctgtcgcctcctaggggtttctccacactccctggaggcctaatgggcccttctccacatggcagtaagatctgtttttgtgtttgtgtttcaagttgggagaaggagattatttaatactaaaatgtgcaacatgggattgagaaaactaattattagtcataagttgagtatgcaacattgaaaccacatgctttaaaaaattataagaaaaaatcatagtatttgaaagttacaagctattatggctaactccatttatctcagttagagaagaagagtcacctgtcaccagggcactgccagaagccaggctcatttccaacagcactgggtgctccagctttggggtgccagctcctcccataaagcaaacacatacctagggatgatatttctttgcaagggctctgccctacagcttgtacatctcaagaagttatgtaattaaactgtctgttttgagaaaattgtagattcacacatactagctgtaagaaatgatgcggataaatccagcgtaccagctttccccacggagacgtcttgcagcgtcacagccaggatgaggcattgacccaggcgaagtccagagcacctgtgcgctacagggccccttgcactgtgctgtcacagacacgcccacttccagatgccatctaggaccccctccaaaaagcagaggcattcttaaaaacacacatctgcacatgttcctcttcatttgaatctgtcagtggcttctcagtgcctttcaaatgaaatctaaagtccttacaagccttgcagcaggaacctctccatcccacttcccctcacactctcagcttcatctctgctaggctctgttcagccaggcagcctttcacagtccctctcctcctgccctgccaggaaggtcccctgcccccaactcttccccacatgtggcggggccccgcttgtccttagaagcccagctgaactgcttcctgaaggaacccctccagaacctctcagaccaggtcaggtttctgcactcttagatcatccccatggcataatcacagttgtgatgttgtgatgattcagtgaatgtctgtctccccactggatggtaagcttcctgagggcaggaacagcattggttccagtcaatgctatgtcccaggactgttcgtttttgcacatactaatcctaaaaggacgatgacaacagcaaccacttacatgacctagatgctcttctgggtgttgtgcaaatattaacaatttaatccttgcaacaatccacgagggaggcattcttctactcccacttaacagacaaggacagtgaagctagtaaagagaagtcatttgcccaaggggaccccactactgttggcagagctgggtgcaaacgcaggcttgtgaagccaggacccatgcattcaaagaccatgccaggtgcccccactgcacacctcatccccacataccagtgagggggagagaaatgctcctgcactgcctctgattaactgctttcctagaagtcacacatataaaagggatttaattctagtgggattgaatctcaatagtttccttattaggttgatttctgttaatagtttaagtactggatatacatgaattagaaaatctagattattagcaaatgcaaactataaagtattttataaatgttatcttgtttgtcaggggatgagtgagatattcattatacaaaaagtagtgtggattttgaggtagaaggtttactaaggatcataccgtagtatgaaatagccacaaacattcagtgaaaccaaacacccccgcttaacctcaaactaacactaaataataaggaatagacttgggggcagtgcaagtgtatttctaatggtgaaaaccattccccagtgaaaactaatgtaccatctagttaataagagctcctctgacccacgcacatcaatacttacatcccaatggtgatgtgacattttgggttttgtatttcttttgcaaattgagctagcatttttgatgagtggcagggctctgctacccaacctttggacagtttccaagcataaaatcacaattccagataattctgtcacaaagatctgggtctcattaggaaggagaggaagctgggagatgatccagtccaacctcccccaaaccaaacatcacggccttctcagttgtttcaccaaccatctaaatgttttagtaattctaaaaattgatgcgctttttccacgaaaggaagtgttaccacattttccaagtgggaggcatctatatccttactccttcatcctctccttcccaccccctcaccccccaccacccacacaacatctgcaattcttaaactaaagcacaaattgttacaaaagttaattgcactttcaaaggaatgcttgtatagaaactttctcggcttcaaggaaaaataatacgctttgaatggctgttcaacagcatagaaattagctgagtagaaggcactcatatagccattaggaccaatcctttctgccgccaacaccccccttataaagacttgacagtgggccagaataaacaacttcaggatgaattcagttgagacacaaagtacacacttccagtttttcccttctctggttactggcctcaataaccaggcagtcaacttaaaaagaaaaacaaaagcttgcttcagattacagattgcagacttcttataatatgtccatttcaccaggccccgctctcagccccgggaaaggccactggaaaccacctcacatggtagggccttgcgggagccagtaataaccttatctccgtcaacatgttctgtcagattgaatggggcagccagagaagccagagttggcacaggaaccaaaacaaaggcttcccatcctcctggagtgagcggttgagcctggattggtgcttagacctataatgggtgcaagcagcgttcattcatagtggctttctagacccagggacttggccccagccctgctgctccactcctcttcttgcttcattaccacgagtctcctagaccaccgaacgatgcctgcatttgaaagacacttctgctgatcaaagcagctgatgtgtccctttgcggttcatttctaattgtccccaaggaggagaaattcaaatagtttattactgagagttaaagaaatccactgaaatattctttggtctaaaattactgtcatggcggagcagcttcaccttagtcattgcccttaaatatgaaagctatttaagaaagtttgcccttaaatatgaaagctattttaaaaagtttaatgaaagaagagaatcacaaaacattttcaaaaagcaaaagaaaacctaagagaaaagttgaaagtaggaattttttaaagaatatacgacgtgtgttctgtgactcacccctgcaagttatttgtgtgtattcccttgcatagtaattaataatgaagcaaagcatggcaatgatatcttttcttgtctagtattctagaagactccatgtttttggaaaatatcactctagttagatctcaaatatattcaatcagaaaatgggttttctacaagattctatatctgtagtcaatagcaaatataattctattaagctagtaggatgtgataggaaactaaaacctaggggagaccaaagcaaggaaaaatacttcctcatccaaacttgagagcaatttaccgtcaggcctactattaatagatggaatacagattccattttcattactcaactgccatattcattattacactgtacagaaaagggaatcacatctgttgaaaacttatatatgatgttcatgcatgcattccagtaattcaacaatttttatttatctttttattgcttgctaatttttcaaaataataagctaaagaaaacaaaatgtttgtgctgttctcagatgacatgttatctctttaaaggacaaaatgtgctgtgaaataatagaatgctttcagcactcaagtgtgagtgagtgctcatacatgagagaaagccgtggggactacagaagccaagaagcagatctagctggggaggcctttgcagaggatgtagttgtgtggagaggccacacacgtggaattcccaggagggctgtggaggcggggaatctgcaggaaagcactggggtgagaaacgtgatgagaaacaattattgtcttaaaatatctgcagggctgtaaggtagagaagcaatacgttgcatctgtgttaagtcaaacaaaattatcaagggactggtttcagcttaacataaggaacaattatgtgatagggttgtcaataacaagagtagactgcttcttcacacactcctagtcactcagaatggtccaggaggagtggacaaccatttggtagagtatgggaaggcaggggccctgggtgggagtggtgagggtagggagtgagtatcccaatctagaagtaaattgtgcccagcacggagctgcaacactgccctgcacacaaacacacacaaataacaatccccagcccctgcatttccctctccggtttcaggaccttgtatcttacttcaattcctttatttagctgatgatgaaataggaagagcttagcactaagaaaatccttttggagtttggccttgggggaaaatgaatcactccaaccaggtctgtcttctagaaagtataggatgaaagggctcctcatcacatacttcctgacctcctgctaggcctttccctaaaacaggggctggcaaagcacaacctgtgggtcacgcctagcctgccacctgtttttgcaaataaagttttattggagcatgactatatgtatttgcttacagtctgtggctgcgttcacactatcccagcagagttgaataattgggacagggaccatatgatgggtgaagctgaaaacatttactctctggctgtattcagaggaggtttactgagcccttctctgagacatggcaagcgctgcttcaggctcatgcttcactagattcaggcctggggcagtaaagagccagctcaggatagcactcccgactcactcattttttcaggcaggggagccatctaatgtcaagtgcctacgtgcaggaactggtctgttaattagcagctctcctcatggaagggataatatattctagaaacaggagtgcggccctattgcaagaatgtcctgagccaaaattaagattcttctatggcagaaacttggctggggcttctcctgagttaacttggtagttgttagtgatttttgagtcagtttttccttgtcaacgaccccaggaatgagtttgggattacagggtagccagggaaagggaaagcttcacgcccgcccccgggacaaggtctgtcttcacactgctacatcccttcacccactttaaaatgaaacttaaaaggaggatttcagttgagtaggaagtgagaagagggctcattttaaaacaagcgttaaatgaaaacccacacacactcagagcacacaaatccaaccacgcttacaaaaccatcacagagggtcaggcgaggcccttttctaaatgaaaaagaacaggggtggagactgttctgagagcatgctgggttccctgaagggaattctcagctgtatgtgccccgcacaggatccctgctagacacaaggccagctgccttcctttcaagccgcagacgcatccctgtgtccaggcgggctggtcagctgcggtcagcaccagcttccccgctccatggtgaggtcatcacaacatgtgagcaggagggcaggccggcaacctctgagtgcttagagaaagggacgggattcctcctgtgcaacccctctagtctcactcagactcaagtctgactaaggggccaggtgctttgaccagggactctcccctctcacttccctcccaggagtcacaggtacatgagtccttgttttacaaatgaagaaaacagacccaacatgattaagatgttgccttcataggggtggcaccaggattccaaaccatggactccactgagcccagtgcccactgacatgtgccagtaacagtgcagctgcctgtggttctgtcgactaaactgccggcagaggctggctttccaccttctttttttttttttcactcttcaaacactttatgacatgaacataaactactggctgcatcgttctgctgacaacatgacatgtttctataacttgaaaaaagcaagcagtggactgctcattggtaaaattgagtcagtaatcttttaggaaggttatttttcttccttttactgcttctcatctgttccccgcagtaaagaggacaagatgacgacgactcagggaacacctccagcctgaagcagcaccatgcgagcttagaccttagggtcggcttagaaaccacaggcggggcggcttgggcccctcggacactccctctcgaagctgcttctccccaagctaccccaaaggcactgagcgccctctgccccccagcaattcaattcactggctgtcctgctcctgtcagtactgagagttgcatgtttgaccctcgggggaaaagtccagaggccctggggtgtccagcatgctctgaggtccctgctgctgaccccttgcgctgtcagcattcagagacattcacacagcacagcctcccaggctaacagctgtcatggaacagtggagcagctagacgtggccattctgtggcccagtgctgcagaggtcaaagggacaagcgcagggagcatctttgctttcagaaaaaaaaaaaaaaaaaagaagcacactggtgcactgacctgctcctggtgtctttgtgattgctcttttctttcgatttttggttgtctttttttttttgaaagaggggcttttatgcttttttcctaatgttcatgggtaaaccaatgtaaatgtgtgtatgtttatagagatggctttaaatcgcaattctgcagtagagattgattttttaaaaaacatgggtaaaaattgaagaaaaattttaaaagaacatttaaaccatcttgggctaggggtggatatgcaccaccccacggaagccaaacaaaatctctctgcagataaacatttgcaaaaagaatttccaatcccaatttttgagtcagagatcttttatttccttgcaaattacatatctgtttcaggatttttgactataagaagaatgaatgaagatgtgtttcttacagataactatgaacaaaccaggaaggataataacttgtatcccccaattcgaatccagaggatgggaaggcataaaaaaaagaaatggaagaaactttatttttagtggtaaatggtgggactatgtattttacgtatggtgaagtcaccaagcccaacacttggcacttgtaggcaaggtagtcttctaatctgaatgtgaagtattatgttttcatttgcttggtaatgaggaatattggtgctttcgtcccagttctcgagctgactgacttctctttctgacgtgtgttcctttagcacacctctacactgcatggctctgagatgtcctgtgactgtttcatgtgtaaagttgcctccccaaaggactcacatattccttcagggcagtgagtacttctgattcatccttagcagctaccttcgcgctactttactagatatgttgtagttgaattaatgaacaaaagaacaagcaactttggtgcctggtgtgcatctcagagcagggtggagtgagcctggccaaagggtcatcatgcaacctctgtggctgactccatctggccacggagcttctcagccatgcttggtattcacatgacttctagggcgacagctcaaccagcaaataaacagcttcatatgggaaatattactcagcctttgtcatcaaggagtgagtcacgggcctgaactgaatagaagatagaggagaaaaggtgtgtggactgggtgagacagcgcccagcgaggtgaactcccggcagccctgcctgtctttacctgcacatcaccttgctagggtgccttcggttgtgagggcctgtctaggaagagaagagttgcaccctggcaggcagcactgagctgtctcatgcaaagctgaggaagaaagagtgagctgcccagtgagcctgctggggtggtggaggctgggctgggctgtgcagtctgcagcccccagcagcccttggcacctttctactgcctggtgctcaccagctctccagtaacaaagagggacgtgaagtcagaggggaagggaggtagcacagggcagtcttgactttgaacaaagagctggcttcctgaagtcagctggccgggttttgaagccgattttccagcagtgatctttgatgccaaccccatttaggaattctgtatctccccctaccttctaccagatgtctctgagctcacctttggtgataatcatgcaatctccgtcatccccacgtccacactgccccattctgtcccaccccgggttctgtggtgctgtcggctccccagcgagccaggaagggagaggccagctctgctggggctcctgccgccctggctctgcactgcccttctctggcaggtctgaggcgccactggaggagccacacggccctgaagcagcaaggcagatgccctggacacagtggaggcacagagtgcaagcaccggcctggcccacagacttttggaggggaagtggtattattcagttcaaaagtatgcctgtgtgtaaagagagagcccctgaacatgagtaagcaaaagtctcagcgcagagattagacaagtagaatgctggcccgagaggaggcgtttactcaccctctgtctaggaaggaaagccaggcccagcacgctcactgctatctatcctctcacacagagggattttgaatcgaagccagcatcctgtcctttctccaatgtcccctgctcaggagtcaggactcagcaaggcccaccccagccacacacagatacagttccaggactcagaactcagcgaggcccaccccagccacatgcaggtccagttccaggattcaggacacagtgaggcccacccgagccacatccaggtccagttccaggactcaggattcagtgaggcccaccccagccacacacaggtccagttccaggactcaggactcagcgaggcccaccccagccacatgcaggtccagttccaggattcaggacacagtgaggcccaccccagccatatccaggttcagttccaggtaaatcatctgccttcctccgtccaaaagccttgtttcctgtgtgtccttgtgtttaaaatggaaacgttatgagaaactgcctgccagggcaaagggtgctgcccggcacacagtagggactcaaaatgaaactattgtattgaatacataacagatcaacgggtattgctttctgaaatcttttttagcccaattttgtttcttatagtccaataacaggtcaaattcatttctgatttactagccattcagttgcccataaaaaatggaaagtgatttaagattattagtttaaaaaccaatgaaggtaaaacagttatcattgaaggcacataggcagaaatagattgcaatagttgctgccatgtgaagcctcagtgtcatgctccatatttagagagatctatgatttctgaggccctttcatgtccatgatctcagtactgctcacaactgccctgtgaaattcgccgagctggccccatgtcaatcagagtacactgagcactgagacccagcatgttgagataactggctagagatcatcccataatggtaccatcacaatcttcacactgtagaagtttgatgatgtcactggaagcatattccacagtcccttgtgaactggccttcctgtgatcagaagcatcagtgaactcccaagagggtgggaactcccaagaggtattctcactctacttagtgtatattttacaaatcacaagcttggctttggattcttttaatggctagaaggagaatcatggggttggaagtccaccagtttgggtattctgttccctaactcaaaataaagagatgttattttcaagtcttctgcttgttaacttaattagagatacatgagtttgcagctgtgctgggcatgccgcagcttggcatgtttagtccagaaggcatattataatgtacatggaagattgtcagaaattcaaaaggactttttgagtatcacatgtgtattttcaagttccaatatagattcacattcagtttgacaggtatctttggatgcctatcagttaagaactatttattagttgtggaataaaatagggtaaaataaggaacaactgaggaaaaaacataaaatttgctttgtgaataaaagttgtcttcaaaattatgactttttccatcccacaaaagttttgattaaacccacaatgaaaatttaaataagtgtatttactttggtttaaccacttatttcattatgactcacaactataggttttctagtttccattattacaaactattgtgtggtttaaatcaatttcatagactagtctagttctatagtcacaatttataaaatttttttatgtggtaaattgagtgtcttcatagatgtacatgattatttctcaatttttaaggaatgtattttttaagatagccttctttagccttctttaacactgatttttgtaaattttttacagatttttttaaatttttggtaattttttagcataaagtaatacatggtcactatggaaaacataaaaacacaaaaactatgaagagtaaataagaaaaacacccagaaatttaccattcagaaaaggtcattgttaacaacacggtgtatcttcctcctgtcatgcttccgtgcatttgagcacatttgagatgtgtatacatgttcactttgagattttagtatagcaaaagaaatgaccggtcctgattcaatgaaacctctggcaaactcgctatattttccttacatatttttaagttcatcctataaatgaactatccattcatcttatttgagattttcttaaatctttcagcaagaaagcgggaaaaaaatcctcctctggcctttaaagcctaattaaatatatgactaagctagaaatattttataatgaccaaccagaaagtggcaaggactgtcactcttcccatacagcccacctcctcctctatctccctcaggcacacggaaacgagaaaggcagagaaacccaggacaagtcatccaagactttggtcacatggccatccattgctttcacaacaaaaatataaatccaacatgtgtgtgtgcatttcataccagtaggtccaataagctatctatatatacacatatgtgtacacacacacacacacatccttacagacactccccagcttactacagtttgacttaagattttttgactttacgatggtgtgaaagcaatgcacattcaatggaaaccatacttctaatgttgaattttttatcttttcttgggttagttgatgtctgatatgttactttcttgcgatgccaggcaatggctgggagccagagctcccagtcagccatgcaatcaagaggctaaacagctgatactatacagtggactgtgtcaccagcattttggggatattgtgttttgtgtttttgaatcctatcatgtctacaaaatgccattttcgactgctattttcaatttagggtgggtttatcaggacataaccctatggaaagttgaggaccatctgtatatctggtagggaaagatggataacaaattcataggcaaataataatttcatgattattattaagttattcctacttaataataagtagtgatcactgccagggagcagagaatgcaggataatgtgacagatgtaatggtgggtacttaagctaatgtagttgcagaacaggcttttctagagggtaggcctttaagcgtacctcgaagatgcaaaggaagcaaagatgcgaagatctgggctggggatggaagcagagacaacttggaggccaaggggagagactgacaacagcccagctcatacctcagcagcctttaatgcatagctaagaaaacaacaaattaaaacaattatagtttacttagacgattctaagtgtctaagtggatttgggcaaatctggagaaacttgttctaatactgtgtcttaataagtaatatagatttgcccaggcttgtgggcagagtggtatacaccccataatagcagaggaaggccacagggcctaccctacaaaaccagaggcatttaaaaacttaaaggaggcagattgcttttattttcagttaaaataaagtgaggagtttctcaagaaaaataataacgagaccaccggcccgccctagatgtccaacaagaatgcacagataacttcgtatatccactttcctgaacctgcccctgacagccaagtggagcacaacaacagagatgaacctcaaaactactgtgctgtgacataaggcttgctcaagaggacagtgtggtgtgagtccatctatgttctaaagcaagcaaagctattctgtagtgaaaatggatcaggacagcagttgcctctggtgtatgggggcagggatcgactgggaggggcatgagggatgacagttagggtttcgatcatgacaggaattcagattactccagcatgtgcatttgttaaagctcatcaaatgctacacttaagattaatcctctcacagtttgtggatgttaccttaaaaacaacaatgatgactgcaaactaatattgaactctggttagtgatataccaatgtgaagtatagtgatatctctactttactttaaaatgcatccaaaggcagactagaggaccatatctgacagacagaaaaatagatatgtgataaggtgaatgtagtaaaatgctaacataaggatgtttgcggtacaattctttcagcttttctatacatttataaatcataataaaattttaggacaaaaagttagtgctttgaagtcctaagtcatagggcctgctgctcttgatgcagtagaatttgtcttcagatttgcaaagggtaaggcaaaccactagcattttgtatggaacttgatgcaaatacttttaattgtctggttttcaaatgtatagacttaaagtaatatcaactctttctttgaatcaactactgaaatacctagtcttaaataaatatttttatgtaatccttaaagtactatgtattcatttttctttcttctttcttttctggtttgataaatattctataaagtaactgtgtttaatggccaacatttgagtaagtccatatgcagatccaaacatctcagtttagacaataacttaagacaatatagagtggctgacatcccctaacgtgggtccagatgcatgttatgttatgtttctgttgcattctcaatagttaactttaataaaagaaagtcaaaagcttatatattttttcaatcttcaaaacatttctgggaggttgtcttagttaattttatgttgctatacccatatcacagactgggtaatttataaagaaaataaatgtatttggctcatggttctggtggctgggaagtccaagagcatggcattggcatctgcttggcagctggtgagggccttcatgctgtgtcaatctatggtggaaggtcaagagagcatgcatgtgaggtggtggggaagagaaaaagcgggtttaactcatccttttatcagggactcactcccgtgatagctaacccattcttacatgaatggcattaatccattccttagggcacagctctcatgacctaattataatacctcttaaagtttccacctctcaacactgttgcattggtgattaagtttccaataaacgcactttggaaaacacattcaaaccacagcagagatcaacgttattgtcaccattttcatatttgaggaaagcatggcacagagagcttggagaagtacttcaaggtcacccaatgaggaagtggctaaacaaaaaccttatcttaaattaattaaaaacctcttgctctttgcagttttgtcttaaatctacctaatttgtgactgtaatttttaagtaatttactcatataagtggtctcacattaaattttctcattgctttatatttctaacatgagatatttggtataaggatggaaccaagatcataccttgttttaattagaaaacctagaccaagtcattgtgatcctcatcctagatttcagttaaatgctgctgtctccttttgggtatgtgacaggggaaagcctcagaagaaacaaccttatgtgttttcttttgatactttagtaattaacccaggatagtattcaagattgacatgccttatattgaatcaaatagcatatcaactgccttcttattctcaagtatagacatgttgggtaattgggcatttaagtttctttgcaattttttccattattaacaaaattaatgagcaacattctgcataaggtctgtttcctcagaatacgtttcccaaagtggaatcatcatgacgtagaatttaagcatacttacttgtttaaacaaattgtccagttgcttcccaaaatgttttgtgaattaagatttacatcaagaatatgtaatgttgttactgtctcccaaatacaggatctttttctgaatataaaagttatacatgctaattgtagacaatgaagggtcattatcctcatagataatgaagtgcttctaatacttgtgcttttattcatttattcaaaaagtgctaaataagccctgaaggggcttttggggggtcatttggggcttatttagcactttttgaataaataaataaaagcacaagtacagtttttttaaaatactgttttctataatagattaatcttaaatggcatgttttcctttattttactgacaaaagttacttactctgtgattgaataataaaaattctttggttcagctgagagaaacttgcaagctgacgtccttgattatttaaaatgaaagcagctgcctgttttcatctctctgcatcctgaggaaactcttctgcaacgtgttccagccctaggttctagctgaccctgttcatctgtttggcacgaggggcccaactaacacttgcggctacctggacgacagccaatctagttggaatgagagttagaggccatagtctgtcagctgggaaagcagcttttattccaaggtgtgccaaccgaaaggccacatgttattgtcacaacctggtacctacatcagtgctgacatctttaagaaccttagaattgggaaatcagtttagccctatctgcatgtgtagccgacaaccacacaattgttccaacttgaggttgcattcagagcaacctcatttcccccatactcctgaggaaaagcagaccagagacgctgggtcaatccagagttatggttggaaaaatgatggaataattctgcccctggtgataggagagagggactccatcttgtcaactgtcatggttcccatgtgaaagctatcattatcactgaaattgaatgagaacacagaagggaagaacagggaaatccccacagagttaaagaggatgtgaagattgcttcatgtttaatgtttgtgtaagtgctttgggttggttatgtgctgtctgaacatgtgctcatttccatggctcattgagagggcagacagtccaatgatactctttagaatcattcccatggggaaggaacaaagaagcctgtaaaatagaaatgcacatgtaaaaagcattgaagaaagtgccagtgtattgattttggccatggtttgtgctctaccacctggttactgtgattgcagaagtgcctttgcagatgaggaagaacctggccaaggctcaatccaacatccaaagccagaggccatatttcttcactcttaagataatttgggttcaaattatagtccctttacacactctctgcctcaaaaggcccaagactctcttttgttatgcttgcctaaacatgcctttcaaagaactagttctgtaaatacaactttattataaacctctcctttgcttttaaaaatggatcaccacgtccatttctatggtccaactttgtcccttaatttaaaattttttcttggattaagtttgatgccttgaaacattaggaactcaagcatacaagattgtatgctggtggtgagggaagtaactgtgcctccgcctgtgctgggtggatcaacatggagtgtggacgagcatagggatgtgtgggtttctcactagctgagagtgtttttaaatgttgtattttgatgtttgttattttctgaatattctacagttagacctttgatttattctttgatgcattcatttgaataatatttttaatctccagccagttaggtttttaatttacacttttgtccctgattttaggtgtagtgttgtgtacactactgcccagtgtatgttatgtttgtaaacattcattgcacgcacaacaatgtgactcacaatatttttgagaagtaaaaagttcattatatagttattaactcaaccctacagttatattcgtgaaataccttgtgaaatttattttttgcctactggagctcttacaggttaatcctgtcttcaagattttcatagaattttcatctaccacccacccctttaaatttcaacatttttttattttggcattttaatgcaattcaatgcattatagggacaagctatctcttattatgaattgcaccttatataaacttaaagatcttttatcacaaatttctttgctgtgtcctttagtgagaatttgtattatcagtcactaaagctcactaagttagtaagctttgcgcccagatgacctgggcaggaatgggtgagtctctgtgtggagagagtgaagaaactgctacccttaatacctggaccttgagggattgttttattttagtttttctgcatttctcagtatttcatgtgatatctgtctttttcttccagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaaggttggtgactttgattttcctacacaaataaaattggagaaaatctaagtggagaaaggcctgggcagaattccacttgaagtgtgtttatttttgctatggcaatgacaagtcttacagagctacaaacgagagttttatgagaaagccattttaccagctaatgtcaagtaataactagaaaaggatatcaaatagaaacaggctaatctggagttccatgtcatcatagacactgacgtttatccctgaccattacctcagtcatgatgtgctgccatactcgctcttaaaaactttttttaaaagccctgctttgcaccatttgcctattcccttagtgtaaatactcctactatagctgatttcaaggtaccaagtttcactcagctggtcacagaattcttatttcacgataggcgctaatgaccccataggagccagctctgaaggcttcagagtttcactgaattttggatggggtttacttagccttcttctgtttttcttttacctttcctttttaaataagaaataatgcaagacagatacaaagtaattctttttaatttccattttcactggagagtgttgaaccccgtgaggcatgagagcacagtgttccagaacaatgcttactgctcattatcacaggggtcaaaggctaacgtgcagggattgttgcagatcgtggacatgctgcctcctgtgtccatgactgcaatcgtctacctattttacagttgttgagcactcgtgtgcattagggttcaactgggcgtcctagggctccctggacccattttagaccttgagttcttgagttcctcaaaagagaaatcacgcatttatgttttctcttcttagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggtgagaggctgggatgccaaggctgggggttcataaatgcagacagcagttccgatggctcccagcgagcttgtcactcaattccacctcggagaaggcttttatttttacccagtacacgtgcactgagtgccggctgtgtgtaagatactgcaggggaagttactgagaagatggcagatactggaatgggaagatttaagcggggtaccagtgtttacatggacatgaaaaaatactgagagatagtaagaaatcgtaaagattctgagtaaaagagagtatgaccaaacaagctgagcaggaatcgtgaatctatgtgtgtaggcagtgaataaactgccagtcttattacctggacctcaaggataaaagacatacagtaaaaatcaacccacattgaggacagtttcgagagtcgcgctgctacacagaaagccctgtgtaagttaaggatagagaatgaggtgttctagaactttgaatttttgtgagcaggactcgtgaggttcctgtgagaggaaacaatgaaggatgatagaaaagaagggaaattgattttaaaaaactggagatagcagtgattgtgcctcactgtgcagtgggtttggggccaggaatgttaaattggtaacttcatttaacgcccacaacctttcttcaaagtaggcactgtacagatgccccttgacttatgatggcatcctatctggctggaccccgccgagggtgaaggcgtcattaggtcggatttcagggctaattgaatgtatattgccttcacaccatggcaaagtcgaaaatctgtgttaaatcatgctaagccggggactggctgtgctctgccatcgtacaaataaataaatggaagtcaagtaactcccttgagggccccagctagtgaatggagaggccagctatggccaccactctctgccccagggcgctcaacgcccctcctgtgccatgcagttctgacagggaggcagtgctggtaggaaaggggtgtgatgaaaggggtgcccagcagagggagtcatatccggagtgacaggagcccaacaggggtgcagcgctggaacccaagccagcacctctggtcatggctcctcagttcaccgcctataaaattgtgtggttcccccacaccccttgctgctcagagcagccgcgcacatgcttgtgctgtgcgtgcctcctgtgagatggcctggtacaccggttcctacagtgcgcctcacacgctgtctcggagggaggcagcctgtgcgggtgcctggacctccgagccagaccctctgggttcctgcctggccccgtccctcagcagccagatggctcgggagcacattctccaatccctccgtgtctctgtttcgtcatcttcaaaaatgtggatggcatagctgctaaaaaatggtgacatacttcctaggtggtgcagaaaattaagtgactgtaggaacaggcctcagcagctccttccacttccttggtatgattgttttttaaaccaaggctgggattgtatagatgcagattagttaatgtgataccattaatagctaacctagtgcctgctgcagggtgagcctcccctaagccaccgggaagcggctcctgcagcctccctcacgtgtgctggccctcctctggcagtcattgcctgtggtgtgctgaaggcccagctctgactgtgcctctgtgctctcctcgccccgccccctgctctctctcaggtctttggtctgttgtccgagctgccacagcagcctggacatccctgttggtgtttccagccctgtcctctcctgagttccatccacctgtgcatggctttttcatgagtgttttcacggatggttctgctgtcatctccaacctgataaacaaagcaccacgattcagcccttatgaccccaagcttccttcctcagttccttgcttctgtgcatccactgaagaagcctgttccactgtttccctgcactgggtctcctgtctgcaggaagccttcagccctcacttccacactcctctaagatgtgtgcctgtgcccttctggggaagctcattttcctagcagcctccaggatcttcaggggtgaatccctcctttcccacgttggtactctgtacacacaacatgcccattccctgcctggggagctgggcattgcttcatgaatcagaggtcaattttttctctattaaagtcacagatgctcattgcaccattgtgagaatgaatgaagatagtgcttataaatcagccagcaaggtacccagcctcactgtgtcagggtctccctgggcatgaggtggttagagtgtgtgacatgtctgtccccaagcctgtcagctcccagatcgaagccagtggatctcattcatcctcgcagcgcccacagcacttgcacagggttttgtacacataagtcattctgtcaatgttcatgtttaatgtcatcagtggaacactcccactttgtaaagacttgaatgtgttcatccctgacttttccacatcttgttagttcttctttggaaacagctgtacagtttcaccatcctgtgcatccctggagtctacctgtctctgtcatacattcagattcttcttgtttcgtgtcactctcatatccttttctctaatgaaaagctccgcctgggcatgcaaggtggagccctggatgccagcccctcacctggcatccagggctgtagcactcaggaactgcctccctgccctgcctaccccctacatcatgcgaccattccagtccagccaatcagccccttgggacccagcttaccacatgcatatcatttatgctgtgaccactgactaaaccattctcttccttcctccccatatttctaaatttctaatcattgctcaaagcccaattcagagaaaaccctagctcctccatggcaccatcattaacaattttatctggccgccccccgggaagttcactgggctaattgcgggactcttgttcgcaccatggcatctctttagcagaacataaatgcgaagagcacatgcatccttcatgggaatttaaaggagctggaaagagtgctcaccgcagttccattctcccgcagaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgtaagtgtcgcatacacactatctctgcctccagctcctatgggggacagctctacagcactggggcaggggagagaagccatgtttagtaagtcacattaatcagaaacaaaaagtagtaagcaaaatatctgaccactagaaaagcatgtatttaccacggacatagagatcgtttttttgtggcgggtggcagcccagctggttggcagtgcaggccaccggaggcagatcccctgcagggacagcagagcacttgtgtcctgagaagagctgctgttcatggggctggcagcaccagggcctctcctagcctgccctgctgacactggccagactcctacatgcttctgagtctccagaggctacccggccctcctgaagcaccagggctgaatccacccccagctgagggcatgaacactgccacatggagtcacacacacagctgggcactgccatggagaggaagtctgtccatgtttccttgaatactggtggcctggtccctgtcccattccccagtgaggcagcctgtggggaagcctggcagggaaccaggcgcaggtcagcgtggcgccctgactcaggccagcactgatgggggactctgagacgcaagctcacactcacccagctcccctgggctgcgcccgttcctgatcgcttggactttctgttctttagagtaagaagtgatcaccatttcctgcttctttgtttctccacaactgtgcagtggatgcctgtttgttttctgccctcagaacaaaaaaaaaaaaaaatagagctgacgtgaatcttcaaaatcatcaactacagggctttggatttttgtgtatttgttttattttcattttatggatggattgtgatgaaatgcccgtaatacaagattttccatcttaaccattgtaagttacaatgtcagtggcattatacatccacatgggtgtgtggccatcaccaccgtccacacacagaactcttttatcttgcaaagctgaaactctacccattagacagtaactctctgctctcccttccttcccagcctctggccctggcaggcaacagtccacttgatgtctctatgaatttgactgctctggggctctcatacaggtggaatcatgtagtatctgtccttttgtgtctggcttatttcacctagcaaaatgtcccgaaggtttatccatgctgtagcacgtgttaagaatgtccttcctcttcatggctgaataatattccattgtatgttgacactacattttgtttgtccattcacctatctacagacactggggttgcttccatcttttgactgtttgaataatgctgctgtgaacatgggtattgaggctctttgttttatagacatattattccaccagatacccatcctgacacctactatgtttgcaagaaactgaaagctttattttacattgcaaaatttcatattatgagatcaaggttagcatttcctcagctgtctggtggacaatggggaggttaaactgtgcacattttatttttttttaatgaacctggaacggttatggggccagtgtttgccatggatcaggtcaggcagcccacaatggcaggtctccatgttctgtacaacaactgtgggaaagacccacagagaaagtgctggaaaggggaatgatgggtaggttcatgcagtaaaaagattcaaatactacagggcattgaactataggccaatatagcattgctttaagaataaacaaaaaataagacagtaagaataagcctagcaaaatcaaaagtctataaagaactgacatttcaagccaataagagaataattccttattcaataaattgtctggaatgacttaactattaggggtgaaaatatcaaagtgagagaactataaagggtttttaaaaaggaattaggtatgttgggttagtcgcattggagagtgcaaattcaccatcgacctgatacctgaaatttcctccttaccatctagaggcaagttgggaatgctgccaggctcctgtggtaaaggaagctcctctcttgactggtgctttatggctacacgttcctgctcagaatggatctcatttagtcttcaccaaaaaaaaaaatctcatgagatgatttaagtgttttatggacaagatgtctaaaactcagaaaaatttcacagtgtgcctagcttttatgtttatgttgaagttgggcattagaagttagaatgaatgggtttacttcagagaaaattaaatccatcacccactccttgtactatgaattccaaatacatattaaatacatataataaaatatttaatatatatgtaagtgccagaaggaaacataaatatgaatattttgtaatatcaagttgaagaaaagccaaaatctgacatcataaaagaaaactttcaagtaaaatatgttaatggctaccaggaaaatattgtgcaatgtctgattgccatgaagagggttaatatccttgctatatcactctgtgaagtcatctttaaaagactaagaaaaagatgaatctcttaataaaaacctggcccagaacatgagcagcctctctctctcactctcactgtctctctttctgtcacacacacacacgcacacatacacacacacacacaaatatggccaagaaataaagtaaaatgttatttctaatgtaataagtaggtcaaaatagaaaaagaaagcatcacaccttcctttgcaaagtatttgggttccttttgcttttaaacacctgggtcagctggggtgtcgagaaacagaaattctcacgttctgcttgtgggcatatatgttaataaaaccaagcttggcaatatgcctgcaatatgtatctaaagcttcaaagtatgtatagctttgaccaatcaatatcacatttcggaataagagaaaaagaaataatgaaagtgaaaatcataagagatgtagaaacatattcttatacaagaattccttgcagccttatttataataaattttgtgaacaaattatatatctaaaaataagagattggttgaaaaaattatgcagcagccatgctattgataatcatgttagatagaagcatatttaaaggcatggaaaaattgccatgttttatatgggtttttaaggttataacacaatgtatagtgggattccaattcctgtatatacatagacttatatgtctatattgattaactctggatgagtctcatgtcttctttttgctttcttctattatccatattttatacgatgtgcctgcatttcttttttgtaacagatggtcaatactagaatcataaacagatcttgtttgtttattggcaaatgtttcccgttagaaaaagatgcatttttcttttaaatatttttattttatacaatgattacaagcttataatagaaatttgaaaattatatgtgagtacagggtaaaaagttgaaagaatgggattgcacgctacagatctagctgcttttagcacgcctgcgtaggaccttgctttctctagacctctgttgcagtctctctgcctacctcctcacaacgtccatcccccgcggtcactgtcgtgatgccagcctccccggccttcatgtctctaaggagcaccagcgcggcaattagcgccctttgccttggtggtattctggcttcacagtcacatgggagatcaatcgtcagcttttctgtttgaaatctaaattcttcctgactgcaggggacctcgggacccatgaacacctctagtttactatgtcttcacagtaaaagatatctgcatgactggactctttaacaaatttggtggttaacctactctttctatatagatatagcacttcgaccttcagacttctcaatactgataaaaagaaaacacgacagatgacaggaaaacctttgcagctataatttgtaatcggccaattataaaaactgcaaaaattgaccagatagctaaggttttacacagtcatgaaagtgatctgcactgttaacatttcaccctctgtgcaccattctgtgcttctctctggtttggagtctagaaggttttatttacaggctatgacttaacaatcccagaacggctgacacatgcagtcactcaagactggacacagcaaggaagtagtgggtccatgccaaaggctcagccagacgagacactctagctgtggcaggagatgccagggaatgctccaagcctaagcagattgtaaacaaggaacctcaaattcatgaaaaattcttgcttatgtggcccatgtcagtaattactctctgcctcagtttccgcagctgacatgtaaataaaagcagttcatggttcatcttcttttcttatcggggtctcaagtgattctacaaaccagccagccaaacaatcagagaataagttgaaaagattgtcttcatttattgaatgtgcttaactcaggcccgggaaagggcgtcatcagtttctcatcatttcactgagatatgcatctattacttttacatttcaggccaaaagtgtgatccaagctgtcccaatgggagctgctggggtgcaggagaggagaactgccagaaacgtaagtcagtgaacagcctcagacccatgtgtgaccgcccctctcttccttcacttgcttaggtgattggatttgttttccctctgaagactccaaagagttactttattacagggtcagatgtgaaccagtaggtgaaggacagtcttgcaaatctcaccgcatgcagttaatccagggtgggctattttgggagcttcagcctatcacaaataagtgaacatcagcaggggctgggcgcggtggctcacccctataatcccagcactttgggaggcggaggcggtcggatcacgaggtcaggagatcgagccattctggttaacacagtgaaacctcgtctctactaaaaatacaaaaaattagccgggcgtggtggcgggcgcctgtagtcccagctactcgggaggctgaggcaggagaatggcatgaacctgggaggcggagcttgcagtgagccgagattgtgccactgcattccagcctgggcgacagagcgagactccgtctcaaaacaacaacaacaacaacaacaacaataagtgaacatcagcaagtaccccagccctgtcctctgaacacagcacactttcccaggaatggaagacttgctcctgttgacagcagtcaccagacttcttgtttcctctccctccctggctttctttggtacccacctacacagaagcctgagcacgggttctcatggggacttttccatgtggaccctgctttacgatggagagggccattctcctaggtatggttgtctggctcagcctctcagtggccaaggaacctggggacatgagctcaaaaacggacactatgtccttaagctgaattgtgggggggctgttaggcccttctaaacactacttcccagcaggtatttttgttctttgtatgtgctttctgcattgcccaagatgcatctaattatttagcaggtctcaaagtctagacttgatctcatgagttctcttaagtgattaaaaataaatcaggagaaaaaagaggcaatcagaaaagggcatggtttgacttagtttgaatgtggtttcgttggaagcaaatgtgtcttcactttttcatgaaaaagtctgcaagtgctctgcgacatccctgggaaatgatcctaccctcactcttcagctcacagggaacctttgctctttttcagtgaccaaaatcatctgtgcccagcagtgctccgggcgctgccgtggcaagtcccccagtgactgctgccacaaccagtgtgctgcaggctgcacaggcccccgggagagcgactgcctggtaagatgcccctccagcagcctccctggagcaggctggggctgcacccgccccacccacaccaggacagaagacttcctgtgggggagctgtcaattagcatttgtcataacagacaggatattgccctctgcctggtgacaaagtatctttagtatcctgcctccaccactcactgagaccttgggaaaatgatgggactaccatgcctccatttccttacctgacaatgatgcataacaaagtctctcccagttgaatgcttaaatgatgagatgcctgtgatgtccgtcattaggacctgggcacagaacaagcactaaatactacatgcaagtatttgtcatgaatgtgccttgttgccagcagcacactctctttattgtttgacttcggctatacctctagagacttgacactgtgaggtccctaagagacccatggagagccacacaggtcttgctggctggggctgggttagggcctcctgacacggatccctcggctcctccaccactgctcaggcacctcctgagctgcaccctgccctcaaggggtcctgaagtactcactgtcgccccattgctccagaaagtgccagcagaagccttgctgccccagcgggctctgagcagcactggagggtacaggtcagaagcgtcttggaagtcctggagacgccaaggctggtggatgtgactcctggagtgggagctggtgtgacgaagcccttcctaagactaaatccagagcactctgtggtttcagagaagattcctaaattccagagtttggacccagacccaggaattgtgacttggttggcctgagctgtttctaatgtgagccccagggagaagactgtgcgtggggttggtcctaggaaaagccctcgctgtattgggtctggctcctttacacggcattgttctagcaaggctttctgccattcagcaatacattataaaatataccctcaattgtactttataagggaagcccaatgtcctttataagggaaattaaacataatttcattccatagtcaccgctataatgtgtgaactccatcatctatacgttagtaaacagacgtatttttatcataatccataaattatgataggtgggacagtgcacctaagaaaaaaatggactttttagagaagggtctttctgactctgcagagggcgccagctgggttttcccacactagtggaacactaggctgcaaagacagtaacttgggctttctgacgggagtcaacaccgtgctgcgcttcctccgtgtgtggcgctgagtgtacttacctcacttgcccagcgtgtcctctctcctccataggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtgagtcctcctctgtgggccctctaactggtcaggcatccttgtcccgctctgtctcctgctgagccctggagtatcccatcttggagagtctttgggtggatgtgtttgccttgcttggaggaggcgaccctgtgcccgtccaggcacacaggcgaggggaggggctggcttgctaccgaggagcgggcaggtggtggccatctccacccatgggggctgctcagtgcacagggcagatctgggtggccaggccacctcacaggagaaacacctgctgctcagccctcaccactcatccagcagccacagccgtgggtattcagttgtctgctgggcacaaagccgtgggcatgccactgtttagtgcttgtgccaagcaggtatttaatacaccgaaatcagagagtctatcagaagacctgccttcttgagtggttaaaattctagtgaaagttatgcctcttaggagtattgcagaggttttgtttttgtttttattttgttttgttttaatggtttgggtttgagttttgcttgtttgtacttacatttgtactggtggctccagggtttagggaaattgtgacataaaataattcctgacagagaaagcaaaactttgtctaatgaaagagttttagaagccactcttgatctctagaaggggagattaactgagaaaaaaaattgaaagaacaattatgagggggagattttaccctgccagatttgtgtacatgaaaaattttacattccgtatggaaaaaaaaaacacaaaataataagccattataaggtaaatgacaaacaaagctaaagaaaaatgtgccacagtgatgacacagatatatctttgagatagggcttaacagagctttaaaatccataggaaaacacttcgagcctgagataccaagagcagatggttcacagaagaatcatcaatgtcctataaatatttttgaggatcttcttggggaacttaaaacaggaacaggccaggcacagtggctcattggctcatgcctttaatcccagcactttgggagactgaaggggctggattgtctgaggtcaggagtttgggaccagcctggccaacagggtgaaacctcgtctctactaaaaatacaaaaattagccgggcgtggtggcgcacgcctgtaatcacagccgctcaggaggctgaggcaggagaattgctttaacccaggaggcggaggttgcagtgagctgagatcacaccactgcactccagcctgggtgacagagcaagactccatctcagacaaacaaaaaaggaagacatagagctcctaaaaataacgcagaagtctgctattaatacaaatgaattactttaaaggtgagagcaggtggaggagagggctgaggtgcctgctgggacgcaaaacagctggcccctcaagggacccagtgtttcctgccatgatgaaacacctgtattgtccacattgcggcctagaatgttattaaactcttgaacgggattccttctctatttgcaacctttcattctttgtccttaaagtaaataaagccaaaggaggatggagcctttccatcacccctcaagaggacctggaccgcctgtgtgaggcccgagcacctggtgccaccgtcatcaccttcctttcatgctctcttccccaggtaattatgtggtgacagatcacggctcgtgcgtccgagcctgtggggccgacagctatgagatggaggaagacggcgtccgcaagtgtaagaagtgcgaagggccttgccgcaaaggtaggaagcccgccggtgtgcggacgaggcttgttctcggctgctgaggctgggctctcatgccacctccaaaggaacacatcttcctcttctcattaaaaaacaactatacatatcgtttctttaaaacagaagataaagctgtaaagctaggttaggcaatgggaaggcactgaaggttgtgacggggtggggggctctgatgagaacagtcacagagccagccccgctcagcagctgccaggtgcccagccctggggagaatccagggaaggcagagctggaagcagtgcagctccaagcggcccatgggaaataatgaggagaacgcaaggtcagtgtgaggtgacagggatggcatctcctacaccgccgtagccccaaagtgtactataggtcctggtgtccccccttcccgcctgcactctccccagccccttcagtgtttgttgagtgaatgaaggatgatgtggcagtggcggttccggtgaccggaattccttcctgcttccctctgcctgtggatccctagctattcttaatccaacaaatgtgaacggaatacacgtctctcttatctctgcagtgtgtaacggaataggtattggtgaatttaaagactcactctccataaatgctacgaatattaaacacttcaaaaactgcacctccatcagtggcgatctccacatcctgccggtggcatttagggggtgagtcacaggttcagttgcttgtataaagaaaaacaaaatctgcctttttaactggtagagattggtgatcaataatcaccctgttgtttgtttcagtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaatggctgatgttttgatatttttcaaaagtgcagtttctcctgcaggcaaaaggggacacgttaagtccaggcttgggtcattcactgcggtgtaaacacgctttctccctcccgcccggccccagccagctgccttggtggcccataacccctgagggtagagggaggggacaggggtaggtgacaggcagcctgggcctcaggcttttgaaactggacgccagagccttgtggggccacgggcaagcctcgggtctatgactgccgcctgagctccgcttccttcctctctaaaatgggaagattagaccaaaataacaagactgttttaaggttggaatcaaataaggaaaatttgtaaagctccttgtatgtgataccagatccacaattggcagataatcgcagcaggagcctcttcggggtaatcagatacgcggcgcagcaggggtctcagggccacagccaggggggcggcgggagacatgcggaatcgcagcggaaggcgggaggcagctgtgaactgtggctcggcctgcgtccgccctgcgcatgtacactcagagaagatgataatgaaaaagaaagcaaatccaattttcccacttactgttcatataatacagagtccctgagagtctagagtaatgtctcatacaaaaaagaaactcctacgtggtgtgtgtctgaagtctttcatctgccttacagggtttttgctgattcaggcttggcctgaaaacaggacggacctccatgcctttgagaacctagaaatcatacgcggcaggaccaagcaacagtaagttgaccacagccaaagcctggtagattacatttgcctttttagttggaaattaggcttaacaggagagttgctaagatagggcacagagctcctgcatctctcgccggcattcccaaatgctatctcacatgagcaggcacagggagcaagactgcacgaccactggcacaggctgtccgctaaaccacagacttctcagcgctcgccagtgcttctgcttctgtgtccactccagatcccacattgcacttagttgtcaaatcttttcagtccatttctaacctatattagctcctgtgtctttccttgtctttcacggccttgacacttacaaaacgtgtgggtcaggtactttgcacactgtctaaccatgtctgttcagctggtgttttctcaggatgcaattgaggttatgcacatcttatcacagggaccagagagactttttagcaccactcttcaagaatttccactttttcagctttgacagtggaatagacatgcaggtgctcacacacaagcatctttaatatggtaatggtaatcatcagtttagtggtgtggaggaggagatgggaatctcttagtgaaacccgccttggaagcagcctcgttatgagaactgctgcccctacttgactcttaaagcactagataatactgtgcaacattaaagagaataagagtgcgtgaaatatgcattgcctcccataaactcccttggctctgaatctctgatactaaatatgtggctaccgttgcttcccagaaaggcctttttgctctgaattctctggaatgctttctttgaccaagattcttataaaaataagagatttagagcaattttcttggatggctggtatgagccagttggcttagttgtagggatttaaacaagataagggttacttacttttcacatttaatgagaagtctggtgattccagctcctactgagacagggtggccacacgttccagggtgtgactcactgaggccccagacctgccctgcaaggaaaacctggctctgccctggtgtcctggcctccctgggcatatgtgggggagaattcctaatggtattggttacaggctcctatgcgagaccactcatctgtgtaggagaaaggaaaaagatgggggaaagaagagcagcagggagaggagaagcctctggatgatactctaaccccctgccatccaacacctgaacatcagtctcttcatccagtgctctcagctggcccagcccccagcctggggtcagatgagagcttcctgcaaatgcagatctctttcctgtggctccttctcaattacagacagctcctccacaaggtgcactctggccttgtgctccctccccaaaccagcccagccctcccagcctgcatcatcgtggtcctgtaggggctagaggttctcacacccatcgtggtctggcagaggctggtggttctcacacccatcgtggtccggcaggggcttagtggttcttatacccatcgtggttcaggaggggctagtggttctcacacccatcgtggtctggctggggctagtggttctcatgtccaccgcgtgctttcctgctcctccaggtggctgaggacatccccccttcggtctgaatgacttccatccagtcatctgatatacacattggaccacccaatagcatcctagtgtcatgttggatggtgaagaaaatgccacagttactgctttcagggcctcacaaccttgggcatagctttttggaggaaggccccacttcccaggcatccctcccagacctggtcagaggcccctgctctttgcttccatgttgcccacactcactgtgctcttcacaccggctcaaaatgatctgcttacggggttgtgtcaccaccagatcaagcgtcctggagaggaggaaacatatttaacctgcacagaatttgggacagagaacctctagtgtttgttcaataaatatatgaatggatagagggacaggttgggtggtggatagatggatgaacccacacctttgaagtgtatttggctgtttgagaggttagaatatgttctcaatttccaggcaaaatgaaaatggagaaaatataatgacattaaggcattttattcatcctccccatctgccactgggttaaagatactaaataaacaaggaactatcttttgcctggaggaactttaaaaacacctgcagttttcaaaaggtgcagtgtgtgcctcccacagcatgacctaccatcattggaaagcagtttgtagtcaatcaaaggtggtctggagaaacaaagttttcagggatacattgtttttataatttttcaccacatgatttttcttctctccaatgtagtggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcagtaagtcaccgctttctgtttagtttatggagttggttctaatgggtcctttatttgtatttagaatattgaagggctattcccatttaaattacttttttcagttccttaagaagcaaattaaaatcttaagattcctaactgtgaaattaccatgtgaattccattaaaactttttccagatcattaccattcaatgggatgaatttaccctgaggtttaggctaccaattatttgtaatgtaagtaactaaatttagtattagttatattaccttttagttgtaggtcactctctgctcatttcagcctgtaaagactacagctacacacatacacacacagaggaatggaatgagcactttacatcaacacttcctgttctggctctagagcctcagcttttgaagctggtgagagcctggcctgtgctgggccttggccacgggcagcgtcagctttgagtcaagtgctggtctggcctccctagctttgagcctctgtcaattcccttaatctgtttaggctttggcttcctcatccatagaatggagatatgaatgattcctacgccgtagtgctttgagagaattcagtgaaattcctgtgtgtaaaacccttccatggtgcctagcacacagcacacagccaatggcccaatggctcctatcagctgtgggatttgtcatcagaacaccaccagctctgctccaggctgccctgggtaccatcaaaacacaccctgtgcccagcagcacctgctcctctgcacacctggttccttcagcaggggcagtggccgtgggagcacagaaaacatggagtcccatctggtttaattgatgccattgccaaaggggaggactcacggcaccccctctcgggtgccagggtgcctggctcccaccaggaggaagacctgtcctccactgtcaggcacatttcagtcttcccagcagccagcacaactactttgtccttccagtcacggtcggcctctgggaagcccagtctgtgtcctcctccttcaggggtagccagcatgtctgtgtcacccaaggtcatggagcacagggcccctcccgggaaggtgccgtctcctccggcccctcgggtccctgctctgtcactgactgctgtgacccactctgtctccgcagaggccacaggccaggtctgccatgccttgtgctcccccgagggctgctggggcccggagcccagggactgcgtctcttgccggaatgtcagccgaggcagggaatgcgtggacaagtgcaaccttctggaggggtaggaggttatttctttaatccccttgcgttgatcaaaaataaggctccaggttgttgttatagctttacaggcattctgtttgattttctcttccttttattctttgcccttggcttttggaggttttgggttttctgtggggagacgggaagttgtttgattgcgttatttttggcaaatttaagcacaataggaaataagcaagtattattgcctaatataatccaataatttatagaatctcttttcctggaagtatcttaaatttttctaagctacaaaaagttcctaagacaaatgagacagtcatcaatggttcatctagccaacaccgtggccatttgggcttttctttgtagtgcccgattcctggtgtgtgaaaataaattaacacaaattatattgccaagttaatatctgttttatgtgcccccagcatgtgttgaacatcaaacagtaccagggactttaaatatacccacggacaaagaaataattcataatgatgtttgttgaatttagttgcaatcaataaaaagtgcagtttgtgaatgctctgaggttcttgatattgatgtaaggctttgaacgacaaatgaggacaaaacataaataggaaagtaaaactgaaggatagaggccaaggccatgttttagaagatttaaagaaaaagggaaatttggtgagcaccataggaattacagatggctgtaggaattcttcctgttttactctctgggcatggaccacagcttggatccagaaatatttaggagcaggataagaggaccaagttcaattctataggaatcctttagctgataggctcagaacaaatcacataattgatagtgctgcttcaacttcaagtaaggaatattgatgcaatccttacagctacaaatggacagtggtctcatgttttcagttttcaagtgtttcttaagaggcaaggtgatgaaaacgcccacgtggggagccccatgtccttccattagtgtagagaaacctggtgtccagcagcacctgctccctctgcaagcccagcccccttcagcaagggcagtgacccagagaagaagcacagaagacacaaccctgtatcacattttgtttaatggtgccattgaccaaaggggaggatgaaaggcacacacttttttgttgttttttgagacagagtctcacgccatcacccaggctggagtgcagtgatgtgatctcaactcactgcaacctctgccccctgagttcaggtgattctcctgcctcagcctcccaactagctggaattacaggtgtgcaccaccatgtccagctaattttttgtagttttagtagagacggggtttcaccacgttggccaggctggtctcaaactcctgacctcaagtgatctgcccgcctcggcctcccaaagtgttgggattataggcataagccactgcacctagccaaggcacacactttggagaataaacactccttgttcgctgctggagggtagaactatgcttgactactaggcagagtccagtcttactgacaaacagccgtacatctgttctgtcttttcaatcaaacatcagcttcttgcttaacattgatgtgtacatcttgagggatgtcaaaatattgtaagctaagtttttcatacctgtgttccacactcaccatttttagtaataaccattgagcgagttcattctccctccttcctttttctatcacttaatctaaaattatcatttttccagcttaattttgataaccatgaatctggtattagaggcagggaacacctcctcaggactatcttttcttttatcatttggcttgcttacccaatatgcaaaaactatgctgtagaaaaagcagaaaagatatcttgattatgaatgaagctcctgtgtttactcagagagaagatgacccaggattcagttaacaaaatcagctgattatattactatatagtcctggagtcccaactccttgaccattacctcaagttatttggaattttgaagaggtgatttgtgttcctgcaataatgtctcaggggtgggctgacgggtttcctcttcctcctctcagtgagccaagggagtttgtggagaactctgagtgcatacagtgccacccagagtgcctgcctcaggccatgaacatcacctgcacaggacgggtaagagccccttgctgctatccacgtccatttcatgggaagggccttcacagaagccgaacagtgatgatggcccagggcatcctgtgtgggcaggacggccatcagagccacttcccagaggagacggcaggcgctgacagcgctgtccgggcagggtgtcggtgacattagcacacacattagcctgcgatgaacattcactctttctgctgacacccccaaccttatctaagcttatcaaatcctcacatttaacggaggctgttttcacctggtttcccccatccctgacctagtcagcattgctttatcgctttcatcaaacatcctcaaattcttaacattagcttgtaattaattgaagaatttttaaagaaattgctagcaaaactttttaaactgcacaactttgtatctatatgttcaataacatatagatacaatattctttacaataatcttttaaagaatatgagtgagaattcgggcccctctcacaccaaatgtcctgatgttgttaattctcaatgttattatatagggagctctgttttcttgtgagcttcaacagccagttctaaatctactaactgaaaacattttttagacattctctaaattgggcagaagatgacaggactgtgttttgagggataggctgccagcgtggctgcttacaaagtaaagacttggtttataggtttgcatggtgttgggttaaatttctgtcattaaaataattggcgatattgacatagtcatctaattatgctggctctgggcacacacagcccttgagtggacaaaaccaacatgagagaacttagccaaggggaaagcctttccctgctggttttatttctgctacttctgaagtgtggggcacacaacctgagcagtgcttttatttgagtcccaatgcttttatttgagttttgcaaggttattccaagttttacaaatagaaggtagcgtatgactcagtccttgatatgccaaccactgcacagagacttgccaccttcctgtcactggagaaacactcatgtgggttttcttaaatttgcctccctctgagcttccctttaacttcaactataatatgcaagaaagactatctgaccataaatacacatttgggccaatcaagatggttttgccaaggaaagatgcccacaatggttaagcagaatgcaataatgtagagaatatcatttctttcatgctggtgtatatcatatgcattcaaaaacagggagaacttctaagcaactaacagtgaccatatcaagcaggtgcaatcacagaataactggttttctcctttaagaatttttctatcatttggctttccccactcacacacactaaatattttaagtaaaaagttacttccattttgaaagagaaaagaaagagacatgcatgaacatttttctccaccttggtgcagggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtgagtggaaagtgaaggagaacagaacatttcctctcttgcaaattcagagatcaaaaatgtctcccaagttttccggcaacaaattgccgaggtttgtatttgagtcagttacttaaggtgttttggtccccacagccatgccagtagcaacttgcttgtgagcaggcctcagtgcagtgggaatgactctgccatgcaccgtgtccccggccgggcctgtgttgtgcaatgctgcacatcacaacaggagggtagggggacaaaagagcacaggtcctggcagctgccacagtctccaggggcttttgcgtttctctccagatttctaaggttaacatggggattagctgttttgcaatgaataaaaggtaacattgcctggaatgttgcttaaagacacttttttaaagctagttgattgttaagctgttgctacttaaattaaaactactttgggccagacgcagtggctcacgcctgtaattccagcactttgggattccaaggcaggcagatcacttgaggtcaggagcttgagaccaggctggccaacatggtgaaaccccacctctactaaaaatacacctgtagtcccagctactcaggaggctgaggcaggagaattgcttgaacccgggaggcagaggttgcagtgagccaagatctcgccactgcactccagcctgagcaccaagagcgaaactctgtcgcaaaaaacaaaaacaaaaaaaaaagctactttgactggaattagcagaagcactctgattgtgtgtatcttatttactggaataataaagctgtcaatcaaactggatcccactcaacaatcagaaagagaagttgagctgtcatatagtagttcacacttacttctgtttctcaaaatcctcagctttgtttggaactgttactcattctttctctgaatccatctgtatgagttgtgtgcccttgggcaagggtcttaccttctctgtgcctcactttcttttctgtaaattgggataataatgctgcatagctcacaggatttttatgaccatgagttaagatatgtcatatacttaaaatggtgcctggaaaatggtgaatactgagtcaatgatagcatcattgatggtgggatggtgatgaggaggtgggagtcacaatggtggtgttgatggtggtgatggtggtgaggaggtgggagtcacagtggtggtggtgttgatggtggtgaggaggtgggagtcacaatggtggtggtgatggtgttgatggtggtgaggaggtgggagtcacaatggtggtagtgatgatggtgttgatggtggtgaggaggtgagagtcacaatgttggtggtgttggtggtggtggtggtgaggaggtgggagtcacaatggtggcagtgttggtggtgaggaggtgggagtcacaatggtggtagtgatgatggtgttgatggtggtgaggaggtgagagtcacaatgttggtggtgttgatggtggtgatggtgatgaggaggtgggagtcacaatggtggtgatgagggtggtgatgatgatgaggaggtgggagtcacaatggtgtcagtgttgatggtccgatggtgatgaggaggtgggagtcacaatgttggtggtgttgatggtggtgatgatgatgaggaggtgggagtcacaatggtgtcagtgttgatggtggcgatggtgatgaggaggtgggagtcacaatggtggtggtgatgacggtgttgacagtggtgacgaggcgggagtcacaatggtgtcggtggtgatggtggtgaggaggtgggagtcacaatggtggtggtggtgatggtggtgatggtggtgaggaggtgggagtcacaatggtggtggtgttgatggtggtgatggtggtgaggaggtgggagtcacaatggtggtggtgttgatggtggtgatggtggtgaggaggtgggagtcacagtggtggtggtgatgagggtggtgatggtgatgaggaggtgggagtcacaacgttggtggtgatgatggtgttactggtggtgacgaggtgggagtcacaatggtggtggtggtgatggtggtgaggaggtgggagtcacagtggtggtggtgttgatggtggtgatggtggtgaggaggtgggagtcacagtggtggtggtgttgatggtggtgatggtggtgaggaggtgagagtcacaatggtagtggcgatgatggtgttggtggtgaggaggtggaagtcacggtggtggcgatgatggtggtgaggacgtgggagtaacaacagtggcagtgacggtgattgagacatgatgatgatttgtcaactttctaggaaaacaatcatataatctccaacagtgatatcttaatatcttttccaaaagtatcagatcatattataagggccaagtttccagaataatatcagacataatgacagtggacatcagagcttggcatctaaaggtaatgggaatagctctaatgtctcagcgtgaaaaacaacatttgctattagtctgagatactaattatctagttaaggaagtactcacctatacctagtttttaactgttttttaaaatctggaattgattttgaattttaacaaatatttccctgggaacaatgtaagattcttcatattttcgcctttgggtataccaacatgccagctctgttggccactttgtgagctcgatgaagcatggtataaaagatgctttgctagtgtttcacgtaatctatttctataagcaattttggagctaagcctctgaaacagaattatattatctgtatagaataaatgttttatcttcccccttttctttcttctggaatagatgtgcatcagtatctctgcatcaatatctctatatcagtatctctgtgtcagtgagcatatgttgctgggcttaggggaggtccagaaagtgattgggttttggcattttcaatacacttactttgtataagaaatagtttgccaaatatagaaagaggggatttagtcaagatttaaattaaaaatgttagtggtcatttttctaatgtctttctattttttcccaggtcctaataaatcttcactgtctgactttagtctcccactaaaactgcatttcctttctacaatttcaatttctccctttgcttcaaataaagtcctgacactattcatttgacatatggaattttataaatattttctttagtatgtgtgattacattcctgattctgagcctttttagatgagtatatagtttgatataatcttgttattgccacctgtgtcttctcccaaagccattaattatataggaattacacgatagaaatgggtttaatttttaaaatacggccaagtgttgatgagagggaaaatttttttaatttctttcactgagtatttatgacgtgcacaacattcctgaatatattgtctctctcatttctcagatgggatgtattgccttctccatttctattgttaaagaaacacttacaggggtttctttaacaacttgtgaacagcagcatcagagcccagactacagcataagcagctgctgattccaaaagccctaccttccaaccgggcaggtgcagccacccagacgagggggaggaaccctggaggaatagctatttcttttttttttttgtcgagacggagtcttgttctgtcaccctggctggagtgcagtgccgtgatcttggctcactgcaacctccacctcccaggttcaagcaattctcctgcttcagcctcccgagtagctgggattacagacacctgccaccacgcctggctaatttttgtatttttagtacagacagggtttcaccatgttggccaggcttgtcttgatctcctgacaagtgatccacacaccttggcctcccaaagtgctgagattacaggcgtgagccactgcgcccagcaggaatatctatttttaaatggaactgtgttttcatagtacacggtgaggagaaagttgctttgaaatctttatcctaataaaccaaataatatgaaaatttgcctattttaattatatgtaacaaagtttagttactgctataattgcaaatatgtataaattccttaccaaaaaaaaaagaatcaagtgggagccagagaataatttttctgacagaattaaataacatgctatagctgcttgagttcatactcaatagtcatttctgcagagttaccgagggcctcatcagcgtcagcaggagcccctcgccttctgacgctctcacatccttctctcctgcagccccgtcctgccactgtccttgtccagcttctcttcaagggtcaactggtctacctttccctacaagtctgtcacagcttcttgttagcaatccctatggttgcccaaaagcattttcagagcctgcataagactgcatcttgtagaaaatttgcagtttcaatctgccctccctctgccgggtgttcccattgtattgcattcagcaggcagggagagactgctattaggtctgttcctgagtgactgctttctgtctcagactgtttggtgtctgtaggaggtagtggggtgggcagtaacgaggtctcctgtatattccacccctacgaagcctgtgtgtttggtttatgaactaagctcaaaagcaccacaggggtaagactgcagtacatgacaccatggaaaagagggagcacccagacccccaaattaagaagagcagtgtagagaacagagacctggagagcagagatagaaactgttaggatcagattatagtgttacaccagggctccccaggcctctcacatattgaaatgtacttgtccatctttctccaggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccagacacatagtgattttaattatttaagagtagtttagcatatattgctttatgatttaattaaaaatctccaaaatatatgccaaagaagtagaatgagaaaaatgtatatttctctttcacttcctacagatgcactgggccaggtcttgaaggctgtccaacgaatgggtaagtgttcacagctctgtgtcacatggacctcgtcaagaatgaccacactgctgtgggtgaagatgctttcctgcatttctgactgtcctctgtcctgatcaagtttctatggctctgggccagcctaccctcagccagggtttctgcagagactgcccagctggttccacgtggctccacgtgccaactttgtcctcagtggagggaaagttggacacacagtgctggggctgctccctgctccgccgttgctcgatgcatggcctgcctctgaattccttggttccactggttttgctgggtccttctgtgcctctagctcctctttttttctgtccacttaccccattggtcccatcacaagcctgtgtgtgagtggcctttctgttcgatgacaacctccagcataggggagtgtttctccttgctttctttcccagacacactgcccagcaaaggcaaaagggcttccttcaacatcagctctggccagtttgccagagcaaagccctgagaaaagcaaggttgaaaagtcttattcaaactcaccaggaaagagtggtgttactctcgatggcgtctagccaggaatcatggaattatacaccgagcacctgtttgccattttggatgtttccaaacatgaaccaaacttccaggcccctctgccatctctggtaacatttacaaagtcccttcctcaccactgcccttccttcattttggcatgctcctccgcccccgagttgacagccatagctctctctcctgccaccagtgtcacatgatcgaggaagaaggcaacttcaaaaagactgggtccccttccactcccatctcttcagtgagctgctaggacacccagcagaacttccccactccacactgcaatctcagggatcttagtcacggggctttccaccatgtctccacctggaaaccagtcatggccattccttcttacatctgctcttttccatctttttcttctcctcctgttcacccgcccttactcttgtggcgccctatggatatgcgctccatagcaaatgattctttatatcttacggtattctagtgagctggcacatgtggcttctggtttcctctctctggaactagacatgacctctgtgggagggaggattaaatgcaccctacagtctgaggctgcatgatgacatcactcatcacaatgatgctttctatgtctgaatcctattcctttataacccctttcaagctcgttcagagagtatttcacacaatccatgtgctcatcttaaaagccaaggacccagaggagtctcagcattgccaaaaagtcccttcacccagcctggccagaggcagtgcctggtccatgtgtatggactatggcacttcaattgcatggaaatactcttggaatgaacaaaataccaatccatgaaaaagcattattgaagtctaagttattttttgaatcatattttgttaatcaacaaattgaaaaatactcattatatggagaggtccagataaagcctcaattttaaaaaatgaggaaaagtgtgcctggtaggggactggggagagcttgagaaagttggaaacgttgccttagaagcctgttttttctccttttagaagctacatagtgtctcactttccaagatcattctacaagatgtcagtgcactgaaacatgcaggggcgtgttgagtgccaaggccatggaatctgtcagcaacctcacccttccttgttcctccacctcattccaggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggaggtgagtgccagtcctgggtgggctcaggagccctcgcaccccgacaggaacaagggccagccccgagaacgggccattagcagttgtgtatgttagatacataattgtattatgatgcagaaagaatctctgaatgtgcagttatacccagttggtgacatgttggtacatccatccgaggaaatggcaatgtttctaggctgcacccttcaatgtccacaaagctgtgtggcatctgcttaggacccggtgcctgtgtgtgcataggagggaggccaggaagcctggctgttgatcccatgctggcactgtggcgaaggcgagagattcctgctttggaaaacaccattgtccacacagtggctttgtccatgatggacttcgccacagcccagtcctgtgctggaagccatgttctctggaaagagcaacccagcggctcataagcataagcgcgtgtgatgtgccccaaccaaacgaccgccatgcacaacttccctaccggagttttcaatccagttaataggcgtggaaacagacatagaaattgtgtttgttgaaaggtagctgttcagttaaagaacacctgtatcagagcctgtgtttctaccaacttctgtcaagctctgtagagaaggcgtacatttgtccttccaaatgagctggcaagtgccgtgtcctggcacccaagcccatgccgtggctgctggtccccctgctgggccatgtctggcactgctttccagcatggtgagggctgaggtgacccttgtctctgtgttcttgtcccccccagcttgtggagcctcttacacccagtggagaagctcccaaccaagctctcttgaggatcttgaaggaaactgaattcaaaaagatcaaagtgctgggctccggtgcgttcggcacggtgtataaggtaaggtccctggcacaggcctctgggctgggccgcagggcctctcatggtctggtggggagcccagagtccttgcaagctgtatatttccatcatctactttactctttgtttcactgagtgtttgggaaactccagtgtttttcccaagttattgagaggaaatcttttataaccacagtaatcagtggtcctgtgagaccaattcacagaccaaaggcatttttatgaaaggggccattgaccttgccatggggtgcagcacagggcgggaggagggccgcctctcaccgcacggcatcagaatgcagcccagctgaaatgggctcatcttcgtttgcttcttctagatcctctttgcatgaaatctgatttcagttaggcctagacgcagcatcattaaattctggatgaaatgatccacacggactttataacaggctttacaagcttgagattcttttatctaaataatcagtgtgattcgtggagcccaacagctgcagggctgcgggggcgtcacagcccccagcaatatcagccttaggtgcggctccacagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaattaagagaagcaacatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactttctatgtctttccctttctagctctagtgggtataactccctccccttagagacagcactggcctctcccatgctggtatccaccccaaaaggctggaaacaggcaattactggcatctacccagcactagtttcttgacacgcatgatgagtgagtgctcttggtgagcctggagcatgggtattgtttttggtattttttggatgaagaaatggaggcataaagaaattggctgacccttatatggctgggatagggtttaagccccttgttatttctgactctgaaacttgcattcaattcactccaccaagttatctcatctttgaaatggctttttttaaaggtgcctagaatatgatggcgtgcagtctataaactgttgcccaccttctgtactttctctcagaataattcacattcttctccagtgtctgttgattgttactttgtggaataagttcttggaaaattccacaagattattgttatcttcttactaccaattctattgaactttctccaccttctctgggccttccccagccagtggtgggaagatgctggctggagtctgacagagcctcttctacactggcctgggcttgctgtgagttggtggaaacctttgctcttgtcccaacacagagcaagtgaaagaggaggtcaaggggctcaggcagcggactagggaagcagaatcgaggaaaaggaaaaatggctgacttattacctcaaaactctagagaatttagttgatcttacagccaagaaggacaaaagccagagagtaatatcctccgcctcatgtctaacccacagaatacatagcaagtaaagagaacatgggcctttataaaaatgtcttaagatacaattttttaattggaggaaatctacagtttaattttctctgggcagcttttcttccttttattatagtaggggaaatcccatgttgatatacttctaaatgaaagatgatgaattgatataatacaataaaaaatctgtaaaattgatgatatacttatcaagaaaaattagctttcattttaacggtttacaaattgagtcaagtcctagtaacaaaatgttaagtctattaacataaccacaagaaatacaggaagacgggcaatctgtgaagcctttcacttacaatctctggcccctcacctgtgctgtgtaggaaaatctttgtgcacaatttgcttccttaattcattttttattcattcaacacattctaataaattatacaaaatcatgttgaaatgtgaatttcagtggtatttataaatgcagtgtgaggagggtttggatgtattctaagacaatagttgtgctttgggaaggaagcagtgttcactgaaaagtgcccccaggaccttttaattggaggaaatatgcttctgtggagttggaaatggggtagaagatagataaggtcaaggcttaaaagttaagtgcacccaacatctgaagcgtccatgggcctggcatggtggctttcgcctgtaatcccagcactttgggaggctgaggcaggaggatcccttgagcttaggagtttgagaccagcctgggcaacatactgagacccagtctctacaaaaaataaaaaattagctgggtgtggtgtctcatgcctgtagtcccagccactcaggagatgggaagatggcttgagtccaggagatctaggctgcagtgagctaaaatctcaccactgcactccagcctgggtgacaaagcaagaccctgctcaaaaaaatagttagatataaatattaatatagatacctatatatatctgaatatagatatctatatatactctgtatatagttatttagatatataaatatatatgatatatatttagagagatatatatttagagagatatatatttagagatttatatatattttatatatatttagagatatatatctctaaatatatatctctctctaaatatatatatatctctctctaaatatatatatatccctaaatatattaaataaataaaagaaataaaagaaagctcagtttggcctcctgcttgtcctgtctcctcatcccctcttccccctccatcattttatttccttgccccatgtttcttcactgcggccatgtcccccctcctctccaatgatggatgtcatgtctgctgcagtcagagggcgacaagcctggagtgttccctgaagcctgtggtttgtggtttgtcctgcagctcaggctgcccaggcctcaccagcaatcctggcgggcagggcaccacactgggatggagagggggaagctggaggaggcactttctggtaaagaaagcaaaagccagcagtgcccaggccaatttcaacagggagttaaatagcaccttaatcctgtggcaggacagctcatggggccatgtgtgctcttagaaagactcacatgcacgcatgcacggcagcaatgactccatactcacgttcccctgcagacaccaggcccccacagccggcacacacactgcagccccagttccatgttgctagcagtggcttagtgaatgagtaaagttcttaaaatgcaggggacacctgcccttcattcataaggctggacgtacacctctccttaaggagttcaagagctagtggaatcccaattcatacggtagagccattcacagatgagagagacaagccagaaggaaggaaccaaaagtcatgtcagcagttaggacaaaataacaggctttcaaggtcacaaagcctcagggacactcctgcggtgggactgggctaggagccatgggggctccaactgtgcgctctgcctgccagcctgtgggtgctggggctccacgaagattgttgtggaataccaagcatgcttgctgtaggtcacggtgcacgtttactacttccaagacaaacagccgagaacaaagctcgctttagcttctgcgtacaccgaacgggacacacgactgaacagcgttcccattgtgcctgctgggtggggaggaagtgatggcccagtgggtctatcagatgttagtaggatggggcctggcggggctccaggctctgtgtggccgacacccacgccccccgctctgctccccattcccagccccaggtcagccctgcgaggccctgcagcagatgggctgctcaaactgctctggtttgcagatttttcttccctctcaaatgaatacaatatgttttcaagtctcaaccagatcttgagaaaataggaagagccagagggtttctttggtgttatggttgtacagcttcccagactccgggggagagatgtgatttgtgctttctggcaatcccatggcgtattaaattttcataggctttccagtttaaatttagggtaggcaatggaagggaacgcaaaacagatttctaggtgtactgtgtgtgtgtctcccacgtctaaagtctgttaactggagcacccaacaggccccacaggctgccttcacacagaggacctggggcgcctccgacccattggggtgagcagtgggccatggagggagccagggtcaggagacctggttgtgggcctgacctgaccctgctcagggtggcctcaggtgggccgttcacctcgtcagcctcagcttaccctctgactacagtgacctcagacaaaatacgcttcctggccctgtccagttctgactttttataaacaagcacttatccaagttaaagggatattttcaatatctactgagtccacagatattaaatatctcctctcttctttaaaattgtggcattatctttagaatataaaaggaaaataacacacactctccttgaaaatagagagcctaaacactctgcaggaaatatttaaagctatagtttttgtttgtttgtcttgaatgcaagtggcctggactttgacttgctttgagtctttgaccttcatgacttcagtacagttcaaccctgacagttttgaagtaggtatgtgcctagatctgccctagtccctgctggaatgttgaagaagcaaaggtccaggccctcagagcacttgccacgtacttgccaacagatacggggcggagacttgagtcaacgtaagagcaagtgtgtgccgggtgatccgacactgcagagcgccagctagaccctaagcgtgtgctaggggctgaccaagccgttctttcctcaaaaacttggtggggagggtatttttaaaatcacacaaatatttaagtacagattatgatgactgcctcaaagcagtggctcttcagcttcatcaagcttcagagtccagagggtttgttcatatggaaggctaggcctgtctcctgcatttcaccctcttggcctgggggcgggacccaagaatgtgtggctctaaaaggttcccaggcaatgctgaggctgctttctgaaggaaaaactgcaagataccaggagagtttcatttagattgaagagtcgaggaaggctcctctgagaaagagtctgctaaggaaggaggaggtgggttctggggacagaggttctcccgtgggtaagggtggagggaagctctcctggggagaaggtgggcaggaggaccagaggctggagggaggagggcagtcagcctcggggcttcccaggaacagggacggccagggcagggtttagggcaaggaaagcgtgtgagcatatttgtattttagtaaatatttacagtttgccctccatgtctgcagtttcatatccatggattcaatcaaccacaatgaaaaacgttggggaaaaaaattgcatcggtactgaacatatacggactttttttcttgtcattattccctaaacaatacagcataacaattattcacatagcatttgcactgtattaggtactataggtaatcaggagatgctgtagatgggaggatgtctgtaggttacacacaaatgctgtgccactttatatcaggggcttgagcatcctcacattttgatatttaagggaggtcctggaaccaattccccagatactgagggtccactgtctgtgtcccctcgccccaccttgcctttgtctcctgtctcctatctccaccctgcctcccgccagcctgttgctcctgacctgcccgggcaccctggagcagcaccctatctcagagcctggctcagtgtgttcacttctgcagagaaactaacttgcccaagtccacactcaaaacataggcattgctgagatgtgaaaagcagctgtggatgctttctgctacagtctgtgtgttcttttccatatctgaataaaaggtcaccaccatttgtattttaaagagaaagagaatttatgggtggaaattggggattccctcattctcagtcagacagaaaagagggccccattgtgtgcctgattgcaaataaatttagcttcctcagcccaagaatagcagaagggttaaaataaagtctgtatttatggctctgtcaaaggaaggcccctgccttggcagccagccggaattagcagggcagcagatgcctgactcagtgcagcatggatttcccatagggagcctgggggcacagcacagagagaccacttctctttagaaatgggtcccgggcagccaggcagcctttagtcactgtagattgaatgctctgtccatttcaaaacctgggactggtctattgaaagagcttatccagctactctttgcagaggtgctgtgggcagggtccccagcccaaatgcccacccatttcccagagcacagtcagggccaagcctggcctgtggggaagggaggcctttctccctgctggctcggtgctccccggatgccttctccatcgcttgtcctctgcagcacccacagccagcgttcctgatgtgcagggtcagtcattacccagggtgttccggaccccacacagattcctacaggccctcatgatattttaaaacacagcatcctcaaccttgaggcggaggtcttcataacaaagatactatcagttcccaaactcagagatcaggtgactccgactcctcctttatccaatgtgctcctcatggccactgttgcctgggcctctctgtcatggggaatccccagatgcacccaggaggggccctctcccactgcatctgtcacttcacagccctgcgtaaacgtccctgtgctaggtcttttgcaggcacagcttttcctccatgagtacgtattttgaaactcaagatcgcattcatgcgtcttcacctggaaggggtccatgtgcccctccttctggccaccatgcgaagccacactgacgtgcctctccctccctccaggaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaaggtaatcagggaagggagatacggggaggggagataaggagccaggatcctcacatgcggtctgcgctcctgggatagcaagagtttgccatggggatatgtgtgtgcgtgcatgcagcacacacacattcctttattttggattcaatcaagttgatcttcttgtgcacaaatcagtgcctgtcccatctgcatgtggaaactctcatcaatcagctacctttgaagaattttctctttattgagtgctcagtgtggtctgatgtctctgttcttatttctctggaattctttgtgaatactgtggtgatttgtagtggagaaggaatattgcttcccccattcaggacttgataacaaggtaagcaagccaggccaaggccaggaggacccaggtgatagtggtggagtggagcaggtgccttgcaggaggcccagtgaggaggtgcaaggagctgacagagggcgcagctgctgctgctatgtggctggggccttggctaagtgtccccctttccacaggctcgctccagagccagggcggggctgagagagcagagtggtcaggtagccctgcctgggtgctggagacaggcacagaacaacaagccaggtatttcacagctggtgcggacccagaaagacttctgcttttgccccaaacccctcccatctccatcccagtcttgcatcagttatttgcactcaacttgctaagtcctatttttttctaacaatgggtatacatttcatcccattgactttaaaggatttgcaggcaggccctgtctctgagaatacgccgttgcccgtcatctctctccgacagcagggcagggggtccagagatgtgccagggaccagagggagggagcagacacccacccggcctgggcaggtcctcctcattgcttgcatccgcctggttagcagtggcagtcagtcctgccgagtcattcgtgaggcgctcacccaactccaggcagatgtaaaaggtgacctacaagaagacaaacaaaaacatctggagcgctcttatgccagcatctgcccttgacaccaccaggcaggctgttgctgggagccgtggtgcttgggtaagctccttcccatggcagagctcctgggacgcattgtagaagcagggaccacctcccaggataaccagatagcagcacaccctgcacagccccttttactccagcatcatcgggcattgatatctcagctgcagccacaggcggcccccagcaccccaggaagtggggagcgctcatgcttctctgagcacaaaaatcactgaatatttttgccattctcatggtcataacccgggccacagagtagaacactcctatcactgttgttagacagtggtcctgggagagggtcttgtgtgcctcggatgccagggcctctttttattgggaggtgcttgttatttctgtgtgtggctgcatttgtttcccaagactgccacaacaaatcatcaccaacttggtagctcaacatagcacagctttattccctcctggctctggaggccaggtgtctaaaaggccatgctcccacaatggttctgaggaggatccttcctgcctctctggcttctggtggctccagcatccctgggctgtggctgcacctccccatgtcaacctccgtcttcacaaggccttttcctgtgtctctgcaaccacaggcccctctcctttctcttaataaagataccagtcattgagtttgaaaattgctaagagagtctgttgtaaatcttcttagcacaaaaaaaaatgacagatatgtgaagtggtagatatattaattagtttgatttgatcactccgctatgtgtataaatgtcaaaacaaacattgcactccataaatatatatattaaaaaagatcccagtcattgcatttaggacccaccctaaatccaggatgatttcatttcaagacttttaactagatttgcaaaaccccatttccaaataaggtcacattctgcagttttgggtagacgtgaaatgtggagacactgtgcaacccactgtcttggggagggggtggtcagcctggggcagatgttgctgggtgtggagctacatccactcatgccctgacctggaacccagacctgcttccccagctctcctcctggttatctgaagcagggaatggagagcactgccctccttgcccaggcagtctctatcacctggttttagtttcttcttagcacatattgccccagaatatctggttggtttatggcttacttgagtttgtgcctacctgtcccaaccgggaggtgagccctggctattccccaaacccggccctgcatgtgggagctgcccttcctccgttcatcagagggggccaacagtccacagctgttcttaatcatctcccagtaacccccagctccacaaaggtgactccttacatggtggagaggtggtcgggccatccgtgtgaaatgtgtatgtgaccgttttccttaaggggcacgtagtcttggcaggtttcgctcaatataggatgagctcaggactccagtggactgtggattcagatctggattctggcgcattcgccgtgtgaacgggggcacgttgctggcctgtctgcgcctcgtctcccgactgtggagtgtgttctgccccttgtctttctgggaggtagggagggcagtgagccccttcgcatcgcccaccacaggcccagcacatggctgatccccactgagtgttcttttcctcctttgatcccctttggctgacctaggttggagcagccactaaaatatacccagaaacatcttcctaatctacatctgtgccaaccctcattccctggcgcagcatgaccatcacatgcccgccattgttcctgatctctgctgctcatgacctgctctccagcgctccttctcatgctcacattccagttggcctgacctagataagtggaggtttatttgaccccaaaaattagccttctacaaacgaatataatagtgtccattacagagaataaacttagtgcgtgtcccatttaagcagaagttactgaaagcctgagtttaagtttccagggcctgaaagttttccatgacagttttctgcataatattacctacaatttcaatctgttatttaaagccattcttgtgtttgttgtactttgattagctttattttgatttgaagtccttttacattacgggcagttaacgctttgtctctgttagatttgctttttagttcacaagagaaacctcattcctctgtatttgaatagttgcaatgatggaacagctgtccctggagggaaatgaaaacagtgattccccaaattgtgacaatagaaatttgctcttgggttacttacaatgtatctgagtattaaaaaattttctttttaaacgtttgaagtaaaactacccagaaacacttagtggctgaccagaaactaaactcctggcatcctcaaaatgggatttattggcttataaatgtcctgtgttgactcacaaaggcacaaactatctaggtaagttttcttctaaatgttgatgggagagctggccactgttatgcaagtttcattgtcctgactaaactgccaaagagattacataaaattatatcaactagacaaaaggaaaaaggaaaaaaaacagaggtgtcttgggaggaatccatatgagaccagtagaccatgagagagacatcccttgccatctacaaggaaaatggattttgttctccatatgcaaaaccatctcaggagcttgcggagacaccacttgcttactagccagaaagagcaggtgcctcctaaattccccacacaggagctcacagtggctttcatgcactgggattaagttagacttaagaaagcctgtctactcttcctgggatttacaagccagctagtaaatcccagaataaatcacacggcacagtcatccaaagatcccgtcatccgtgccgtttggaaagccctgctcctgtgccaccctctccccgtggagcctcccatgcccaggactgcagagtcctgccattcagactgcaactcatctcacattcttccaaactatttggacaacagagctttctcatcacctaatgcagattacagtctcacagaattgagtgttcaggcagacactgatgtggttctgtagtacagcaaacaatatcagtttacagtcctgaggccaggcctggtgaacaacgcacggtagcggtggggcagggttctcagaatgaaactggcttacacatggcactctctgaccacaactgtataagcaccaaactacacttagttccatctatgaggtaaaatttaatgcagatgaacatcaaagaaaacgtcaaaggctcctttttacaagtacgtgggctacttaatttggtccaagtccattttaaaaagccctaggtgctttcacggctctgctactgacaagaagccccagtgcctgtgagctgctaatgggagggagaggaagatgagctgagtgggccgggctatcccgtccacaccgggagacagggaaggagactccaagctggtggtgccagcacattccaggccactcaggcctattcctaggtgccaggtcacgaaaaccacgctgacagatcgtgctgtgtgcgtgtcatagcacacaagcaggactgtgagagagtgaaagtgacactgggtggagcactgaggaagggccacagtgtgttggtggagataggctgtcatggagaagagaccctggcttgctctacattgcttccaatgcaactgcaaggcaggtcccagagggctccggccttcgtcatccaggtttgctccctcccctcatggctttcccatcctcagatgaggactcggcagagcctacccctgctgactaactgtggccccagggtggtgactcagccctgcacctcctgatcccgtctgcactgggccagagaggatgacttacccagcacgttcacatcacacagctttgtggattcctaggtccaaggaccagagatttcagttatgtgagttattttttttatttgttcttgcgtattccacaaagggtcgcagctaaacttaacctaatgatcactttagtatatcactaaaaagacaaagctcacagtgctgttgaagcacattcatcatctttagacattttgactagttatttcttaagcatttacctgctagtgttaagcatcacatgaaatacatatagaagtaagacaaaatttcttatctccccaagtttgccaacaaatacagagcaggaagggaagcaggtcagagcaggaggcgcagctatagtgaggccaccatgcaaggcacagggagggtgagctccaagtttgaatggaatgggtctgtcagccaagccccctggctctgggaagatagcagtgaacaagccagatggcccctcaccctccagagccgtgagtcctgcagaccaaacagcgtgacaggtcctttccctgtccaggaggcctctgtgggtgagagttggctgcggacagggcgtgaaggcacttgagggtggggaagtgactctgactgggagatgctgaggacagggaggaaaccaccagataagggacactggggaggaggggtggacccctcagggccaagcacatggagcctcatcacaaaggcaagatggtggccaaattcaaggtcgctgcaaaaggaatggagaagagagaatagatttggcatttggaggaaatggtgacaatcatgagcacctacccgggactctccatgggtgctatctctacataaactcattccaccctctgattaatccattctacatatggggaaacaaaggcatgcggtgtttacgtcacttgccaagatctcaggatttgatccaggtggcctggttccatggtgcagcctctcagcctgcatggatgccccagctcagagcatgactctcaggacaggggtcccagcagccctccctccctgagcagcagggtgcccgtgctgcaccacttctgtctaggaataggacattctgacactttcctgcctcttccgaggtctagcacttactctatgcctgcctgggaaggtggcaagctggcctgaggaacagactcttccattttttagggagctcaaggccacagatgctctgagatctggagtccagagacaggagcggaggcttctcctggtgaccactctgcttaaaaacttcatcagatccgtagtttcagagcccccctgaaccccatcccttacctctaccagttgcaggtgggtctctggggtggggctgccctccccaccagcaccccaagggctaaaaggttgaggggagaacaccatcatttgtacagggggatcctggaagatgaggcctgagaaagccctgcggggcccctcaccttctccctagctgtggccaagagtgtctggccttgcctgcctcaggaccagcccaaagtggaggtgagaggtgagccccagcccccaggggaagggtgatggtggtcttggtctcagcatggttctggtagaggtgggttattttgaagatgatgaaccttaagcctctttctgatcttgctttaaataaatacttctgaacaacagcaacaacagaatagtgttgataggaaagccctccactccaccagaaccacgcggccttctcgtcctcccctcctccacttccttcctaagtcactgctccatgagctcttccacaggagatttacaaaatagaacacaaacaatccagttcccgcctctcactctgaactcctcccaagactcgtggggtgcggcagcccctgggaacacccagcccttcaaggtcaaacacagcccccgcccctcactctggggtaccctgccagaataagccccgacagccatgtggagcagagccttcttttttgtaagtggaagttccaggctggcttttcaaatccccttttaacctcagtgctgtatttcaaaattcattccagttttcctgtagtaattaacaaaaataaatattttaatttcaattaaagtgagggtctcggagaagaagcaggaactgagtttcctgagaggccccgctgaggctttgttgatatttcttcctgcgacctctgctcggaccctgggagctcacaggccgtatcgcagctcttatctttggggaccagttaaagcataactgcgccaggcacagagttgtcctttcaaatgtgccggcagtgggacggagacccatgcgtcaagtctcctctaagttcacatgggattctctccttgtcccaaagctgtctctgacttaaaaccctccaactgattacctgaattccagaatatgtcctgtgctctctgccctttcccacgcctttggtgaagaccggtgttctgaggaaacagacactgtgtagaaatggctcaggtcctttaaagccctggtgtgaggagtggggaagggctgggccagaggtcagctggatttgttagattgacagagtgacgcggacttccccagaggcacgggaccaaggtgcatgctcacgctgtctcatgctctcacacataatgtgtgtgtgtgtgtgtgtgtatatatatatacacatatacatatatatatatacacacatatgcatatatataaaaccccaagcagcctctggcttagcaggtgcatttcccagcagggcaattaaagccatggtcccagtagtggtcttggggtctcagggtatttggtctgtgcagccacatgcttcagtctctggaccccaggtcatctaacgaggtggtcgtgtggggactgggatagaaaaggtgtctgcacggacgtgtgtgaaagggctggcacatcgccagtgctcagcactgtcagctgctatcaccagtcattcaatcattcattcattcagttgttcattcttcaacaggccgttttaaaaatgtgcccagtataccaaaatctccgctaagcatttaaagaggcagaatgaaagttagcagtggtggtgaaacgaagctgggaatgtgctctgagggcctccttgtgggcttaatgaatatgtagaaaccacgcattttaaatagagagggagaaagggagaggttcctggtcctctgcatggggacttgtgtgtggctctttactgtaggcctgtgccactcctgctcaacagctaccacagaggacgccttcaacaaatgtgaagaacgaacaaaaggtacaaatgtgaagaacgaacagggtagaaagaaaggagaaagcaagggtgagggtgagaaatcaagggacagagaagagagaagaggagatagcctgggagttcacacagccaagaaggtagacactcagttgaaccagcaagaggctgagcctaactctccctttcgaatgggcaggagttcatgatatttaataaacagaggccttgctctgtaagagacagggtaccaggcagagagcaagtcagcatcgcaggagtcaaacgaggcagacagcgggggcagggagcttgcctctgaaggagacccaggctgccagagtagcagggagtctgggccagtcctcttttgggaagcgcttcctcggcttctgccccccctctcctctccctttccacccaccatcctgacataatacttcctaatctggaagtgttgtccagagaagaacctgctcatttcctcttaagtaggcagggaagcactaacgtccagcagcatcggaaacccgtaggagcgctctcggcagtgcagggtgaggggacagtccatgtagtcatgagacgtgggtgtcaggcaagcgtctcttttccaaaagagaaaaacattaaaggcctcacaaacggcgcccaaagactaattctgcatagcatctttgcgagaccctaggttcttatgatgactggttttgcctgagaaagaaaaaattttaattttgctctgacatgccaattcaacaaatcattttcacataatattcatgcaaaaaaaaaacaatttgccagaaaacttgggaatccatccacatctacagcttttccctgcagtcacactacagtgggatccctccatacaggagcggcagagtggagcaggctagagatgcctgtttgtttctgtttgctgcaccgcagcaagcatttctgtcgtgcccactctgtactagaaagtacatgaacatcagccataaagggaactagaaaggtggcccaccctcttggtggagagagaagagagtgtggtagaaacaataataagaagtctgcagaacttgacccctcccagcctctcccacctgccagcctggcccttgcagagagatgcaggctgccattcttaggccaaagcctgggacagttgggctcagcaaggtaggcatccgtcaagcaaggaggagcaggggtcagcagtgaccccagcagccagcagggagaaaggtgcatgtgacaaggacaccagaggccgtgggtcaggatcagccagggtcagggtagcatttctaggaattcactctgttgggcgctgtgctggctgcttctcacatattattcctttcttactctcagagcagagatttcaattgcagcgagattgtggaggcagccagggaggtggggagggtggtgtcttctaaaagcattttcagtatccatgtggtttcagtaataataataataataaaccagtgaaaagtaaaacaggacaaaaatcttcataggcagtgaaccatatcagagagtccaagaaagcacaatgagagtgtggcttaaaaaccctgaacgacattcctttgcaccagcttggtgaggagggcatggtccccgccaccccccacccccactttgcagataaaccacatgcaggaaggtcagcctggcaagtccagtaagttcaagcccaggtctcaactgggcagcagagctcctgctcttctttgtcctcatatacgagcacctctggacttaaaacttgaggaactggatggagaaaagttaatggtcagcagcgggttacatcttctttcatgcgcctttccattctttggatcagtagtcactaacgttcgccagccataagtcctcgacgtggagaggctcagagcctggcatgaacatgaccctgaattcggatgcagagcttcttcccatgatgatctgtccctcacagcagggtcttctctgtttcagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtaaggaggtggctttaggtcagccagcattttcctgacaccagggaccaggctgccttcccactagctgtattgtttaacacatgcaggggaggatgctctccagacattctgggtgagctcgcagcagctgctgctggcagctgggtccagccagggtctcctggtagtgtgagccagagctgctttgggaacagtacttgctgggacagtgaatgaggatgttatccccaggtgatcattagcaaatgttaggtttcagtctctccctgcaggatatataagtccccttcaatagcgcaattgggaaaggtcacagctgccttggtggtccactgctgtcaaggacacctaaggaacaggaaaggccccatgcggacccgagctcccagggctgtctgtggctcgtggctgggacaggcagcaatggagtccttctctcccttcactggctcggtttctcttagggaccctcacagcactaaggggtgcgcgtcccctgtcaggccctcgaatgccctcccacagccaggcccctctgaggtttcactctggcctgcttggctcctagcagccaccaacccatgatgctgggccctgaaaacacacgcagacctggatgagtgaggccactgggcacaaccagggctcccagctcaccagagcagcctgggacacagagggtgctcagaaacctaccagagcagccctgaactccgtcagactgaaatcccctgttgccgggaggaggcgccgggcctgggggacgggtcctggggtgatctggctcgtctgtgtgtgtcactcgtaattaggtccagagtgagttaactttttccaacagagggaaactaatagttgtctcactgcctcatctctcaccatcccaaggtgcctatcaagtggatggcattggaatcaattttacacagaatctatacccaccagagtgatgtctggagctacggtgagtcataatcctgatgctaatgagtttgtactgaggccaagctggcttttattgttagttaatttacattatatcctctgacatgcaagtattttctttcgagataatgactaatgataatgtaatcattgctgtctatctattgtactgagaaaacacggcagaggaaatcgagtccagctgccgtccaaaagtcactggagattgcaatgagctcgtctggcagggtggggggtatgggagggaaagagcttaggaaacggctctccctgcaaagtccaaccaaactttaacgttaaccaaaccattaatgttgccatgaatttgaagtgaaccagagggaggtggcagaagaagcttaatggggaatagttccggtagagaaatgaggcttaagatgaactaccctggcccttatgtgtcagagagaacggcttgacaaacacacactgaggatgtctgcagggataaaagaagaaagggagatgacccttgcttctcgctctcgggaggaccatctggtccggccctggggattctctgtttcctcttctgaatcccagtgttgcccagcactggcctgtacccatcctcacgagggccgctctcctcacccggccctaggtccctgccctgtcctgagcctacaggggcctcccatgttgagaaagtgttgctgacacattgtctctgaccgctgtgccaggcattttctgctgaattaccgcacttggtccttgaatttcacccagcaacttactgaaaggctggaacccatgaacctaccccttcactgaggaaaataagttaccccagccatctacagcgacaggagcaagggaggagtcgcctcacctctctagaaatgtgtatttgaggagaacactattgaaatgaatttccaagaataatctagtcagtattacaaaagcaaaattatttgggatatcgtccttttttacttagtattttttctttttcctatagcattattaactttctgattttccaaatacatacacatttttaaatttcctgagtctttatctcttctgttaaaatgtaagatttatgatacaaaggcagagatttgtgtccatgaataagtgaagtttggtgtgcacctgtgagctgagccacctcaattaatggaacagataaggaaataaaggtctgctgatgcattgttatttacagccattttcagaatgtatctcctctccacgagggaactgcagggtcctgccccaagccatttattttgtcctcaagcagcccgcccctcccactccaggcacagcccggtctcctgctggtctcccctcttcccacttgctccccctcatctatgctccagacagaggccacatatattttttaacttttttttttttttttttgagacagagtcttgccctgtcacccaggctggagtgcagtggtgcagtctcggctcactgcaacctccacctcccgggttcaagtgattctcctgcctcagcctcctgagtagctgggattacaggcgcacaccaccatgcccagctaattttttgtatctctagttgagacagggtttcactatgttggccaggctggtctcgaactcctgacctcatgatctgcccgcctcggcctcccaaagtgcatattttttaactttatcagacttttcattctctgctcaacatctttctttggtcctccaggtatgttcagataaaacctgagcacctggccatgactgatgggttgctgggccatctggccctggcaactctcccgtccaccaggtccccctcccgtcacgctccaggcatagcctgtgtgtgccagcgcaatgcccacactccatgcacaagtggaagccctctcaaagtcagtggcttagtgccttgatgtggtcacacccattctcaggaagtccgttcccactgaaaacattgtgtgttttcaacatcattgaggctgccacggcagattataatcactggcctaggcagcccactggaactaccagaccatgagcctgaattttttgtttaaaaatcatatcctgttttctctactctctagtctctagtcaaggtgaattattcaatttaataaattaggggcctagtgtgttgtaccaaggagctaaaaagagagaactcgcaacaccttccagcccattctccacctaacactggctatactggctctcctctctctcgctgtttgttccaaaatctaataacctgtcttcccactagaattcatcatacatgtttaaaaacctagttaaatagtagttaaactgactgcatagatctggaaatgagacagtctttcttttacaaatccatatagactatgagttgggggcaggggatgacacaagaatctattttcttgcccccaaaccattgctttccttccaatgttaagcttgtattctgtgtattaattcaggtggttccgtttgggaatggcctctgttacccagagatgggagggccatcagaactcggggttgtctgaaaaaacactggttctaaaattatcactgctttcacttgtttttaaccatcatagttgtttgattttgaaggaaaaacatgagggtttttattctatgcttgttatatctatattgtggtttcgtattttttagattttagtacctgacatttttttaacttttattttaggttcaggggtacatgtgcaggtttgttatataggtaaatttgtgtcatgggggtttgttacacagattattttatcacccagggattaagcctagtacccattagttatttttcctgatcctctccctcctcccatcctccaccgtcctatagaccccagtgtgtgttgttcccctctaagtgtccatgtgttctcatcatttagctcccacttataagtaagaacatgcggtatttgattttctgttcctgcattagtttgctagggatgatggcctctagctccatccatgttcttgcaaagtacatgatctcattctcttttgtggctgcctagtgttccatggtgtatatgtaccacattttctttatccagtctgtcattgatgggcatttaggttgattccatgtctttgctattgtaaatagtgctgcagtgaaaatacgcatgcatatgtctttatggtagaatgatttatattcctttgagtaatgggattgccgggtcaaatggtagttctgtttttagctatctgagaaattgccacactcttttccacaataattgaactaatttacattcccaccaacagtgtaaaagcattcctttttctccacaacctcaccagcatgtgttgggatttttttttttttttacttttcaataatagccatctgactggtatgagatggtatctcagtgtggttttgatttttatttctttaatgatcagtgatgttaagctctttttcatatacttgttggctgcatgtatgtcttcttctaaaaagtgtctgctcatgtcctttgcccactttttaatgggattgtttaattttttcttgtgaatttacttaagttccttatagatgctggttattagacccttctcagatttgtagcttgcaaaaatgttcacccattctgtgggttgtcttcactctgatgatagtttcttttgctgtgcagaagatcttcagtttagttagatcccatttgtcaatttttgcttttgttgcaattgcttgatgtgttttcatcatgaaatcttagcccattcctatatccagaatggtattacctaggttgtcttccagggtttttatagtttggggttttacatttaagtctttaatccatgttgagtttatttttgtgtatggtgtaaggaaggagtccagtttcaatcttcttcatggctagctagtcatcatttattgagtagggagtcctttattcattgcttttttttttttgtcaactttgtcaacgatcacatggttgtaggtgtgcagccttatttctgggctctctattctgtttcattggtctgtatgtctgtttctgtactagtaccatgctgttttggttactgtatccctgtagtttaaagtcaggtagcatcatgcttccagctttgttctttttgcttaggattgccttggcaattcaggctcttttttggttccatgtgaatttttaaattgtattttctagttctgtgaagaatctcattggtagtgtgataggagtaacattgaatctataaaatactttgggcagtatagtcattttaatgatattgattctttctatccatgagcatggaatgtttttccatttgtttgtgtcatctctgatttctttaagcagtgttttgtggttcttattgtagagatctttcactttcctggtttactgtatttctaggtattttattctttttgtggcaattgtgaattgaattgcattcctgatttggttctcagcttgactgttgttggcatattggaatgctaattatttttgtacattgattttgtacaactgagtcttcactgaagttgtttatcagcttaaggggttttgggtcaagactatggggttttctagatataggatcatgtcatctgcaaacagagatagctgttttcctctcttcctgtttggatgtccattatttctttctctcacctgatttatctggccaggacttccaatactatgttaaataggagtgttgagagagggaatccttgtcttgtgtcaattttcaaggggaatgttttcaacttttgcccattcaatatgatgttggctgtgggtttgccatagatggctaatatgttgaggtttgttctttaaatacctagtttattgagaattttaaacatgttgaattttattgagagccttttctgcatctattgagatgatcatgtggcttttgtccttagttctgtttgtgtggtgaatcacatttattgatttgcatatgttgaaccaatcttgcatcccagggatgaagccgacttgattgtggtggcttaagctttttgatgtgctgctggattcgatttgccagtattttgttgaggatttttatgtctatgttcatcagagatattggcctgaagttttctttttttgttgtatctctgccaagctttggtatcaggatgacattggcctcatagaatgagttaaggaagagtccctccttctcaatttttttggaatagtttcagtaggaatggtaccagctttttttgtacatcttgtagaatttggctatgaatccatctagtcttaggctttgttttggttggtaggctatttattactgattcaattttggagctcattattggtctgttcagggattcagtttcttcctgaggtttttatttttatcaaatggaacttaagctttttcatttccaatttttttatgatctaaaaatgtgcagtttacagccctgttcagaatctgcatcttcctcattctgcagatacaggtccctcagagcaggtgactgagtgtgtatcctgtctggagcataatacttatgctagtagagttactgttgtctttattgttaattaccaaagtttaccacttatcagtcacttactacttgctgggcattgcactaagcatttcagttgtattatcttgttgggtccttacagcaatcctgtgaaacagatactgctattaccccactttatagagaggtagactgaggcttccagcattgaagcaaattgcccaagactacagaaatgtaggtttctaaacatcaagaaacagtaaccagtaatgatgactaaagcaagggattgtgattgttcattcatgatcccactgccttcttttcttgcttcatcctctcaggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgtgagtgactggtgggtctgtccacactgcctagctgagccttggtggctgctcttagccaaacagctgaggcctttgcatccctggagaaatgtcatcacattacttaaggcaggcacacaaatccagaaacatctgtaaataccccttcaagcattcttttaaagacacttcttgactcattgggcagtatgacctgacatttgcccatgtttgcaagcaaataaataaaactaaagtcttccgcaagccattacaccaaaatattctattcgctgagttactcaatgaaataccgagttgccctatattttgaagcctgttaccagagagactgaatgtttttaaatgcatggcagtgagtaacaacataaggctaatagagtcaacatttctgctttgacttaaaccttttaaaccagtggatttatgtgaagtctctgcagtgtggcatttaaacatttcaatctaaataagagtgtgtaatttgattgatgctattattctaccagattcacgagtgcagtgggctctggaggtagcattacatgcatgggatgagcatttgcaaaagaaagttgtatagggaatatgacagagccaagttaatgtaaatattaatgcctttctgaactctaggccacagagttgatcttttttaacttccttggtttgggctaaggaagctgtgatccagagaagccacgtgatttgtctaaggtcacatagcagtctggcctaaaatagcttgatatgctgtggatggaaaataaatgtgatccctcaagaggcatgaggatttccaggcagtagccatacctccaaattgtttaatctggatttagattgttgggtagtcacatgcagcagcacagttaacagtgtgtcctcctgtggaagttgccagcacagccagccctctcacttgcatgcatgcccaccagccttctcacttgcatgcatgcccactgggtatgtgctgtactggagacgccgggggtaggggcccagtcccaaccccaaattctttaaagcctatttttctaagttgcatctggtttcctacctgaaggaatgctaagggtggatgttgagtgaggaccttggtgcagggcaccctgcagtcaggatagttcatggagagcaattgtacagacccacactgctccatcccctcaggcgtaacacaggatgctgaccccaggaagagtgggcgtagaaaaactagagggcattattgttattctgattcaaatgtacagtgctggcatggtctttaaacagtaaccagtactagctggccaagacagaaaagtctaccacaaagacttggttctttcatcacttatttgactggaagtgtcgcatcaccaatgccttctttaagcaatgccatctttatcatttcttccagtgttctaattgcactgttttttctcattccttccccaggctggatgatagacgcagatagtcgcccaaagttccgtgagttgatcatcgaattctccaaaatggcccgagacccccagcgctaccttgtcattcaggtacaaattgcagtctgtgcttccattgggaagagtccctctaatgagcatctcatgtcactgtgttctgtcacatgccagcctggcctccctgtgtcccagatcgcattattaaaccctccagcgcattagagcaagcctcagtaaggcgcaggccacatcgtgaactaagcagcatccgtgagtggggcccacccaactccatctccccctccccgtctgaactctcctctggtgctcgtcctcactgtccggctagccaaagcctcagctgggtctaagagagaagcatggtctattgggctttggtgtcaggcagacgtggcttcacacccctgactctccacttcttcgcatcacccaggcagccgatccacctatctccttccataacacaggaataccaaaaccaagctcacaggattgtctcaaagattcaataaaatatgttgcaaaatacgctccctaacacctcacagcaaggtgcacactcgatgaatgctgcagcttcttccctttctgtttcctcagaagctatttgaatctcatgtaggggctttcaagcatcaaaggatggttcatgttttattttaaggcacccacatcatgtcatgaggggaggcagctataatttagagaaccaagggggatttcattataacaaaattggcaaacacacaggcacctgctggcaatagacccctgctcctatagccaagaagtggaatagcatctctacgggccattctaatagcctcaaaatctctgcaccagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctggtatgaaatctctgtctctctctctctctcaagctgtgtctactcatttgaacaaattgaattttagggaaaataaccatctagtgaaactcacatggatatgaagtcaattttaaccaaatggtaaaatcaaaatcaaaataaattaagtgtattaattattttgttgcattgcaacaacttgattgtaagccttttaggtccactatggaatgtaattaaatcaaaactaaacctagttgctctaaaactaacgattaagacaaaaattaaacaccttcacaatataccctccatgaggcacaccacctgcattcaggaaaagtggatgagatgtggtacaagcattccatgggcaacttctctgtttctttttcagagtgcaaccagcaacaattccaccgtggcttgcattgatagaaatggggtatgtatgaacaccttataagccagaatttacagctctccactatggctctattttacatggaaaatgccttaacctaaataattttaacccagataatcttgagttttcttcctgtgtgggtttttccctgcacggctgtcacgcctcacagtgccgttcaaagcgtgactcctggaccagtagtagcatcgcctggccttgttagaaacgccatttttcaggccactgccccagtttgaccaaatcaggacctctgggggtggcacccagtagtctatgtttgagccactttccaggtgatgctgatgtctgttgaagtgtgaggccgtggtctagaccgcactgtgccatgcagaaaccactagccacatgtggctacttcaacttaaatgttaatgagttaaaatgaaataaaatataaaattcagtttctcacacatgtgaagtgtccagtagccacacgtggctagtggtgaccgtattgaagagcaccgctcatagcacacctccctcactgcggaaagttctgctgtacagcacccagcacagccctgctgcccaccctgcagcctgtggcccagtagcaccagcacccaccagggtgcagactctcaggcctgcccaacctactaatcagaaccagcatctcaaggagatctcgggtgatttttgcaaacactgaagttggggcagccctgaccggagtaaccttccctcatttcctcctgcagctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccagatactcataacctgctaacacacacacatatacacacacatacacatacacacatatacacacaccacacacatacacagacaccacacacataccatacacagacacatacacatgcacacacatatacacacacacctcaaatacatacacaccacacacacatacatgtatacacacatacacacaccacacatacaccacaaaaaccccacacacatacacatatacacaccacacacaccacatacacacacgtatacacacatatatacacacatacaccatgcatacatacacaccacacatacatacagacacaccacacacacgtacacacaacacacaacacagacacgtacacacactacagacatgtatgcacacatacacacacaccacacatacatacacacagacacatatacactacacacaccattacatacacacgtacacatacaccacacacaccacacatacacacaccacacacacatacgccacacacacaccacaaaaaccgcacacacatacaaacatatacacactacaccacacatacacacacacaccacacaccacacacacacatacacacaccacacacaccacacatacacgcaccacacatacacacacgtagacacaccacacacaccacagaaacacacattaacacaccacatacacatatgtatgtgcatatacacacccacaccccacacacacatgtataaagatttagatatatataaaacatatgttatatatatgttgatgtaatatctaatatctatatatctaatatgtagtttattagctatctaatatctatgtcatatatatcaaaatctttatatataaaaatatgtagaaatctttatacatatgttatatgtatataaagatttagatatataacatatgtaagttatatatatgttagtgtaatatctaatatatagtttattggctatctaatataatataaacagattatcaatattataagctattagaaaaatgcaagttaaggcagatgatatacctctttacacaccaactacacacaccaactacacacacacatacacacagacacacacgacacacaccatacacatgtacacacacaccacatatacacaaacgtacacacacaccacacacacatacacaccacacacacaccacacatacatacacatccacacaccacacatgtacacacgccacacacacacatacacaccacatacacatatgtatgcacacatacacaccaacaccacacagacaccacacatgcataaacatatagacatatacacaccacacaccatatgtacacatgtacacacacaccacatatacacacaacacacacaaatacacacaccacacacacaccacaaaaaccccacacacacacaaacatatacaccccacacatacgcatatatacacacacacatacacaccacacacatacacaccacacacacaccacacatacacacacgtacacacaccacacacacaccacagacacacaccacacatacatacacatacacacaccacacacacgtacacacaccacacacaccacagacacacatagacacaccacatacacacccacaccacacacacacaactcataccacacatacatacacaatagacacatacacaccacacacaccatacatacacacgtatacacacaccacatatacacacacgtacacacacaccacacacacccacatgcacacaccacacacacatacaaatatacaccacacacacatacaccacacacacggtgcacatacacacacatatacacacaccagacacacataccacatacacatcacacatatatgtatacatgcatacacatacacacacacatacacacactctcctcaaggcagtttatcctctgagaactttaaatttacaaaagacacatatgtccattactttgagaaggacaggaaagaacccactttcttttgcagcaacagcaagagggccctcccgaggctcctgctccctgtcataagtctccttgttgaggacattcacagggttcagaacccagggatcctgcatgggatggtgctttgctgattacttcacctctgatttctttccactttcagaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactct

SEQ ID NO: 37471 - DNA, 29224 bp, Homo sapiens; identical to SEQ ID NO: 36840

SEQ ID NO: 37472 - DNA, 29224 bp, Homo sapiens; identical to SEQ ID NO: 36840

SEQ ID NO: 37473 - DNA, 145845 bp, Homo sapiens; identical to SEQ ID NO: 36113

SEQ ID NO: 37474 - DNA, 34679 bp, Homo sapiens
gcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgagggaccttgcgtgctctattctccaccatcggcctcccttcggttcatcctggagacctggcggcatcgccgcggcccaggcttcgataggtgggatgcgcggcctctgggccccttttggcattacaagtctcgtcctgtcctctgcatcctttctctcctatggcctgaaattgcctggtcttctgctcatgacatgtcatcatcgggacatttgtgaaaaggagcttgcgggccagtggcagtgacctagaccggtcttttctccaggtcctctgcttttagttaaactcaacagacattaattagcttagtattataaattgagtcatcatcatcgtaactacgtactaagttaggtgttttagctcgttaatatctacttatgaagtagatgtgaattcccattttacagggaggaaacccaggtttaggtaaacagtgtgtggcagagccccgggttgaccggctttaaagtctgtacttttcgctcttgtactgcgtctgtaatcagacatctgttattgggtgagctgccccctcccctgttagtagtacagtctattaactctttgcacaagtctgcagcatcgtcatagctgggcattaacgatagagtttatgaattttcttatgcttgaagtttgagattctaccatgtatacatgctccagaatcaatttgctaaaaaatcatttgaaatatgtggcactcatttttcccttccactgttgtgcacggaaagatatggaggggagaactgatcccattggtttatagagtaaccttcaggagcatctctaatctaagagattgataattctcattcctggctacatattaggatcactgaggagttttagtacactactgatgcactcctcctccagttctgatgaggttgacatcagtatattttaggaattaccagaagttattttaatgtgcaaccagggttatgaattactgatcaaggtaatatatgaagtttttttcacatcttgaaaagtagacacctatgattattcaggtaatgttggttttatatgacagcaaatgagacatttcttcccacaatttagtatcagtgaatattggtggttgttgattcagatgacctttaggtactaatgaagttattctacaggtacacggcatatctgatatgcaaaggagccctcattattaggcatgttgtgtgactgagattttatttattgaattgtgcttttgctaagtagagaatacttgaagagcagtttgtgaattaacttgaagtttaagttttatttcataattggaatgggtatcattgcagtatctatttttttgttaccctgtttgccttacagtctcaaaagtgtaccaaagcctgatgtaactccagtttcttacagcacagaatttgatacattggaggctcaccttgttcattttcatcttaacatgtaaaatattcctgaactgtgcaatgaaatagtcctttctgacaaaatcttcatgccataatttgtagtaggtatagtagcataaactaaaaaaatctcactgtcatttctatagatgaaagcaagaagtatttattggaaggtaaaagttgaagtatataatgctaatactgtgtaaaatggccttttgcttgtgaacaagttgataatgacatggcttttatcattagagaaaacagtaacataaaaatctgatattgtggctaggcgcggtggcacacgcctgtaaagcacaaagtgcctgggaagcactttgggaggccaaagtgggcggatcacttgaggtcaggagtttgagactagcctggccaacatggcgaaaccccgtctctactaataatacaaaacgtagccaggcattgtggtgtgggcctgttaatcccagttactcaggaggctgaggtaggagaatcacttgaacccaggaggcggaggttgcagtgagctgagtttgtgccactgcattccagcctgggtgacagagtgagactccatctgaaaaataaaagataaaaaatctgatattgtgaaataactgacatttaaaaatgtatcacagaaagtttcacacctttaatctcagcactttgggaggctgaggtgggaggattgcttgagccccagagtttgagaccagcctgggcaacatggtgagatcctatctctacaaataataataaaaaaaaattagccaggcgtagtggcacatgcctgtggtaccagctacttgggagtctgaggcaggaggattgtctgagcttgggaggtcaaggctgcagtgaaccatgctcaggccactactctccagcctggctgacagagtgagaccctttctcaaaaaaaaaataataataataataaataacaacataaaataaaatatctgattgattacagtttgatttacaagtaataagtttgaagcttttttggcattttttgaagtgtaaaattaagagctttttcctatctagggttttttgctgttaaccacaattcctatttatagatactgaggaaatattttcttgctgtattatttaccgagttgatgcaaaatagtctagtaactttatttttggacctgtgtttggtttgctaatcaatggaattttattagtgctttttgaaaaatacattaacagcataaggaagttcttttaaatctttgtatagtgatgggatcagagatacaggattgaaatgaactaaacaattttaatatggttctttggagtttattgtcataaatttactttattagagtatcataatacagcatttataaaatgttgcatttattttatatcaaattctattgtgaatttttgagacagagcctcactctgtcgcccaggctggagggcagtggcacaatcttggctcactgcaagctccgcctcttaggttcataccattctcctgcctcagcctcccgagtagctgggactacaggtgcccgccaccgcgcctggctaattttttgtatttttggtagagatgggatttcaccacgttagccaggatggtctcaatctcctgacctcgtgatctgcccgccttggcctcccaaagtgctgagattacaggcgtgagccaccgcacccagcctatgaatattttttctatatttaattgaattttttttttttgaggcaggttctcactctgtcacccaggtgggagtgcaatggcacgatcatggctcatagcaacctcgacctcctgggctcaaatgatcctcccacctcagtttttgatttttttttgtagagacagggtctcgctgtgttgcccaggctggtcttgaactcctggcctcaagcagtcctcttgccttggtgtcccaaagtgctgtgattacaggtgtgagccacagtgcctggcctaaagaatttgataacgtgaaactttcccctttttaaaaaatgtaggataaattgaagtatgtgtatatatgaataatagacagaattatacgtggatagctgttccccagttgtttgcctttttcatggggaaccagtgttccaatgttactggtgtcctatgtatccttccaggaagacaatacgcttatacaacaatacaaaaaaaatttgctctttccccacctttatgcaaaaatgaatatattctattatttttctttttgttttaatcatatgaaatcattctgtgtatatatgaaaaacttcatctttctcactatcctatatagttttatagtattatgaatgtgccacaatttattttccaagctgatattgatgtatatttactttctttccaattttttgctaatgcaaatgatgctttaaggagtaacatacagattttgtcacacgtgtctagtatgcttgtaggataaattcctgcaactagaattactgagttatttaaatttggtaagtattgtcaagttgccctccatagaagctgtattgctcaataaacatttcatagcaattagtaatgtatgagagtgtctgctttcccacaccttcactaacaaaatgttaccaacatttttgatctaatctgaaaaaagtattttgatgtagctttaatttgcatttttctttctttatttttttgagaccgagtgtcattctgtcacctaggctggagtgcggtggcgtgatcttggctcactgcaacctccgcctcccaggctcaagcaattatcctgcctcagcctcctgagtaaactgggcttacaggcgcccaccactatgcctggctaatttttttgtatttttagtagagatgggatttcaccatgttgtccaggctggtctcgaactcctgacctcagatgatccactcgcctcggcctcccaaagtgttgggattacaggcatgaaccaccatgcctagctttaatttgcatttttcttattatgagttagattgaacatcttttcacgtaaagaattttcatcttcttttctctgaacaatgttatgtttcttatttttattcatttttatcttcccaaacccttatttacattgaaggactaaatttaaatttcttttgaaccatgataagatgcaaagcaattatgaattatcactgtatggtgaaagatatttgcatctcaagcactaagtccaagttaattgtagagttaggtttaaaatcatagtagatttagtctgatttctgccttgggttttctgttttttacctcgtgttgtgtgtttgatgatggtgagcttaattgtttttaaattattttactggactttatgtaagcagtaggtacttggtatttaaaatacccagttcctgagggttctttggtccaacagggaaagacgggctaaaagaccaaggtattaaagtgttttgggtgttacggtagacgcttatacagagtacatcggggcccaaaggacaagtatagtcctttcctcagtgttagcatgaagagacatgaaacagtttctcatgttctgagaactataagctgttggatatagttggagcatagggtcagaagagtatggcagtgaagcaataggacagggaccagattgtagcaggtcttgaatgacaggagtttgaggtatgattgaatagtacagtgtgggtatttttaaaaaattaatgcaaggtatgaaacactacaaatatacttagaaataagtgctgaaaatgctttattgctataaatacaatttgttgactatttgtaaaacataaacttatggacttgagaatcagaatatgctgataaatggcctttcttttgactgactgtgtagccttgtgcaagtcatgtgtctgtaactagagctagaaagacaaactagtttctaattcagagctatatttattgatagagaacaggaattgaaatttaagatgattgctttttttgcctttgtattatttaatgtacattagatagtagaagatacttgaaagttacttgcagtcttttcttaacaagttctttatcatttgcaggggtaattgttatctcagtacatattttagattatttttgttgaaattaatgatagtttatttgtgttgaaattaatgatgggttaggtagttgcagagaaattgcttaagaacccaccttcagtagaattacatattgtttgtacagattcagatgtaatgactgaaatcataattttcaaaagataacaaagatgttaatttacagcatctttgccccaacacttagtatttcaaagatatttcattatgatataattttgacagggtcggtcaaatggaatgacttaaaagtgattcaagattttacaacctacatagtttttttttcatagaggaataaagtaacaatgttgattcaatatattaggtgaattttcttatatacctaaaatatgtatgcttttaaaattgtttaaagagcacatccttccttttcaaatattaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtaggaaaagtatttgtatggatttaagattgaaaattgttcatgtaatgcaaatgtcataggaaacaatgtccttccacttgatttttagaatgataaaattcccagaaagtttcagaaagcctaagtttctattaaggtcaataatcttcaagctataaactatctcactcttagttactaattttattttatcttctgagatgtttatattcaatacttatctgtaaagagctttaagacacctgagaaaaacgtgctaccctgattcaaataaataagaatgtgtatcacagagtgaatcatttgcctgaagccataaacccaatagaacaatgttttctttacaaataaataagccaataatgaaaatacagataagtcatttgagtctcaccatgtttttatttactaatatcaaggacagaagtgtttgtagcttgtgataattactctttattttctgttaaaatgagtttgaagggtttgtggcttttttttgcagttttctgtatacttttaaaacttttctttacgtatttcaaactaagttattttcagataccagatttggaaataatagcatttactaacatttgaacagttattttacaaacgtaagttctgtaagtttactctttttgataagggagttttctccaaaagagtttaaggttgccattttttttccaggtcagttgcactatctaagacagttttaatatattcatactatttttcaagtggaacacattcaaaataatttatccaccaaaaaaggaagcaagagtacctataattttaggctggaagactttgaaatgctaagaaacatggttttaaaatattttctggagaaagaaaaggatttttaaggttttggtgatctttgatgtatataaatagtctatttgcctgacaactaatagacagtaataacattatagatagcattaacttaccagtagccaagaaataatagggattgggaaagtctctgtacttttatttggtcttttattatgtgaaatatgcatatatcatactatttctttatataaaactatacttaggccaggtgaggtggctcatacctgtaatccagaactttgcaaggctaagatgggtggatcacctgaagtcaggagttcaaggccagcctggccaaaatggtgagaccccttttcttctaaaaatgtaaaaattagctaggcatggtggtggatgcctgtaatcccagctacttgggaggctgaggcaggagaatcgcttgagcctgggagatggaggttgcagtgagcctagatcacgccattgccctccagcctgggcaacaagagcaaaacttggtctcagacaaacaaacaaaaaaactatgcttaaagaaatagtaatgtttttcaaatagagaatagaacctttcttctacttttttttttttttttttttttaaagcagagtgttactccgtcacccaggctggagtgctgtggcgcgatctcagctcactgcagccttcacctctggggttcaagcgattctcctgcctcagcctcctgagtagctgggattacaggcacctgccaccacgcctgactaatttgtgtatttttagtagagatggggtttcaccatgttggcctggctggtctcgaactcctgacctcaagtgatccacctcagcctcccaaagtgctgggattacaggcatgagccaccacacctggctcttctacctttttgaagagcactttaccttctctacattaataccacaatgtgaagagttactatcctcaatgtttaacaaaactagaaatttatgacagggaactagactgaatacatccatcctcctctctgacttctctgaatcctgaatcagaatttctctctagtccaagaagaatatgagtagttattaataccattcagcaatattcctgattttcttctgctcatatggtgaaattacacttccttgccctcttacgcatcactgtgtgatgttcattgatcagtgaaatgtaagcagaagtgaagtgttagcatccaggtagaagttaataagagaaggtttatgattttcaaagtaaattcttctccttgctgcagtgaggtggtccagatggttggaggctcggtaggctgtgtccctgtttgtggtcagtggggaacagagtctctcttgtcttccctaatccctgagatgttgcatgatgcaaaaaataaatctttgttgtgttaagccattgagattatagagttgttttgacacagaattaagtgatataaatattaggcactacctagtaataatgctagaggtttatttgtatatattcattatatagtgactggatatttagaaaattgtcaagactatatttttaaatgatcacttagtgtacttcttaacctttatgtaaatagatagaactcagcttgttgtagaatatgtgttaaaaattaaggagaaagccttctaggggcaaggctgaggatagatatgttcagtccagtttttttgggagaaccacaacacagaatggcttttttttttttaagagccaggaggaaggggggccctgcaggcaatgactccatcaaccttttatatatttattcatttaatgaatatgtattaggtggcagctatatcagatgttatttgttgcataggagtttaccataacaaatattccttctgctaaaggatctgacttttattcataggttcaggaagagtgtgtatgttgtcctgggttacaatgttatatgtatttcttaaggtaggttgctgcaaaaagtatttgaaaatgcttgttttagcatgtatagtaaaagtcaatgacaaaataggacttgtaaaattaaatgatagagaaataggctgggcacggtggctcacacctgtaatcccagcactttgggaggctgaggcagtcagatcactttaggccaggagttttgagaccggcctgaccagcatggcgaaaccccatctctaccaaaatatacaaaaaaatcagctgggcatagtggcacacacctgtagtcccagccacttgggaggctggggcacgaggatcacttgaacccggaaggtggagattgcaatgagcagagatcacgctactgcacaccagcctgggcaacatagcaagactctgtctcaaaaaaaaagtaaaagagatttaaataatttttttaaactgtggcaaaatatatgtataacataaaatttgccgttttaaccatttctaagtttagggacattaagtacattcatattgttgtgcagcctttaccaccataattttttttatgtgtatttagattttttttttttttttttgagatagagtcttgctctgtcatccagattggagtgcagtggtgtgatcttggctcactgcaacctccacctcccgggttcaagcaattctcgtccctcagcctcctgagtggctgggattatgggcgcctgacgccacacctggctaatttttgtatttttagtagagacgggatttcaccatgttgactgggctggtcttgaactcctggccttaagtgatctgtccgcctcagcctcccaaactgctgggattacaggcgtgggccaaagcacctggccaaaaaataataaattttaaagtgtgtttctacttggaaggctgaaggattcttctgttttttaagagagcattaacaaagcaattattttggtattaaaaatggggaaaatttgaattttaaaaatttagacattaactactgaactatattagaaattacttttgaggtatgggtaaaatgattaatagtccattttgttagatttagtttttgtttttatatttattctaggtgattcaggtgtctggggattgaaaaaaaattttgctttattggagcttttggaacgactgcagaatgggcctattggtcagtatggagctgcagaagaatccattgggatatctggagaggtattgatcatacttggtgaaatatttgttacgagcatgaatttttcttttaatagatgccattattagcacaatattacttcatttatttcagcaggtaaatttctagaaacacaacttttcattacattacagttctgaaggccaacactattcccaagagaaaaaactagaattatttgaaaatcctatgcctaaactatgctttatgtgtgaacttttttttccttatcataattcagttctaccaagaataaagtgaaaagaggaagaagattatggaatagtaagaaagatatgtaagcaacagtagagaagaggatgcaaaagtagtcaacagtaaaactcaatgagagaaagaaaaactcgatgtaagaggccatttaatacagaggggaaaatgccttaaagatagcagtaacttctgagggaattgttactgttatagcttcaagaaaaggttaaactttgtatagatgtactgtctttatccatacaggtagatgtctagtaaatatcagaatccatgaacactggattttaataatgtaaaagtatatttttagcacttatgtgtttgcatagctgcacatatgtactataggacatggctttcgtaggctgttatgggtaaaaatatatttggagtaaatatcagttaatgattttggtgatcaacttgcaaaccacatattttgtatgaaggaaaaaaaatgtcggattgctttcacttctctttcattagatgatgatttctttatactaaagtgaatcagtgaaatgaatttcaaactgcaacactctgttttctaaaagttatgcagttctttctgtgctaaatctttaatctttatttcaaaagacattactgttagctaatgttgacattatagtttataatttatttatttgtcaggtctgggaaacagaagacctgaatttttatggtacatgtgtttatttctcataattgcaaacaaaactcttccactttggattcattttttatttaatgtgataaagaatgacaccattgatgtatttaaacatttttatttttgaaaaaatttatactaaatttctccccttccaattatggccttttaatattgagtaaaagtgttcaaaacattcttgattatctgacatgtaattttttatctacttgaaataaaagtaattatttcataattagttattttttgtaattcctgaaaactagaaataatatttacatgcttacatataggttttatttatttgtttattgttattttttaagacagagtctcactctgtcacccttgctggagtgcagtggcgtgatctcagttccctgcagcctccacttcctggcttcaagtgattctcgtgcctcagctacctgagtagctggtattagaggcatgtaccaccacacctgactaatttttggatgtttagtagagatggactttccccatgttggccaggctggtctcttactcctggcctcaagtgatcacctgcctcagccttcttaaagtgctgggattacagatgttagccactgagcctggcctatttttttttttatttgcttaaatcagtggttttctgccgtgattgtgcaatagactcacctgtggagctattaaaataacatggcgtataattagaaaaatatatacaagtctagggttcatccacaacctgttgaaataagaatttctcttccagacagctatgtttttaaaagcttacagctaattctgatgcatactcctacattttctaaatagcatttgtgcttctgtccttcctatacatcatcatgacaactaatatttaaagctatggggatgtatttaatatcagatttttgtagttttacagaaagacttttgacttctctatggtttagtttcttttgtgtaaagtgaggggatttggtggaagagatctttgcaccgaatatgaatctatgagaatagttctatttttggcttcaaattcataacatatattggccagttaatcttggaaatagcttcttacccctagaaatgaatgcttctcagatgagtattgaatgacctttgttcttaatgaccaatatattttcatatgtaaatattgttcagttaagcaaaaaggattatggattctatatttaaaaattcgtcatgttatactgattgggttcaattttaaggcattaattttttgtttatcagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaaggtatgaatttaattattaatcagttggatcactgtagctactttaccagctcagtattcgttttcactgacctggttctttattctgaaagtagggattgaagaagagttaagtgatgagtgattgggtttggtagcatgaaaataaatgagagatttaatttctgaatgttataaaaaaaaaaaaacttcaaagaggcatcatgattcttcacaaaaaaatagctttcgagcaggaaacaaacattctgtttgcttgcatgttttcataatgcaccagattgttttgacaatatttatgtctgttagctcttacttaggatatgattttagagatagtctcttggttttttgtttagcaataaacggacttccaaattttaaattacttctttgcagtacagttttcttataaaggagtgaaagtaaattagtatttttctgtgtcataaaagtcacttgtggctgatgcttttttgtattaatagggatttaaatagttttttatattattagtcaatactatgagttcttttctctaattatggtacattttatagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtatggattttttttcttcttcactttctcattcttttttatttttcatattttcaccttctactaagtaattaatgggcaattacaatttgccagtattgcaccaatcattagaaagttttttaaaagtccctgtctttcaggaactcattcatcatggaaaagagagagtttgaaatatggtaactattttatggaggagaagtacagggtgctttggcatcacaaaacagggacaatgatttatggaggtcagagaagtccttatagaagaaatggtgtttaaactgagatttgaagaatttcagtcagggaaaagagcagaacggggaatgagttgtcccaagaagggaacaatatgttaaaatgtttgtaagtgaggattgtacatattgtagagacttaaagaagctcactgtagttagagctttaagtattgaatgggacatgacaagaaaagaggatatggagagttcaaagccaaatcatgcaggatcttgtcagccatgttaaagagttcagaacttagtttaaggacagtgatgagccattgaagaattgacttaggaatgatataatcagattttcctcaagaaaggttgttttaaatgtagaaaatgaattggaggagcaacaaaattggaagcaggcagacctattaggatgttgttaaagttttctagttaaaatactagagatgtttatggcctataatacactagggtagtgagagtggacacaagtcaatggatttgagattttaaataagtagaatagataggtcttagtgattaattgttaatattgattggataggtaacttagaggtgatgaggcatgatcagattttgggtgtattttgaagtcagcagaatttgctgagggactagtgggctatgaaagagagctgataatgatgactccggttgtttttgcttcaacatcctgaaggatggagttgccatttaccaagacagaggcaattaggtttgggaataggggagactggagattaggcattccattttgcttgagatgtcatttataaacagttgaatttccaatgtctgtgcattaggggaaagatctagcatggagatttatattttggaatttaatatagatggtatttaaacaatgtctcgctcggtcacccaggctggcatgcagtgttgtgatcaccactcactgcagccttgacttctggggctcaatcaatcctcccgcctcagcctcctgagtagctgggactacaggcacatgccaccacggctggctaattttttccattttttgtagagacagagttttgccatgttgcctaggctgaaattttaaatatttcacaggtaaaatctttattaacattacagttgcttaaaatttattttcattttcttaggtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggtaggtagtttaaatgtggttagggacttagttgtaagtttaagtagataattaccagaggtatacattagtgtgttttattaatattttgtgtctgctgtatgcagtaactttgtgcttaggaaatggtctgcaaccttgaattatttcactagtatggaattatcagtgtcgttcacgtgcctttcccaccataagccatgggttcttgaggccttctaacttcttgccattcttcagttatgccaaatccttttactcttctttgccaagcatatatgtagttttttttttttttctgcttggagtgcatatatctctcttttctaatagtggaaatcttccttctccttcaaggtccagcttaaatatttgcctttctttgaagctttctatttgttggtctttttttgagtgcctctctaccatgtactgcctacgtctgctataattcagtggttcttcactgttagagcaaacgtatgttttgtgatggttgagataccataagaaatttgttacccagtttgcagatgacttacttttttaaataaatgagattcagttattctaacacaaatgtcagctttacccatttgtgttttggatctgttttcataagtgtgaggtataagaataactattgccctaggaatttcagaaaagctgcagtctgtgttatcttcactgatatattgctaataattgtgttgatttcaaatcattgtaggctaagccttgtaccattgtagagctttttctcttaaatatgtgattacacttacatgagagtggccagtctatagcctcatcagtcttgggttatcatttagtccttaccacactgaattgtaacagttgatatgtatgctatttattaagttgattttcagctccaaacctactcttctatcctctattttgtgatactagggctagaactctacagacctcataattgtgttgccagctgggcccatgttaggtactgtcaagagggggcatagttactcatgtgaggagaccacccttctcggaggtttgagtttcagctccatgagccactcctgcaagtttctaagttttaataattctaacttcttccttttattcctttagcactggaagtggtagctatgttatttcatacaattgctacctccttaatacctcagagttccttttaaccttttagctacctagttaataactacacctagttaacagtttttattttaagttctttctattcaagtaatggtgtgatttgtgtcttccgatttgaccttgaatgacacaatatgcctatgtgttttagatgctgaccttgttcatctttgatgcatcttgttcatctttgtgtcactaaattctttgcatctagatagaaagagcttaataaatacatgtttaactcatggcggataatgaagctacatagcaaaatcagagtggagtcatgtcctaaatcatatttacttgaacacttaaaagtattttcatatttattttatgaaaaagtttgttcatagttactgaaatatttaagtattttagagtttctgaagtgttgtgccaaaatgactggtatattagtccattttcacactgctttacagatactacctgagactgggtaatttataaaggaaaggggcttaatttacaggtttgcatggctggggaggcttcaggaaagttagacaatcatgggggaaggcgaaggggaagcaagcaccttgtttacaggacggcaggagagaaagagagagcaaaggagaggtgccacactttaaaaccatcagatgtcatgattaatcactatcatgagaacagcatgagggaaactgccccaataatccaatcatgtccctcccttgacatgtggggattacaattcgagatgagatttgggtgaggacacggagccaaaccatatcaactggtaatttttaatgatacagtattatctatgttaatgcaaaaaaatcaaggtcttggattcatttttcatatggacctattagttttgttctattttataactacagaatactaaccaatgttctttaaagttcccactacagagaaaattgaacagaggaatggatggaacatcacaaattgatcttcacttctgagaacataatttaatcatccatccactctaaacaaattatgcatcatctaaagttcttggcatgatactggatgctgaatatttattcatttagcaaatatgtattgagtagctaacatatgccatgtatttaaaatatatcagtgaacacaataagcaaaaagccataatcttgtgaaattagcattctagcaagaagacaggcaataaaccataaccatatctaagtaagttaattatactatatgttagaaagttctgagagctaatcaaaaaagaattctgcaactacatgtttatgtttgtacagcagattgcattaataagtagagtagtcagggtaagcattattgagggaaggtgagatttgagcaaagattcaagtaaaaagttgaaggaattcgttcaggccgtaactgggagaagaacattgtagttgaggaaatgttatagcaaaaaccctagggcagcatgcctggtatgtttgaggaacaggaaaataggcctcttgactggagtagaataagcgaaggacagagtaataggagctgaaatcagaggttaatagagaattatatgtaaggaaggccctgtgaggcattataaggacttcaattgttttttttttttttttggccgggggcgggaggagtgggttggggacagggtcttgctcccaggctagctagagtgcagtgatacagtctcgtctcactataccttctgcctcctgggctcaagtgttcctcctgcttcagcctcctgagtagcctggactacaggggcaagccaccacatccagctactttttttgtatttttcgtagagacagagtttcgccatgttgcccagactggtctaaaactcctgggctcgagtgatccatctgccttggcctcccaaagtgctgggactacaggtgtgagccaccatccttgggtggacttcaacttttactgattgggataggaccattgtagagttttgagtagaagagtgacttaatcttatatgttaaaaggatttttctggcctatgtgtctaaaatagattgaaagaaggcaaaaatggaaggaaggaattcaacagttaagcagcagttgtagaattccaggtgagaggtaatagtggcttggataatggggattagaagtgcccagattctggatgttcaaaaggatttgttaacagattgtacgtagggcatgcgggaaagagaaagcaataatgacttcagcgtttgtcctgaacaactgaaacagtggaattgctgtcaactaacatgagtatctaacagtgagcaaaaacagataatactaccgttctcatggagcttgcatattattgggagatctctttcatataaagactatgttggtatatgtatagatagtctggaataatattcaagaaactggaaagttcttgactttgaggagtggacctgtattctttattttttttaacgaatacatgtatatctgaaattaatttttaaactttttatagacatagaacatagatatagaaatgtatgcataagtattcagttggctgaattttcagactgatcattaatgtgtaactagcactcagatcaagtaccagaacattgtcagtaccccagtagttccctcatactcacttctggccactacctgcctttcccaccatgataaaccactatcttgacttctaatgtatatcttaattttggttgttttggtaattaaatgaaatcatacagtatgaattctccatgccatgtcttcttatactccacattatgtttgtgaaatttctatcatcacgtgtagctatggtttattctcactgtgatgtagtgttccatttatctatatgctacaatttatccattctttcgttgctaagtccttaaattatttattaatgctcaattattatttttgtcaaatttacatttaactttgactactataatgttaaaactgcttttattgtgagttggtaatataagtctcttttccttatttcttataaaaagtttataagaaatattgttttgcctcttataggatgattgtagagttgtcttggcaaaacaggaaattacaaggttactggaaacattgcagaaacagcagcagcagtttacagaagttgcagatcacattcagttggatgccagcatccctgtcacttttacaaaggtaatgtactgtactttatttttaggtattttttctgacaaatcataattgatttacgtttcatgataatcaccttaaagagacaaccatgaaattcatgaattaggggctttttaagaaaacttttatcagtggaaaatagaaatggtgtgctcacttcggcagcacatatactaaaattggaataagaagattagcatggcccctgtgcaaggatgacacacaaatttgtgaagtgtgccatatttttaaatttaaaaaagtaaaaataagaaaatataaatggtatatatatggtatatataatgaatcttcctgtatccatcacccacttgagcaattataaacttatttcatctccccttttacctactccttttcctacctgcaatctcccagggtattttgaagcaaatcctaatatcatattatttcatcccaatatcttatttcatctatgaaatattttagggtgtatctccaaaagataaggactctttttaaaaacataattggggccgggtgcggtggctcacacctgtaataacagcactttgggaggccgaggcgggtggatcacctgagttcaggagtttgagaccagcctgaccaacatggagaaaccccatctctactaaaagtacaaaaatttttggcatagtggtgcatgcctataatcccagctacttgggaggctgaggcaggataatcacttgaaaccaggaggcagaggttacagtgagctgagatcacgccactgcacttcagcctgggtaacaagagcaaaaccctgcctcaaaaacaaaacaaaacaaacataattgggcatggtggcataccttatagtcccagttactcaggaggctgaggtgagaggatggcttgagcccaagacttcaagaccagcctgggaaatacagtgaaattcccgtcacttaaaaaaaaaaagccaaaatatcattattacaccaaaaaagtttaataatgaatctctaatattttcactaatattatcaacttgttagtattcaaatttctcagattgttttcaaaacaatttttttaatggttgctttattttagatacaatccaagcaaagtttcatacttgggatttggttgatatatttaaacctcttttaaagtgggttctccctgattaaaaagtgttcatgtgtaccattttgctttccatttttaggggctggtttttttttaatttaattatgttttcacaattatgtgaaatgtttatgtgatccagagtcaaatgttcaaagcaaggtttattcagagaaatctagcttttatgcctggtccttctaccctttttacttcattccccatagaaaatcatttagaattttttcttagttttagtcatcattttaaaaagtatagagacatatgtttatatatttgtatgcacaccacttggatttaaaaggtggaataccttacacactttttttttcctgctctttttacttagctgtacatcctaaacatcactctgtagcagtagaaagtgacattttttgttcctttttccagctgcaaggtacttcattgtgaggatatgccacatttatttatcgtagtaaaaaacacataataaaaaatttgctatctcaaccatttaaaaatgtacaattcagtactgttaagtatattcacattgttaaacagatatccagaaatttttcattttgtagaactgaaactctataccctttaaacagttcccctctgccccctctcatcggtccctggtaaccactattgtatttttcccttatgaatttgactagatacctcatataagtggaatcatacagtatttgcctttttgtggctggcttattccacttggcctgtcatcaaaattcatccatattgtagcatgtgaaaggattttcttccattttaaagctgaataatattccattgcatgtgtgatatggtttggctgtgtccccacccaaatctcaatttgaattgtatctcccagaattcccacgttttgggagggacccagggggaggtaattgaataatgggggccggtctgtcccatgctattcttgtgatagtgaataagtctcatgagagctaatgggcttattaggggtttctgcttttgcttcttcctcatttttctcttgccaccaccatgtaagaagtaccttttgccccctgccatgattctgaggcctccctagccatgtggaactgtaagtccaattaaacctctttttgttcccagtttcgggtatgtccttatcagcagcgtgaaaatggactaatacagtaaattggtaccagtagagtgaggcgatgctgaaaggatacccaaaaatgtgcaggcaactttggaactgggtaacaggtagagggtggaacagtttggagggctaagaagaagacaggaaagtgtgagaaagtttggaacttcctagagactcgttgaatgactttgacaaaaatactgataatgatatggatggcgaaatccaggctgaggtggtctcagagggagacgaggaactttttgggaactggaacgaaggtgactcttgttactgttttagcaaagagactggtggcatttgcctagacatttgtggaacttcaaacttgagagaggtgatttagggtatctggtggaagaaattgctaagcagcaaagcattcaagaggtgacttgggttctgttaaaggccttcagttttataagggaagcagagcgtaaaagtttgaaaaatttgcatcctgattgtgcaatggagaagaaaaacccatcttctggggaaaaattcaagctggctgcagaaatttgcataagtagcaaggaacctaatgttaatacctaagaccaaggggaaaatgtctctaggccatgtcagagaccttcatggcagcccctcccatcacaggcctggaggtccaggaggaaaaagtggtttcatgggctgggcccagggtccccatgctgtgtgcagcctggggacttgatgccctgagtcccagctgctccagctgtggctgaaaggggccaatgtagagctcgggctgtggcttcagagggtggaatccccaagccttggcagcttccatgtggtgttgagcctgtgggtgcacagaagtcaagaatagaggtttgggaacctctgcttagatttcagaagatgtatggaaacacctggaagcctaggcagaagtttgctgtaagggcagggtttggaggggcgaggggcagaatgatatgcttgagattttgggtgtgcccccacccaaatctcaacttgaattgtatctctcagaattcccatgtgttagggagggacccagggtgaggtaattgaatcatgggagctggtctttcctgtgctattcttgtgatagtgattaagtctcacgagatctgatgggtttatcaggggtttccgcttttgcttcttcctcatttttctcttgctgctgccatgtaagaagtgctttttgcctcctgtcatgattctgaggcttccccagccatgtggaactgtaagtctaattaaacctctttttcttcccagtcttgggtatgtctttatcagcagcatgaaaatggactaatacaatgtgtataccacattttgtttgttcattcatctgttgatggaaacttgggtagcttccacctcttggtttactgggaatagtgctgctgtgtacgtgagtgtacaaatatctcttcaagaccctgctttcatggtcttttggatatatacccagaagtgaagttggtagatcatatagtagttctgtttttaattttttgaggaatccccatactgttttccataatggttgcaccatattacagttccaccagtggtgcacaagggtgcagtttctccacattttcaccaacacttgttattttctgtttttggatagtagccatcctgattggtttgaaatgataccttatttgttttgatatccatatctctgatgactagtgccattaaccatcttttcatataattgttggccatctgtatattgccttgaatatgtctatttctgtccttcgctcactttttgattgggttgactatttttgttgttgaattgtaggagttctttgtatattctggatattaattccctatcagatctgtgactttcaaatattttctcccatttcataggtcaatttttcactctgttgattttgtcattttatgcacaaaaattgtaaatttgatgtagtctatttttgcttttttttttttttttttactgtgcttttcgtgtatccctgaagtcactctcaaatgcaatgtcatgaggcttttcctctgttttttcttctaggagttttatggtttggggtcttaagtttatggccattttgagttaatttttttaggtggtgtaagatacataacatccttttgcatgtagatatccagtttccccagcatcatttattgaagagactgtcttttcattgagtggtcctgcacccttgttgaagatcatgtgaccctattcctgagggtttatttctgggctctctcttctgttctgttggtttgtatgtctcatctttatgccagtaccacatagttttcattattgtagctgatatggcttggatctatgttcctgcccaaatctcatttccagttgtaatccccaatgttgaaatggggcctggttggaggtgactggatcatgggggcagtttctcatgaatggtttagtatcatcccccttggtactgtctttgccataataggtgagttctcatgagatctggtcgtttaaaagtgtgtggcacctcccccaccctctctcttgctcctgctcctgccatgtgaaatgcctcactccctctttgctttccaccatgattgtaagtttcctgaggctttccctgaagccaagctgatgccagcatcatgcttcctgtactgcctgtggaactgtgagccaattaaacttttctttataaattacccagtctcaggtatttctttatagcagtgcaaaaacagaacaatacattagctttgtaatatattttgaagtaaggaagtgtgagtcctccaacttttttctttttcaaaattgttttggctattcagggtcacttgagcttccttataaattttagcttaattttttctatctccacaaaaaacatgattgggattttgatagggattgcattgaatctatataaattacctgggctgttattcatatcttaatattttatgtctttcaatccatggacatggaatgtctatttatgtcttaatttattttagcaatatttgtagtttttagtgtacaagtctttcaccatcttggttaggtgtacgcctacatattaggttggtgcaaaagtaatagtggtttttgccattaaaagtactggcaaaagccgcagttgcttttgcaccaacatagtatcttaagtctttcaccatcttggttgagtttattcctaagtatcttaaacttttttttctgtacatgttcagagaaacttctttagtcataaactataaaaatgatccctgaaagtataattttgatgctattttaagtagaattgtttccttaatttccttttgggatttttatcattaatgtatagaaatgcaactgattttcatgttgattttatatcctgaaactttgttgactttattctaataggtctttttgtgtggactcttcagggttttctacatacaagatcatgtcatctgtgaagagatataattttacatcttcctttacaatttggatgtcttttattattcttcttgcctaattgctctgtgggcatcttcttgttctttatcttagagaaaaagctttcagttttttgagtatgatgttagctgtgggcatttcttatatggtgtatgttaactgaggcagtttcctgctactcctagtttgttgaatgtttttattatgaaagggtattgaattttgttaaatgctttttctgcaactattgagatgattacgtgctttttttctctcattctgtgtattatgctgattgatgatgaataattcttgccttccagttataaagcccatttggtcatggcgtacaatccctttaatatgtgttttttttttttttgaggcggagtttcgctcttgttgcccaggctggagtgcaatggcgcgatctcggctcactgcattctccaccttccgggttcaagcgattcttctgcctcagcctccttgtagctgagattacaggcgtgcgccaccatgcctgggtaattttgtatttttagtagagacggggtttctctatgttggtcaggctggtctcgaactcctaacctcaggtgatccacccccaacctcggcctcccgaagtgctgggattacaggcatgagccaccacgcccggcctaatgtgttgttgaattcagtttgctagtattttgtagtttcctcctggttgcacctcatcctcactatgttggatatggggaagggcagggatgagtgcacagaatgccccaaattttattacccctttcactggaatgccttcttggttttatggcctgggtgctgtagtttcttaactgttctctagagttctcacagaagtagttctgttccatatattgttttatttctgaggtgtataactggacttaagtatagatttggagccataatatacatggtaattaaagctcatgaagagaatgaaaatatgtagaatgagaaggaggcctcatatagaccctcaagaataccaacatttaagagctggattaaagaaaaattagaaggaacatccaaaaatgggataaaaccaaaccaggaaaagtttgtatcataaaatccaagcaaagagtgctcaaaggagtaagcaaaaataacacatatattttgggaactgttgtaaggacttttatatgtattcttaaaaattaatcctttcaagaatcctatgtaaattttgtactattttaatcctccttttatgagatgaaagaagtgaagcagagaaatcatgcagctagtaatatataaaaatgttcattatagcattatttgtaatatcataaaatcagaaattacctaaaatctatcagttgggggtttagttaaattgtggtttatgaaatgtaaagaagccattaaaagaaaaaggttggtcaatatgtattgacaggattccataatatactgttgagtgaaacacattagtttcaatgtgtgggtaatacttttttaaaaaaaaatttgttttgtttgtgtatgttggccagtatgtgcatggaaagtgtctggagggatatacatcagattcatagtagaaatttctgggaattgagcagcactttttcattttaattgatttacccttattgtgatttttttagtatagcataaaaacatgtttaagatttagaggattcatttgagttagaaaatctgagaaaattaagtgggtatgtatattctgttatacaaagacaaagtggtcagttttactaaggcaagatttagccatggggaaggatttcatcttcttgagatcagactcagtattttgaggaatacaattcagattgcaatggttgaggaatgaataggagatgtagaaataataaaggtgctaaatgctattactttctaactgcatgtcaaacatatttaaaaatatttaaattgtaggataatcgagttcacattggaccaaaaatggaaattcgggtcgttacgttaggattggatggtgctggaaaaactactatcttgtttaagttaaaacaggatgaattcatgcagcccattccaacaattggtaagtatgaatattggtttttaccttaatagacaaaccctagcttacagccaagttcttggggtcttatttgatactgatctgtcatggtggtgggctcttttctggctctaagatatcagcatctcagagaaaaaatgcaagattgtatgactatgggattgaaatgtggatggggataaaaagaagaaacagagtattggtgggacagttggaaggaatagaggattggtgatcctggctgagggtgtggggtggggggtagttgtggaacagagctggaaggtacatggatcccaaggtcctaaggaccttggtggaggtttagagggctaggagctgttacaggtatacattcaccacgtaggagtaggaatggggttgattaggcttcagtagatattgctgcatgtagataatttgataagtcacagttataaactgggggttgtctgtgtttgatatgtcattcattgtaaatacaaatatagtataaaagtaactttttttttaaaacaggttttaacgtggaaactgtagaatataaaaatctaaaattcactatttgggatgtaggtggaaaacacaaattaagaccattgtggaaacattattacctcaatactcaaggtgagagttaaaaatgacatttaatttttcacatttttaggatgacagttttcagtgtactgatttaactagcaaagctgatacttatgattaagtcgttgactgtatacttaagtacctgtggccagtttcttaacttgtaaaaaatgaaagtagaaagattaggatatatacttttagtttattcctgatataccattattacagaataaaaaccatacgtagcttagatatgtagtcagttaagagtactcttgcttctcttaacagagagtgtatattaccagtattatatgggtgtgactgctggtagcgtagtggtatagagttgaatttatgttgtatgattctgctgaattcagttaaactcaacatttatcccattataatctcactatagccccactcccacatttctttcacaaatagttattacctgcagaagaacttacagtagcttgcttttgaccaaaccgtattatatcatatctatactctacataggttttagtcacatttgggtcttactctacacttctgcctcatagaccccaacataatgcttacgctcatgccgcttattctgtatgttattctgctttccaccaagatgagagactgaataattatttttactttgggatttttgatattattatgagccataattaatagaaaaaatgtattttttttttgagacagaatcttgctttgttgcccaggcaggagtacagtggcatgattgcatttcatggtcacctctgtctcctgggctcaagcaatcttcccaccttaacttcccaagtagttaggactaggtatatgccaccacattcagctaatttttttttttttttttttttgagatcgagtcttgctctgtcgcccaggatggagtgcagtggtgcgatctcggctcactgcaagctccgcctcccaggttcacgccattctcctgcctcagcctcctgagtagctgggactacaggtgcccaccaccatgcctggctaatttttttgtatttttagtagagacggggtttcaccatgttagccaggatggtctccatctcctgacctcgtgatccgcccgtcttggcctcccaaagtgctgggattagaggcacgagccaccgcgcccggccacattcagctaatttttaatttttttttaatagagataaggtctcactatattgcccaggggtctcgaactcctgggctcaagtgatcctctcacctcagcctcccaaagtgctgggattataggtgtgagccactgtgccctacaaaaatgaaattttgaatatgaggaatggttgaaagtctggagatagttaacttagacataatactttggagaaataaaaatggtgatggtttttatcttttagtcttttattcaaagactaaatattagaaaagtagtattcgaagaacaagtagcatccataggtagaggatcatgaggcatattttgaaattcgttatgtaaaaagttatttgatatacagaccaatttgcatttgatagagcaagtgttgtaaatcctttcctagatggggaaactaaacctgagaagttatgtaaactacttgaaatcatactgttaattatttgtaggtgcccctgccatactaggcaccctctgtgtgaaaataatgatggtagacaaactctaaccataacataataatgatatcattaaatatttggttcatttactgaactttagcaagtgactatttttgttttttttatttttttttgggtagctgttgtgtttgttgtagatagcagtcatagagacagaattagtgaagcacacagcgaacttgcaaagttgttaacggaaaaagaactccgagatgctctgctcctgatttttgctaacaaacaggtaatgcatttttatattggaatatttattttagtagttttgtgcatgtcaaaaggcaactggaaatatttcagaagacaatcagttcaatagatatttatagtttcttctgtgtattttgagtacaatctatgtgaaaatgctgtgctgggtacctgggagtatacaaaatagaaataaggtagttaatgctcaccagaaactcctgtgtatgcatatgaacacataagagatctgaatacgaagaagactgataagtaacttaagtaacacagtgttacgggaattaggaaagtagttctaaatgtggcatgttgtaagattgtaaaatgtagaatttgagttgaaattatgcatgaggctgagtcagtatgtgaaaggaagaacattatagacagagaagataatagcatgaatgtttttagtttagggaacatcaagcagatctatatgtcaggtctcagtagaggatgaagagaatttagaataacagacaaggccatgctgtaaaggtctgacagtgctagactgagaaatttaggttttattctatgagcaaggaggagtcatcaaaatgttggattagtgggtaataagatcatatcagtgtttcaatactataattctaggggtagaatgaatcagggcaaaggactggagacagggagatgcagtaaattgcttaaataattcaagtgagcattaacaagagcctgaattagaggaatagaaaggcggaggcagatggaaaagactttgaggcagaactggtgactgaatggggaggatgaaggactgggagtagctgaagattcctagaccttgagcctttctaggaggatgagatgcttttaagtagaggcagaaggagagtagaagtggagcagaggagatgtcatgggaggggaagagtaggatgaagaataaagaattttccccttaataaaaaaggcaaactattaagaactggtatatttaagacatgcaaataagtcagtgaaataccattttctgctcatcagatagttaaagatgaaagtgttttataatcctcagacttatatacaactgttactattattattttgagactgagtcttgctctgtcaccaggctggagtgcagtggcacaacctctgctcactgcaacctccccctcctaggttcaagcgattcttctgcctcagcctcccaagtagctgggattacaggtgcttgctaccacacccggctaacttttgtatttttagtagattcagggtttcatcgtgttggtcaggctggtctcaaactcctgacctcaagtgatctgcccgcctcatcctcccaaagtgctgggattacaggtgtgagtcactgcgcctggtcaacactgttcgtgggttattaaactgagacattttcttggaggacaatttggcaatactcatcaaagtcccttaccctgcaattctacctttatatatctggtagacagatatccaaaggttatcctacagataattttgcaaatatacataaatgtatgtcaacttttgtgtatgtatgtttatgtatgtatgtgtatatatatggatttataatagcacataagcataaaacttcaatctgaacattcagtataggactggttaaattatgttgcagccacacaatggaagggaattctgatattaaaaataatgcagaccatctgtgctgataatggaaagatactcatcttcaacatgtttacgtaaaaaacaaacagaaaaccctgcaagttatagaaagtctaaactatgttcctgtttgtgtctctttgcatgagtgtgcatggaaattttctggaaaaatatgttgtaactggtggttgctcctgggaagttggggcaatgggtgttcagagtgggaatgtagtgaactcttcaatatataaccctatatataaaccatttattaaggtttctatgtgttaattttttttttttaagttgatgccttacacttaggcaggccaggcgtggtggctcatgcctgcaatccttgcattttgggaggctgaggttggtggatcacttgaggtcaggagttcgagaccagcctgactaacatggtgaaacctcatctctactaaaaatacaaaaaaattagccgggcatggtagcacatgcctgtaatcccagctacttgggaggccaaagcaggagaatcgcttgaaccaggaggcagaagttgcagtgagccaagatcatgtcactgcactccagtctgggtgacagagtgagactctgtctcaaaagataaaaaaattacttaggcagtatgtttccttttaggttgcaaggactttattgatttcattgttaagctagccttacaaagtatatacatacacacacatataaattagttaaaccaaactaattttttctattcttattaatctcagaataattactgaaagatgaatctaggttttttgtttaggcttctgttagaacactgtcaacaaatttctctataaatggtgataattagaaaaattataatttggatggactgataaaaaatatgtgtatatatctttcaggatgttgctggagcactgtcagtagaagaaatcactgaactactcagtctccataaattatgctgtggccgtagctggtatattcagggctgtgatgctcgaagtggtatgggactgtatgaagggttggactggctctcacggcaacttgtagctgctggagtattggatgttgcttgattttaaaggcagcagttgtttgaagttttgtggttaaaagtaactttgcacatagtatgttttaagaaattatacatctcaaaagatggtaatttaggatgcatatatatatatatatatataaaggaatcttggattgggaattcagtactttgctttaaaaaaattttgtggcagaattaaatttctaattgagcagattagattgaattaaatagaaacttattgaatatacattcttttaaaaagtatatttgttatttaagtttttcagataatatgtgaccaatatactgggaaagaggtagtcacagagaaagggtaagtgaaggtttattctttcagtgaaaaaagaatagccaattgagtgcctaatgagacctctgtgtgaagcaagtgaagtatagctgcttcttttaacctgccttttcactgaatgttggcagcatttagtagtagaaatgacagttgcttaatgaaatagaatccaaactacatatttggataataggattactttatgtttatgttcagagttaacagaacacctttaatgctaagaactataaggtacagaaaattaatactttatatagtgttttattaactttctcctacagcattttgtataaaacacaatgagggagtgaaatgttacccaattaggcttgtcaggttagtaataaactgaacagtaataaaactgtggaagtaattggatctgaatttatgaaagacccatttccaggactgaacctaggtcagagctctaaattggtccttctatttttcaacaaatttaaagtaatatttctttctaatataatattgcatcctttgtgggaatgactataggtaaaatgtagtaagtaacgcagaaccagggttggctttatttaaaagctagtgacctaaatagaaagcgaacttcaagagaagttgtaagtacagtggcaaatgcttattacttacttcaaactgtttcccaaaataagtgcatttattttgacaataaaacttaaggctgttcatgagaaggccttgaaaagttactctagaggaaaaatgtctaaagaaaaaaaaaattcaaaaagtttacattaattattcagtgttgtgagtaaataaaaatgtgtgctctttactgtttttcatttttaaagaatattattatggaagcacgatttatttaaataggtacattgagacttttttttttttaatgttctgatacattaggatgaagttaaatcttaaatcttattagttgaattgttgtaaggacagtgatgtctggtaacaagatgtgactttttggtagcactgttgtggttcattcttttcaaatctatttttgtttaaaaacaatacaagttttagaaaacaaagcattaaaaaaaaagcctatcagtattatgggcaatatgtaaataaataaatgtaatatttcatcctttatttttcaggtaaaaggtcatgctgttacaggtgtagtttgtgtgcataaataatacttccgaattaaattatttaatatttgactgatttcaataactgtgaaaaataaaaaaggtgttgtattgcttgtgagaacttgaactgtttactagttaattgaagaaaaagtgtaacactaaggtgaacttgcttcccttttcactaattttgctaaactttgtaatgcacattcttagcatataactgaacacagttgaaaaattgtgcctgattataatgtatgtataatggtaggtgtttgtgtgtgattcatttttaaagaaatatttttctcaagctcctattactatttgtggttgtattatttcactaatcattagttaagactgtgctagtcttccctgggaaactaagaagagagcttttttatatacagtatattagaattttcctagtagctgaatttctgtattaggtctaaatattactgtatgttatataaagcaggtatgtcaagtgtatagccgtagtctataattcaggaatgctttataaccatcagaagccattatttgcactacatatatgataagtatagacagcaataaaatgttaagatcatttttaag

SEQ ID NO: 37475 - DNA, 34679 bp, Homo sapiens; identical to SEQ ID NO: 37474

SEQ ID NO: 37476 - DNA, 36835 bp, Homo sapiens; identical to SEQ ID NO: 35756

SEQ ID NO: 37477 - DNA, 134141 bp, Homo sapiens
tggcggcgcagacgccgcaccctgtcgccgcgaagccggtcgcgcgcagctcgtcccggccctggcccgccgcaaacgaggatccgctgcgctcggggaacgcgacagcggcgctcgtggccccggtaactgcctcccggcccctgccccagcccgccagtgccgccgtcaggggtggggagcagcactggggtcccggacacgcccggcgtgggctcccgctacccatgtgtgcgtgtgtgtgtgtgcacggtgtgtgtgcgcgcgtgtccgagtgtgcgcgcgtgtgcgcgcgcgcgcgccctccctgctccttcgcaccagcccccaaaccaacttgtccccatcaactccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggtttgtcatgtatccttggaatttcagatgggaggaataatctgagtatcatccacctcattattgtgcccacttgaaactgttccttggagattttaagatagatgggtcttcttgcagctgggtctttgtacccatagagctgactataatttccacttgattacagctaaaatagtctttaagatgaagtttcctgaaatgatttaaaataaacacagatgggaagggggaaaaactgtaatgaggcacttaaaaaataaagtgagcattttcttaagaacaaatgggatttttcagtcttggagaggtttgcaagaaatgtatgtatgttttaaacctttgaaacagaggggttttttaaactgcttttaaaaaaatgttactgactctgaactagacttttctctcctatccatacatgttcttgagatatttctgactttggaatatgtcacttttccttctaggacctgaagacccttccagcatgccagaggaaagttcccccaggcggaccccgcagagcattccctaccaggacctccctcacctggtcaatgcagacggacagtacctcttctgcaggtactggaaacccacaggcacacccaagtaagtcttccccagaaagtcaccccaggtgacaggggagcatggcccctgcttctcctctggtcgttatcatgtgccatctggggcggggccgctttctctatgacctacttcccctgccgttttaatgttaggctgagcaatgttaacaaagctaaaatgtatactttataatttttaaatttaagaagcaggaattcttttttcattataacaactcagatatggatcctaccgtatggcaattttcaaaaattccacatgactttattttttgtactggagttgatttccggttgtacaggcattcatttaaaatcaaacccgacaattaaggaaaatcccctagatggatgagaaacccgaagtaatacatatatcttcacctttgctcacttttcctgcttgtttctgagcttctgaagatggcatacatgtgtcaccaggaagaaaggggcctgggtatttccttctgattccttgccagctcaattactttgtacattttccatcaaggatttgtcttgctattagaagcaaacattgggactatacacaagacagctggtctcctgctgctgctccctcctcttggatgaagcaggaaaaccctgcttgtttgtgttatttggaaaaagaatttatttgtggtaaccaattggcctggtgacaagaacatttcctgttccagggacattttacctgttttgtaggcctcttgtctcctagggatcattgtgtggttggattatgtctctctttgtgctccagtaatcacccaaccctcacacaggtgtaaaatttcttctctgtcttcatcaaggtatctatgatccagggagctgcacgttaaaaacacagagatatggacttttaaaacccggcatagagtcatagcttcagggcagctacacagactggctatggtttctctctagtgttttcaagtgggtaacgtgctgagaagagttcctaccagttctggtaatacatttcttaaagaatgtgtctgtacgtgcatacgcattagaggaagtgggggggttgttgagcattatgatgctaattaatcattaattctccactctgacttaactggctgtagaattgctcaatcttggattaatttctaacagattagtggtttgtggtaatttgatcaatatacagaaagaagacaaataattgaaaatagaagtttttaatgtctgagtctcagacttggggggctttgttggttaagtagtgaggttgtcctagttcgaagtcaacaaaaataaagaggttctgcagtcctggcacagggggagggtggtgggtgagtgggttagaaacggtcaagttggctgccctgccctcccttcgcctgcgggtggttttcacaatctctgtgctgaagttgcattgcagggagccctctctgctccgttgcttttgctctagttagagatgataactcaacttcttaatttaaactgagctgcctcttggatgtcagcgtccgccttgtggtgggtgctgatgggcttaagaacagaggtggatggttgaggcagttcggccccagaatttggaagaaacctatgggtctagaaaaggttaagggaaaaaaatattgagggcaggagcactgaaatagaaagagcaacagaaccatgagcatgtatgaacactttccatagtgttatcctcagtttaccaaagaggaaggggctggccaaggtcctacctacctgtcctgccctgcctccagcccctggagatgatgcagaggtcctggaggccccttgccatgactcatgttaaccctgtgcttgctggatcttggggcagtcttgggggtcctagggtgggggctcagggcagaggtttgtgccagccagcatgaaacacctctgtatcttcataaccgagaccagctgctcagcctgcctgccctcttgcatgatctgggagacccccgcagcatcattataataagtattattattattgcctgcacagaatcattcactctgcttttaggaagagggaggggacctcaagtcaccagggcttcaatctttccccccaggctttttacccctcttcagcaaaactagggcctcgctttgtgcaatcctgtctcctcccagttaggaagaaagaagggaggaaaagcaaggggcaaaaaaagaggagactgaaccctcccccactactgtaccaactgtgggcaaaacctgggttaagagcacctcatctccagccccgcctctgctatctttctcatagagaccctagggacctcagaagccaccccgggggcctgtggatatcttattatgcagaaggatctgtgccagcctcggttagtcagtactggtttgggtagattttctggccaaccagttacctccagctcctggagcctgccgtgagcacctacagagacatattgcccccagaggacctgctgggttccaagactggctctgcaggtggctcggagcaacactaagccacaggtgtcagccgctgcactgggaacctggcttaacccgctttatgcaagcaaattctgtcgtataaacaccagcctcctcggactggaccctgagaaagagaaagcatgtcttgggttagcctttaccatcagtgctgtttttaacgtagcaggccagagtctccgtatttcatcatcaggaatcagaacttaaacctccatttggcagtaccaaggcaaattcatgctgtagtgtttacggtaataacaaatcttatacttaaggcatggcacaattatctcatattaattgagtgccaggtatgttctagggtctggactagattctgtgcacacatgacctcattttaccttcacatcaatctgtgagacaagtattattattcttactattcccattttacagatgaggaaacagaggtccaatgttacaaagtatctttctccaaatgaccctgctggcagtagtgggatttggtccgcaatcttctgacatggaccaaatccaattgttctccttacaccaccaagcaggacagatttcttctttataggtagtgttttcctgataaattcttacattttgggttagggtaaacatcatttcctagggtaaagaggaagagaataattaattctccctaatcgtttgctcataatatatcaaaggtgggaaatcagctgggttccgtggtacacatctgtagccccagaaactcagaagacagaggcgggaaattccttgagaccaggagtttgagaccagcctgggcaacgtgttgaaattctgtctcttaaaaaaaaaaaaagattagagataggtatcccttctgaaaacaacaacaacaataacaaaaaacagaatttatgcccttgcctgactggctgccttatccaattcaacatgctggaacttaaaaatattggccgggtgcagtggctcacgcctataatcccaacacatcgggaggctgaggcgggtggatcacttgaggccaggagttcgagaccagcctggccaaaagtggtgaaactccctctctactaaaaatacaaaaaattaccggggtgtggtggcagacgcctgtagcccccgctactcgggaggctgaggcaggagaatcgcttgaacccaggatgcagaggttgcagtgagcggagatcgcaccactgcactccagcctgggtgacagagcaagactccatctcaaaaaaagaaaaagggggggatactggatcatgagcaaatgtccactgatgctatcagcacggcgatggagactggcccatggatgggggcaagccgctttgtgggctcttgagctaggaagtcacagtttctcttgtgcccctttgagaaatatttagcacctttgtattcagccaaccaagtggctctcagtccatagaaagacgtctagaagttaactgtgagaattccttacccatgagctcaggtgagggaagggtgcggtctgaaaacattgtgcaatatgatgacttagactccaaaaatatcctcatttgacactggatgaccaggaaggctggagagcaggctgtaattatatgattgtacaactctgacccctgccaggcagtgagttcaaggcatggagcagaccatatttgctgttcatctgcaaggcccggcatgaaggaggtgctgagtagagggttaccgagtggacacatctcactctcatctttcctcagtgctagtccatccaccggctcatgccacttggccttcctggcagcccctcaactctggagagctggcccactttcttttctgtagcttctgttatgatgataaaaactggtgtattgaaggaactggcttaaagtgtgattgtccctccctcgctgatgtcccaagacacacgactgggaggccagccctccccacttcctccagagccctgccctcacacctccagtaagtgcctcctcctttaaatctctgtttagcattttgttccaaattcccctgcatttatggagaccttctggaacataagccctttctctgaaccttactggccttgccttctagtcctttcttgcctcagacctcggtcacgtggcttttctctccaggaactttgtagtcacccctcaccatggctccctcctctcccacctggccagctccaccggtctgagctgcctcggggccagggtgcagcctgcatggttttcaggattttcccgtcggtgacatggagctaggtgctgcaaggggaacacaggccgtggatggactagcaagggagatttggcattgtttctggaacctgcccaagtcctcagaactgtggccgctttcagtggatctagaaccaataagacagggctcctccctcctgcagttccttcccttgctcccgggagtggggctcagtgatggtccccatcacagccctcccgttctaggcccatgttgacccctttctccatgaagccttcactctctgtgtgtgtctacagcaatgggcagtgccatcctcgggcacttcccccatctatgccagtttacctggaggagaggccatgccctgaggcctgggtagatttaagtgatagagaacatccccccttcttgcgtcctcgtaatatcctcctcacatcagcccccagccagacacgggtgtggcacctgtggctctgggaaataagggcccctcccagccatctggatccatccggaggtgaacaattttcaccatttgcttgcacataattccatccccacggccttcctgagactttgtcctcaaaggtgggactggcttttccttccccgcccttaggttttctaatcaggttgtcagccggctgttgagtgctttctttcccccaccccctgctttgggtgtttgttcagtgttccaggaaaccttctgcaggtcctgttttcatctttgagtgtagaagggagtgtgaatttccatctccccaggccgcagctgctgaaccctgtagcccttctgaactcacgccacctgcgactaggtgttcccgcatcaccagccagctggtttagcgcagatgctccctggggtcagctaaatcacacagcttattgtcccttcaagtggccattttgaaccccactctgtcagtctctgcaggggtgaggacggcctggctcctgctcagcgcccctcgcatgcagctctgtggctaccccatacggctccttgctctcctctcccaggatccaaagcagcgattcattcagcaaatacttccttattgacgtctacatggtccttgggcgccagggtggggaaagggtggcaaagatcatgcatctgatgaaggggtgggatggaccaacacacggataattataatatgatgcagccaggacctagaggcagggctgctgctatgccacgcagagcctttgtgcaaattagacagaggtgcccactgggcagaggctgccccatgagttggtgagcagagtgtgggctgggtcgcagctcctacttgcccttctgtcctgtgtcctggatggtgttccaccctcggaaagggcacgtgggggagaggacccaaacacaaaagcatgagccaaagggtgggtgtaggggccccagctttgtatccaaataaccagctagatggagaggttcatagtaatataggcgcaaggcaaagaaggccgcgtcatggcaaagacgtagcaccgcgtgttagcaggagatggagagatgaacatggactgtacctgaggatgcatgggcagcagagggagaaggagggtgactcccaggtgtctctggagtgatggcagaaggagctggtgttattgagggtgtgggaatgtgggattctccttcacagcacacacctttaatgtattctttgctcggaacacggtggggctgctgtgtggcaaggaggatgcatgggatcatcgcaagctgcgggtcatttgttgacacagccatgggataagccaggaggggagtgaggagaaggagcagtggccaacgaactgattacatttcagacgtcaccagttacaatatcaatcaatatgaatcacgagtgactctgctgaaggtaaggaaggaatcagcttacaccctctccccacaaggaggaaaaaaaagtgaagcacctttgacatatgtctgttgttccataaaatttactcttaaactctgagaaaatgggccctaccatgcatcttctagcaatgacattatttttagtcagattattgcattttagtagcaccttttaagtagtccattttaagaatttccagaagtttgtttttcttgtatgaagctgttatttctccttctgatgcttctgcctttgtgatagcgtagcaaattgttttatttttaaacagggcatttcttctgggctttttaaaaatactcttcaaatagcaaagatcttttgatggcaagaggcaaggccagctgctattcttgcagttgagttttccaacagcttctttaagggataatttcttccagttgctgtaagaatgttctgctgatacaaatctggctttgttttgcagtagagtcgaagaaaaaaaatagcagaataagctgctccctgaatagcaacctttgtccaccattgtctatttattggcaccttttaggtttagatcttaatcccagatgcactttgtccatgaatgcaaaccaaactattggtcattgtatacacggaggaaatggtctttactggtgcaaatttttacagctgagatgacaagatgacccttgtcccatattgcagggtcatccaagattcttgttggtaggagtttcttttcatttcacacagccttgttcattaggggatgggggtggggatgctgcggtggtcagcgagtgaaacggggtgacattgttctctgtgtgtttgagggctataagaagagctgtgtgttgtgtgttcctacacttgcagctgccccaagttgacctttgtgtccatctgctaacatgcctctctcccgggctaatgctgaccatttattcccatgcttgatgttccgcaaagtctcttgtatatggtgatgagaaggtatgcctcaccttccagggagtcacagctctagcaacattctgaagagaggaagggagagtgggagggaggcagggaggaaaggaaggaaggaaagaaggaaggaaggaaggagggagagaagaaaggaagaagagaagaggggaaggggaaaaataaggaggaggaaggatagaggagagaatgaagaggaggaaaacaacagactgagcagtaaggtatctttagagatcagcagctgtccctgaccttggggacttgcaggaggttcatggatagtttttgggggttagagtgtggggcttttgacatcaaaggggtatgtacacttttctaggaaaggaagatggatcataggctccaccagactctcaaaatgggggtcaatgacccgggagtcctgtgtcaccctcatcatttcatagatggaaagactgaggcccaggggatgaaaggagtttctcaggctgccacaggactggctcagggctgcagggcagcctcctgatcacacgttgcttctgcttcaggcttttcatccagaagtttcccttatgccttcttctgatcaatttaaactacaagttagccctccccagcaaatgtccggtttggagcagggcttggagaggtaccagacccctgtctcccatgggaagccatttggccagcctccattttgctgggtctgttgacagtggttagaagtatgtgggcacctaagtgatgcccgccgaggctgctaataagtgcagatggacctcagaagagatggccagagacctacttagagcagccaggagataggtgggaggaggggagaaactgtgggaggaacaggagcccaggaggcctctgggagaacaagagtcggaagaaagtggcagactcttatgagggggccccaaacaaaaaggagggaagcaggggaaaaaagaatgaaaagggaaagagatggaagggcacaaaaaaactgcacaggcggccacatacagcctctggttaatgtctccttgtcaaggcatgtcaattttcccaggtcattgacagtctactggattagagattaaaaacctttagttaggaaattgctgtctttagacgttttagaagttcccctctgtttatcctcttccgtcaatcttgaagagacgtgtttcagggaaacatagcctctctgaacagcaaaagccaatggtgcatgcagaagagcagaggtcctgggacaggactgccaggaccacaccccgatcaacaccagccaggtatgggcctccagagacgctactgacccatcactgcagcagttttctcatctttaaaatgaggactaatagcacctttcccacatggctggtgcaggtaagagagaaatgtgggctccctgaggggtcaacgtgaactctcttgattcctttgtccgcttcatctccctgcaccatcgttctggggactctgcggacctgtgccaggcttgttgattgcccaccgttaccccttacttccctccaccctcatggcaagcgccagtcacagaggacccagtatgaaagcaatcatgcttttgacagattccagcctgactgctgccctcaccacaccaggccacaggctttccccaggcctcaggttactcaccttttttttcttaacttttttgtttcttcaaatgaaactcagttccatgtcaaggagatttcaggctccctgataaacttctgcagttgctgggtgcttcttttaaaagtaaacaaaacaagaaagccacaaggaagccagcctttggtgtgaacttctttttgagataacacataataagggtagctcaacacttttcttttatgtggaatgcagtacaggatttgtggcataactcttgactggaaggagaaccaaacaacccttagctattatagctggaagtcaacttaaataagccttccttagagcatccagtcaattttcagtggtccatgtcttaaggtattccagtctttggcatatgtttttcctttcgtcctgattacgttatcatggttggtagaaatgtttctgctgcagagagtgagactgttactacaagggccatgtgctagatccagagtgggcaggatagtctggggtatgttaggaatctattgctgttactcagcccatgattctgtgggttcgcaattagtgctgggctcagctggatgggtcttctgttgctcccagctgggctcctgcatgtatcaatggtcagttgtggatcagcaggcactggcaggccagctagaggcttgccagtcttggatggctttaccacatctggtgttggcaggctgttggtgggatcacctcagttcttgtccatgtggtttatcatgctttctcagactggcctggatctgttattaaggtggcagtttttcaagagcaatgagaacagatgccagtatgcaagtgcttttgaagtctctcctgtatcatgtttgtgaatgtcccactggccaaagcacatcaggaggccagcccagaggcagtatgtgaaggcatgtccaaggagcaaggatggaggagagaatattttgtggtcatttttgaaatctgttgcatgggggaaaatatatttgtattaatagttgggacgagggttgaagtcttattactacctctgcctctgagtaactttagacaaggtaccagctctagactctccagcaagttcccagaagttttttcttttgctataactctgggatagtttgcatcttgcaagagtagaacaacctatgagcttctccagggcagaattcatgtttagcttttttctatcttctccaacacatgcctcttgtagagtttcatacctggcacaaaataagggatcaaaacacgtttgttgcatggatgattcaagttcctcatatttacagtgggatgactgagagaggatgattcctgaagtctctactgccacagttttgcaggaaaagaatataagcatttctgttgagtatggcttcaaggcattaaccttttgtgcaggaaaggagcacctaaatccagaagtatcaccgaaggagttagtgacacctagaagaagaatattccctgcaggttaccccttgagatactggatggctgtactttcaccagtttggttagctttgctgtaaaactctgtgtgaaatgcatctacgagtgggagttacagtatggcaggtgttttccattttagcacagaagttgctgtggatgtcagaatctggagggtttgcttccttttttgattgggtgggggaatggttcaacaggtattaattgagctccagatgtaaactcagtactgtgctggacagcaaaggagggtccacaaacagcatggagacgtggcccctttcacttctgacctctccatggcactagctcttgctgaacacctcgtgtatgccaggtctcattccagtttggagataaagaaatgaagttgccctgctcctgcctttgaaggcatctccatgcatttgtcagggaggcagtgccatacaccatggatgttgtcttgtgaaggctgtggattctgtgttgggatttcagagggacgtttggtgactttcagctggatcttgaaggtagaaagggacattctgggccgaagggaatcacactctcacaggcatggaagtgagagaggatacagtgtgctctgaaaataacaaggattatttggaaactggagtccgaagtgcatggcagaatgtaagtttggaatggctggctcaggagcctgcattggaatggctgttgtctactctgctgggaccactataacaaaataccacagactgggggtcttcaacaacagaaattaattttcttgcagttttggagcctagaagtccaagatcaaggcgtcaacagggttgatttctcctgaagcctctctctttggctcacagataccaaccttctttctgtgtcctcgtgtggcctttcctttgtgcactcagttcagttggcaatgaccattttgacttgctaaggaatttgggcttcattgtataggctgtgctgggaaccatgatagagtcaggggccatgtgggttggtaattgtttacagtctagtccattcagagcaacagagaaattcctgcaaaggttttatgtggctaaatgtctagaattggacaaggatctcaccctttcacatccgtacttctctgtggttccgtggtggatgccccagcctgcatgaagttgctgttggtttatcctttgccttgatgtcttttgtccaagaccatctagtctcagcaagccccacaggccacctggctcaagggcagagccagcacatcatgggagcatgccaggaatgaactctgtcattgcagagtaagggtactgtgcagagaactgtggccatcctcacttctttcttgctgatttttgtcctcagggatatcactcattagtcttttttttttttattgttgttttaagagacagggctttgctctgtcacccaggctagagtgtgttggctcaatcatagctcactgcagtctccaactcctgggctcaggtgatcctcccacctcagcctcctgagtacctgggactacaggcacttgccaccatacccagacaatttttaaattttttgcagacacaggatctcactatgttgcccaggcatgtcacaaattcccaggctcaaatgatcctatctcctcagcctccaaaagtgctggtattccaggtgtgagccaccacacctggcctcatgattggtcttaatcagacatggctctcccattctcctctcccagtggcattgcagctagagctggctataggacttggtgatggctaatgagacacagaagacgtttctggaggatattagctccatgataaaaggtaagagagagcaagatgagaagattgatctctctctctgccccaattcccctcactccctacattctgcctttgtgggcatagtgcttgcagctacagtagccatcttgtagtcatgagatggcaaggctaacatgctaacagagagtgatgaagaaagctgggaaaatctgggtccttgatggaacagctgagccaaccttggatctgcctataaatataccttgataatacaaaaatccacaccgatgtgtctcaaccaccaggtatgttctgattctttcagccagatggatccaaatgatggaagatccaaatggtggtgagtgtttgggctgctgatgcttgaactgagtctaaaaatggcccaagacagatatggaggagcatgaatgagaaggaggaaaggaatcctaggcacatgtccagactaagtagaggcactggaggcaggaatgagcaggagaagagaggctgatgttggagaatagtgggagatgagcttggagcctgagtaggcattggttggttgcctccccagtatccatttccttcttccacccacagtgccttaaatttaagaggcatctctcctctactttcagcccatgtgtttctgttggtgttgactccaccctggtgagaggttgatcttgcaacaagtttagcctatcatcattttacattctccccagctacagtgattggttcagggatgggcaagtacccagtgcaagtcagtgatcaataagacttcccctgggacttttgggaaggaaactgtcacttttctcctctgaagttgactctagaagtgtgaaccctgggcactctggcaaccattttaagactgcaagggggaagtctgaccaagaatggaatctaccttaagaaagcaaagctaagaagtgttgaaagagaaaccagttcctggtcatgttgccagaccccttgaatcaaacctaacagtactgagcctaacaatcacataaaccaataagcatgggaatcactttctgtcacaactgaaagaatcatcatagatctggaaatggtcacattgggggctatggtcatgttggaggttgtagacaaaatttttgataagaaagctagactctggagcagagaaaaaaagagttttcgtccaggcatggtggctcacgcctgtaatctcagcactttgggaggccgaggcgggtggatcacgaggtcaggagatcgagaccatcctgactaacatggtgaaatcgcatccctactaaaatacaaaaaattagctgggtatggtggtgggcacctgtagtcccagctactcaggaggctgaggcaggagaatggcgtgaacccaggaggcggagcttgcagtgagccgagattacgccactgcactccagcctgggcaacagagcgagactccatctcaaaaaaaaaaaaaaaaaaaaaaaaaaaaagacttttcacagcatgtctaaattagccagagtaggggtcagaaaacatcataaaatgaagttctgagttcctgcccctgttcttgtatgactatgtctttagtggccaagagacctcccttctctcttctcatcactgacagagttaccaaccagagattcacttaataaaattatcttttaaaatgcaaatatcttttcaccttaatacactgaaaaaagaagagcaagttaagcctaaagcaagcagaaggaagaaaatcataaagatcagagcagaaattagtgaaataaagaataggaaaacaatagaggaaataaatccaaaagttggttatttgaaaataccaataaaattgataaatcttcagctagattcatcaagaaaaaaagagagaagacttgaattactacaatcaggaatggaagaggtgatgttactaccaaattttctaaaataaaaagggttataaagaaatactataaacaattgtgtgctaataaatttgataacataaatgaaatgaacaaattttaagaaagacccaaacttagacttaaaacaagtaaagacattgaattggtaagcaaaacaaaaccaaaactaaaaaaactaccaacaaagaaaaacccaggcccagatggttttgctgttgaaatctaccaaacatgtaaaaagaattaataccaattctcacaaacctttccaaaaaatagaggaaaacacttcccaacttattctaagtggtcattattacccagataataaaagtaaacaaagacatcacaagaaaagaaaactaaaggtcagtatttcttatgaatagagatgcaaaaatacttaacaaatactagcaaactgaatctggctaatttttgtatttttagtagagatgggatttcatcatgttagccaggctggtctcgaactcctgagctcaggtgatccacccgcctcggcctcccaaagtgctgggattacaggtgtgagccaccgcgcctggccctatctacctatttatccagccatccattcattcattcacccatccatccaccaactcacccattcatccatttacccatctacccatccatacatccattcatccttccatctatccacccacccatacatctactcacacacccactcatccatccacctaccatctacctatccatacattcatttatccttcagtccatccgtccatccatccatccatccatccattcattcgttcatccatccacccaccccatacatccacccagccacccattcatccacccttccacccatccattcaccaatccacccatccatccatttattcattcatccacccatccacacatttacttatccatacatccgtcagtgtcattcagtaaatatttactgagcacaaactctatggcaggccttgtgctggatcttgggtgacagagaaatcattaagaccccatggtccctgccttccaagggctcacagcccaaggagaacggcaggcaggcaagccactagtgcatgtgccagggtctggagtctagaccgggtgatttgcctggagaagctagagggcttcccagaggagaggaccctcacagtcccatgctcatgccccacctggccattcagtgcatttagaattctatgcaccagaacaaagatgggcattgtcaggctctatctccactgaggccccagccaagaattggggagacagcctgctgatctccatggcttaacctcagagggctgcagggaggcatgtattccttgaatacatgagtttcttaaaattcttttgtaaccactttttatttatgcttgtatcacctttggaaaggggcaggaaacgaatctctttggaaggcccaaacctttgtctgacacgttgctagatacttctctggctttacctccctgactctcacagcacccatgagatgcctggcctcattcttgctattttattgccatagacagtgtcagctacatgctattaagtggcagggccaggatttgaacccaagtctgtttgctttaaaagcaccattgaaattccagcacctagctatgcctcgtaaaatattgcagaaccatgcctgtaactcagctgtgtgtacagatgctacgtaaccctcacaacaaccctagtggggggtgggcatgataagcccattttacaggtgagaagactgaggcccacaaaggctcagtggctctgatgaggtcccacagttaggaatgccaggtctgcggtatgagcctgtggtccatgccccattcaccctccataggtgttcagctcccgctcccactgatgatgctggcctggctgcagatgccccttcaggtcataatggagtgcagaggcctcattgtgcctatgaaattgtgaccattttccttaaattcatcactcaatgctcgtctcacctctcccgcattctcaataaattcctgatcatttatcgccatccgtttggcatttcaccacccagaggaacttggagccatctgcagccttggaaagttcaagctgttctccttccaggaaagaaaatgaatgttacataagatggagcccagcacattcttatagaagatcaggaaaccacttctctgactaaaacagctccctgttatctctgcctcttgcttcctattttatccaggtccacaatcacacggcagctgccgtttttaaacattctctcttgcagagcctttaaaaagagctccatactgtccctgtgttcccatagaatggccgtctctccaagacccccatggactctgtgaggaaaggcttctcccactgcattgttcccagcagagcctgtgctggtggccttgtcctttgtccttcaggtgtgggtgggagacctctccaggggtcgaggtgcctgcagacccccagtggaccctggcccacttcctcctagtgcctctctggggtggcaggcctggcccaactattaccatttcttcttcatagaacaggctcttcttctacttgctcatcttaggttattttatttggttattgtcaataaaactggctctgtgttttggggaaacatgttcattatagaaccttaagaaactgaagtagaaagatgtgactactgaccactccaggacaattaacgttgatgtgcacagactctgaggagttggaaagcaccctaaagatgatctattatagtttgacctgtgggctctaccatggggaaactgaggcccaggggacttaggctcactcattcccctgtaggtggccatggcaggagtggggagtcctactcagggagtcactgtgggatgggggacaagtgagcagaagcgatcagtggtctctgccatgtggccaggatggctttaagcagacgtgacatttgagccgggtctggtccgccccgtggccctgcaaccctctgctcactgccggcctcctgggcgacactgctttctggctctgcggccccatcctcctcccattgatgttacctcctaactagccatcttgcattccgggtggtaattcctgctaaatggctccagatcagcttttcccaaaccttgattgtttacacgccacctttgtgattttcatagcggctatttaaatttcatattatttcttcatagtttttttaaaatcaactttcttttttactttaaatctattttaagaggaaattttattgtaacacaagaagtagaaaccagtgtcaggggctgtaaataggtgaccacaaggagaaaacaaggcgacagtgtattgcagctctgcactggggtacactcaagagccctgagccaccccgtcctgaaagtggtggtgagctagtgcctgagaggtgcttaaaatgggtcagcacctgagtgagtctctctcttaagtactcagaggattggaatgggatgaacgagggaatgagtaatgttttcctggtacacggtgatggcatttcatgctgtgacatcaaacttccctaactcatcccaggcacaaccagctgtgggagtcctacaggctgagagactcatgctctgcacactcagggctcatcacaccagctagtaaatgtgcagggtttttaacaaccctctgtgtgatttagagtctagctctcttcttttttgttttttgccctgacatatatgcacatcttcattcaaagtcatcccataaatgagtgtactgttcccctcctatggaacatgcctgtacagtaaaagcatcccatatggtgtgagtgcaccagcatcggccatggtttgctgtgaggctggttggcaccaaggagaattagaagaagcaggtggggccagaatatcttcacccccaccccactgcttgttccttcaggcggcctggaggtgggtgcccactgccagaacaagagcaaacaaaggccctccccgtgcagcaataaagagactcaggcttgtgccaggtgtggtggctcacgcctgtaatctcagcactttggcaggctgaggcaggtggatcatttgaggccaggagttcgagaccagcctggccaacatggcaaaaccccatctctactaaaaatacaaaaataaactgggtgtgaggggacgcacctgtaatcccagctactcaggaggctgaggcaggagaatcacttgaacccaggaggcggaggttgcagtgagccaaaattgtgccactgcaccccagcctgggtgacagagcaagactctgtctaaaaaaaaaaaagagagagagagagagagactcaggcttgaaagacagtgctccaagctcttgcacagaagcgaggtcagtcataccagcatctggtccttttccagaatcttgggacagctgtggagctcttcattaatggactgctctaaaagtcacaccatgtgccttccacagaccatcagtgatttcccagaagggcagttccaaatattgatctaaatgtcgcctcagaggagccctttggcataagaaccttttcaaaaccggccagggccccggctggcctagaagaggcatctgaagagatcgcacatgttaataaaggttcttaatctcttggcctcctataatgcagaactgcttttcgattaaaaataaatcactcctggagcttgcatccccaaagcatatgaaataattttgaggcagtagatatcttgtgttggaggagtaataatagccatctaagtttccagcctagtacaaggggggtgattatccatctcaccccactggcactgacatattttctgcacctgtaggagattacaggaggatgggaaagtgtgggagaggctaatcaggcttaattagggaatgcaggatgtcggttttgcttgttattgcacctgggcaccagggctgtcaggctgctgaccgcctcggtgggcctccacactttggtcctgtttgcattttatgagcagcaaacaggtatgcacctaagtaagtgaagttcaagaccaaactcttgaacctagtatctcttacactccgcaactctagcatctccagtcctataggaagcaggcctgtgctgtgtggtatggagcggatgtcccctgtctcctgaccctgacatgcttggctcagggtgcccaacccggcctggcatatgctcatctgctaattattctgggtccacactagactggaagttccataagggtagggacttggtctgagatgtgtccccagagcctaacccagtgcctggccagacagagctctcaaggaatctctgttaaataagaaatagagggctgtgagctgtgtgggcctctgtctggtgacaagcatgggttcttcctgttgggttacagctgtggccacagcagccttccagctactttcatagggcttcatcctttctagaaaaaaaattatatatataaatattttatattataaaatatatgatatatttattatattattataaatacatattttaaaatacataacatatacatatatattttttctttcttttttaaaggaaataaatactttagggactactccagaaccttgcatgcatctgaacttttcttggaaatgtcaccccttttaattttgttttattgtattttatttttgagacggagttttgttcttgttgcccaggctggagtgcaatggtgcgatctcggctcactgcaacctccgcctcccgggttcaagtgattctcctgcctcagcctcccaagtagctgagattacaggcatgcaccaccaggcctggctaattttgtatttttagtagggatggggtttcaccatgttggtcaggctggtcttgaaatcctgatctcaggtgatccaccagcctcagcctcacaaagtgctgagattacaggcgtgagccgccgcgcctggccgttacccccactccttttttttttttttttttgagatggagtttcactcttgttgcccaggctggagtgcaatggcgctatctcggctcactgcaacctccacttcctgggttcaagcgattctcctgcctcagcctcctgagtatctgggattacaggcgcttgccatcaggcctggctagtttttgtatttttactagagatggggtttcaccatgttagtcaggctggtctagaactcctgaccttaggcaatccacctgccttggcctcccaaagtgctgggattacaggcgtgagccaccgcacctggctcattacccctttttaattagtagcattgctcttctctctctgactatacgtactctctctgacttctaaatttatcagcagcttcttctgaagctggcctggtacccggtgagctctacgggactctgagctgagtttagaggagggaaaggcagttgaagggatttcttgttggctacaatgcttagacacctcagggggtgaagcacatgctctgactgttaccagtaagttcccaggccaaccagtgggtagttcttactaccacacttggcttgctagggcttttgcatgaaaatgaatgtgaggacataagatcagttgtggcaggaagacacataactaaccacacaggggaccaacataaaagctgtttcctctggtataggctgactaatgcacgggtagcctggctggggctccacaggcaggaaaacattttgataagatgattataacagtagccataacagtagccaactttattgtgtatattctatgttgtttaattctcactacaggtcctatggttctcctcatttcacagatgaagaaacagtagttcagcaacttgcccaaactcacagaagtaggaagtcacagagcctagatctgaactcaagtcaactggctattccccatgtaaggggtcttattaatgatagtctgcatttgttaaggtgcaggctgagcacagagacctcaaaatttagtggctgaaataagagagaggtttattttgctctcacttagcagtccagaggtgagcagtccaagttggtagggtcactgggctccacatggccattcagggacctaggttccttccatcttgttgccccaccaccacttagagtgtggttcaatcaccaaagctggtcattgccttctctgtgttcctgaccatggggaggagaaagagcaagtctaaggcaagcagattatttcaagtaggtgttgtagaaattgcatacgtcacttctattcatattctattggcataacttagtcatacggccacacctagctgcagggaagtctgggaaatatggtctctatctgggcagccatatgaacagttaaaattctataaaactctgtaactacagaagagagaatgcagtttggggcaatcagtttgcagtctaccataaagaccatcttctcttttgtgaatattaagactgggctaccacaggacagtgttaaatgcattcatgatcatatgcagacatggggtcatctattcatttcataaatatgaagcccttcctttgccggtactactgtagtgagctgcttgggggctgccaagatgcctgattcactgtctcttcctgaggcacagccgggagatgagacatcagccaggaatcaggaaagaggaaagagagttgactggtggatttcattcactcattcaacctggtgtatttacacacatcttgtgctgagaaaggacttgaggtagcccacttgtagtaggatacagctggcaaaatgctgttcgtgtgcgtaatctctttcaccttctcacccactctgagggaggcagggtagtttcagaggagttctggaagcatcagaaatcccatgactggtgagtggtgagggcaggatttggagctggtcttgagggtggtagaaagggcaaagtgcagattcgaagttgggagagtccacattcgaggcccggctcttctgatcctaacgaatagcttcactcacccctggaagcctcagtttcctcatctggaaaactgatgctcaggctacttatgtcaaagggccaggaggaggacctgctgagataatgggtgagtttctggggcacgtagatgctccacagccgtgagtgtcctccctggcttcttaggagcacttggtccctggcaatttgcattacatgttctatgatgtcctaagaatgtgtcctcgagagaacaatgagtccatggactcagggacactgggcagggccctatctaggcctttggtgtttggctccaagttctcccttcatcgtgggaatccagctgcaggcttgaaaggcaatgctcctgagactgctcccctgctctgccctcagcttccctcgggtgctctccagcttggctgcaccacctgtgacctcacttcattgtggacaccctgaccagggccccagtgactggggtacctggaaaggctgtggagcccagcctcctactgataggaaccttcctgcaggtgaggaggatgggaagggcatcctgagtggaggagaggccacacaaaggtgcggggagatgatgtaagtgcagagacatcagtgattttggctgttgacacaacaggaatatggcatttgtgtgagcacagatttgagtgggggaaactgggggcagggtgtggagttaggaggctgttgggattgttcaggctgttggggtaataaggtctgggagtgacagcagagggaatggaaagaacaaatccaagagaagtgaagactcagcaaagggcctgtccaaggaggaagtcctggaacccagagtccagtggcagctccacaagaggacaggcaggggccacagaggcaagaacagggccctggggtcccagcagggtacttcggagccccaggactgtgactcagagcaaagcagaggctgaagctgaaggtgggagctcagagagacgtgctgcctgttttatggcacccaaagaattcacttcatgggctagagtctgacgcatagagaacctgaacaggctcctgctttcctgcatacatagatacgaagaaaagcaaaagagtgattatcacaaaactctggacagtgggttgctcctgcagggagaaaggtatgcactgtgcttgcaaggtgctggtcatgtgctctgtgtctttgactgttagtaggtacatcgggtttccacctgttatgattatttgacctgtgcagatcagttgtttgtactttttaatacatatatctgtttcacaatgaaatgtcacacaccccttgctgctctggatgacatcaacctgggcaaagttggagatgaaggttagagatacactggagaaatatatgctatataaagaattttgggccaggtacggtgggccaggtatggtgggcccacatgcctgtaatcccagcactttgggaagcccaggtgggagaatcacttgactcaggagttcaagaccaatctgggcaacatggtgaaaccctgtctctacaaaaaataaaaatcagctgggcagtggtggctcgcgcctatagtcccagctactcaggaggctgaggtgggaggaccgcttgagcccgggagtttgaggctgcagtgagccatgattacaccactgcactccagcctgggtgacagaagaagaccaagtctcaaaaaaaaagttgatttttatgttgtttgtttttctaatctggaatatttgaggagtctagtgacattccggatgtcttaggcattatatgtcttaggcatataaataaggaatcatagacagccataataaaaggattgtgttcaacctccatcttttcaccctgagtttctattttcaggagccttccagctcagaaaataggctgcatgcggagcaagactagactgagtcttgacaggtcgaggggaatattacttaggagacatggttctcttattcgcctcaggaacattttttttttgcctgcaaaaagccaggaggattctcagctttgcccaggtgttctcagggacagccacacagaatgtcccagaagctgagtggaaagcagtcctgggatacaccctctgcagagggatggtgaaagacaactggagagacgattttgatgcggtcacacagccaacagtgacagtcatgtatgtggcacagcatggcctctcgtgcctggggactgcacagcatcacaggcttctcctctgccaccctgtcctcaagcacaccagtggattgcaggcctcccacggagctctgcagagtgggtaaggcatccgccttccagaacctctcagcttagcaggctgggtaaggcaggcagtcgccccgggggaatgtgataagtgcccaaagagagatgttagcagcatgataaattaggtggtaaatgcaccaggctctccgtccccgtctgtttcaggctggtggatgctggatttgctttcgcacatttatatggaaatacatctttgctgtggcttgtaattttctagttgaataacttcagggtaggcctactttagaatttaattatccttacgctgggagagctttgctgaggttcagtgctcagaagagtgcacgattctaaacattgcgtgacactcaccatagggcaccgttggctgcagtacatcactgttttgagggttgtatgatagtgttcttatgtcctgctgacccaggagtcaagatggactggtctcaaatgaaattctgccctaccactaatcacgcagcagggaggtttctcatctactggatacttaaccaagaggttttgaagccagactgattttggcaaccctaatgcattggctccacagtgcttttttaatgacagtccaagctaaatatgaaagatccaactgcagattcattgtgcactaaaggcttgaatctctaagtagtggtgacatagtcctgtagggaaattgtgaattgaagcttctcagaattaggcttctcaaagccgaggcccaatgtaggaagataatatgtggctgtctagagtgtggtgctgaaaaagggtcagagggcttctgtgttcctcagaaaagggaactgggattgattagtaatatctgctttgagttcaggagcagggacagtggcccaaatgccatgtgtttgtaattagccatttccaagatacctcccaacttctgggctctgtgcagagagtggtggggcggggagggggctttctccaatgttctctccattcaccctcactgcaaagtgttgatgctatttccatgggaagatgttcatggaaagatgttaaggaatcaaaagcaggatttaaaagaaacatacaatgtataaataattacgaacaaattttaatatatttggaaaagaacctggaaggaaatatatcataatgttcataattgttatcactgggtgataagattgtggatggattttgctttttccttcatgctcatctatatttttctatttttgtgcaatgacccatattcctttttaagcatacataaattatatgtgtgagttggtgtgtgcattcttcaatattacatatgtgcagatttggtggcatgcttttttcactttataaattcatcaggaacattaattactcctcctcaatgtaattttttagttactacttaaggtaattctaagccttttgcttcatctgggctgaaaggtctggacagcaacctcatcatcatctcctcatatttttttttaaagtatcaacttttatttagattcagaggatacacgtgcaggtttgttacacgggtttattgcatgatgctgagtttggggtatgactgatcccatcacccaggtattgagcatagtgcccaataggtagtttttcagtccttgcccccctccctcccttccccctctagtaattcccagtgtctgtttttcccagctttatgtccatgtgtactcaatgcttagctcccacttgtgagaacatgcaaaaccccaccatgtttggttttctgttcctgcattaatttgtttaggataaattaatttgtttagtaatctccagctgcatctgtgttaactgtaaaggatatgattttgttcctttttatggctgcatagtattccattgcatatatgtaccaccttttctttatccgatccactgttgatgggcacctaggttgattccatgtctttgctatcatgaatattgctgtgatgaacatacgagtggaggtgtctttttggtagaatgatgtattttcctttgggtatatacccagtaatgggattgctgagttgagtggcagttctgtttgcagttctttgagaaatctccaaactgcttttcacagtggcttaactacctcagtttctaatactagacacacattaactttcttccaaaaggacgagcaaaagataaaaactcaacagaaatctgaaagactctgcagcccaaaggaggggggtatcctgaggaggaggcctacataagactcatagaagagagtcttacatcatagaagacagtgttacatcataaaagacagtcttacatcagagaagagagtcttacatcatagaagatagtcttacatcatagaagaaagttccacatcgtggaagatagtttgacatcatggaagacagtttgacatcatagaagacagcctgacatcacagaagatagccttacatcacagaagacggtctgacatcacagaagacagccttacatcacagaagacagccttacatcacagaagacagtcttacatcatagaagacagccttacatcatagaagacagtctgatgtcatagaagacagccttacatcatataagacatccttacatcatagaagacagtttcacatcatagaagacagtttggcatcataatagaggatagtcttacttcatagaagacagtttttttttttctcctgcctcagcctccttagtagctgggattacaggagcatgccaccatgcccagctaatttatgtatttttagtagagaaagggttgcaccatgttggccaggctggtctggagctcctgaccttaagcaattctctcgcctcagcctcctaagtagctgggagtatagacacaagccaccacgcccagctaatttttgtatttttggtagagatggggtttcgccatgttggccagcctggtctcgaactactggcctcaagtgatctgcccacctcggcctcctggagggctgggattacaggcataacccatcaaacctggccagaagacagccttatatcacagaagacagccggacttcatagaagatagtctaacatcatagacgatagtcttaagtcagaagatagtcttacatcatagaagacagtcttacttcaagatatttagaaaatttccagtaacttccaacacacttcaagaagacttggccaggcgcagtggctcacgcctgtaatcccagcactttgggaggccaaggcaggtgggtcacctgaggtcaggaggttgagaccagcctggccaacatggtgaaaccccgtctgtactaaaaatacaaaaattagctgggcgtggtggcaggcacctgtaatcccagctacttaggaggctgaggcaggacaatcacttcaacccgggaggcggaggttgcagtgagccgagattgcaccatcacactccagcctgggggacaagagcaagacttcgtctcaaaaaaaatgaagaagacttggcatctataaaataagacccacttatgcagaggggaagaaactgacatctgaaaagattccgtgggatctagagcttctctaattatggggaaggagattgtgaatagagagcccttagcccggtgcctggcccataggctctcaaaatatgttactgttatcattcttaaaataagttatattcacacacaacctatttttctaatgttttcccttattaggatttatgccaattggggatttttaacctgcagttttagcaattctgccaagccaggcccttccctgcctctccctagactcatgcaagttacagagtgagacccgaatgtggcctgggagctgctgagccagccaagggccagggcggctgccattctgccacgtgcctggtcgactccgattgctttatttctctggtggagccactgtggttcgcatgttggagctgggaagggttccatctggctcacagccaaggaggaatggagaattccttcagacttaggtaggctgacaatcaacatcattgctcccaagaaaaaatattttgagtcatgacccctgggtgggattggaacccttcagtttctgcccagatgtgcctgcttcatgggaaccagatgtgttaaaaagcaaaacacgggccagaaaacctgccatgtgtgtaaagaggctgtctggagcagtcttcccaagggcccgcatagctttgcatgttctccagtggcttgactgaggaaaccctaacatgcacacgcaggagaggcagcctagagaagtgaactggtacctaccggcagcttttcatcttcaaagcacttctgcaaggcagggattttttttttttcttttgagacagagtctcgctctgtcactaggctggagtgcaatggcgcgatctcgtctcatcgcaacctccgcctcccgggttcaagtgattctcctgcctcagcctcctgagcagctgggactacaggcgtgtgccacaacacccagctaatttttgtatttttagtagagaacggggtttcaccatgttagccaggatggtctcgatttcttgacctcatgatctgacctccttggcctcccaaagtgctagaattacaagcgggagccactgcgacctgccaaggcagggattattattcctgttttccaactgaggcacttgaggctgtgagtgactttctcaaataacaaggcagggttcatcacacagcaatccctttgccattactccagcctttctcgaacccctgtccctcagatcttagagatgcatgtgtggaccacagcaatggacttttggctgtagtcttggtctgggcaagaaaaaaacgtggatgggttgatataacacaagtatctgaaagccagattgatagatgtaaatttctagagagaaggacctagacatatagatttgaacttagtgagtggcctctgggggccgggatgctgcatgtttgttcgtttgttttttgagacagagtctcgctctgtcgcccaggctggagtgcagtggtgccatcttggttcactgcaacctctgcctactgggttcaagcaattctcctttctcagcctcccgaatagctgagactacaagcactcatcaccatgcccggctgttttgtattttagtagagacggggtttcaccatgttggtcaggttggtctcgaactcctgacctcaggtgatccccctacctcggcctcccaaagtgctgggattacaggtttaagtcactactcccaacagatgctgcatgttaaaggactcatgctcctcttgccttgagggcagaacaaacacaaatggagccgatgcagttcaaggaatttccataaaaggcaaggaaggaactccgggcctcaagagtttaaaactgagataaacagcccatgttaatatttgagtgtcctgtttcacagttttgggaggaggctggagatgatataattatggagttcagtccacagcatgacatatgtaaagcacttagctcaataagcattccttccctttcggggtaggggtcggggtagggggatcttagagatgcacagatactcccaatataaacaaaacataatcaactgcaaccatgtagaatcatcaggacatgaaatgtgagctgaactgtggttagcctggaggctgcagatgcttctcagagagctttgaagcaggatggctcaaagacaaacaagaagtgagaaagaaaggagggagagaggaggcggggtggccctctagtgcctgggacagagaggtgtgcgggaggagctttcaggctcctttaggactctgatctttcaatgatctgaagaaagctcatactgaaaggtaaagctcctcacacagggaatttgggagtcaggctctgcagttttcttctatttctgggagcacttatttcagcagggcatttgcaccaaaggaagaggaagcctcctcagacgctgggccggccataccctaactaagcatgcactttgggcaggcacagcacaacctcagctgcagtctcagtggtacgggtggcatggaagactgggtgacatggaggactgggcctcaccgcactggggccggctaccccctggggttgccatcagagcaagttcacacaccagcccacgggggaactcgtgggatctgtcagtgtgagcggaagaaggatcaggctcctagactagggtcccccaggaagtgggcaggctggctggacttcagtaggagaactgagctagaaatccaggcattctggtgtgggggaggcaagaggctgcggggcaggctggagtcaggctgtgctaacgggaaaatagggagtcagggaaattgtttcccatgcgacttccgtaagggcagtggaccgggtctcattcaactcaggattctgaagtggcttcacaaaatacgcttagtgttccttacggacgaaggaaggaagaaaggaaggactaacagtgcctttatttcaggattgtccaatctatccccctccctccatctcatctcctgctgccatgaggtcacagtgggagtaaatcgtccacgacaggcaatgtagtgtactggttaagaaaggtcttcaaatcagatctctctccctccaagcttggcatgtgtgcatttttagctaaattcttaacagctccatgcccaattcctaatctgtcaaatggcttagaatgttacgtaatgctgagatcacacctggggagacgacaatgttagctcatgtgggttgagtgctccgatgcacgctgggctcgtgtttcactcattaccaatgtaatcatcacggagcctctgggaggtgtgtgctaccattagtacccacttcacagatgaggaaactgagacatagagtgattgagtcacttgtcacctaggcctgcagccagtcaggggcagatccaggattcaagtccaaagaatcagattccagggccccagcccacaggatactgctttttaatcagcgagcacacttactactaatcagggtgattgtcactttacccaccttggcgtaaccaagggcttctgatttgtagtgttttatgataataaaaaaatacatagcttggaggtgggtggcagcatttgtgctaaaatatgctggatgcaaagttgttctgggtctgagttgtgcccattctgaaaggagtattagatcaaagaatgcttacctgtgctgtgactttgttttattatggttataattttgttttcttcttggaaaatgcctctattaaaggtctgcctctttctttcttttctttctttctttccttctttcctttcctttctttcctttctttctttctttttgagacagggtcttgctctgccacccagagtggagtggagtgcagtggcgtgatcatgactcactgtagcctccacctcccgggctcaagtgatcctcccacctcagccttccaagtagctgcaccaccacaccctgctaatttttaaaatgtttttgtagagatggggtctcaccatgttgcccaggctggtctcaaactcctggcctcaagcagtcttcccctactttggcctcccaaaatgctgggattataggcgtgagccatctcacccgccccaaaatatgccttttaaaaataagctaagattgggttgggtgtcagggatgatgagtctaattcccattgtgttcccaaatctcaaattttccttccagccgtagatgggtcccgggccttttcacatcctagcccagggctcctgaagctgagcccacaggggatgatccacagcagctcctcccaccatggctgggctttgctcacactcatacccagctcctcctggccaccacatgcctcagggccttgtgtcccttggcattccaccccctcctgccccacctttaatgccctttgcacatccccccaccccttttgagcccaagagagttcccacctctccagtggagcgtttggataaccaggttcagctgcaagcacaagaagcctctctagccaggcaaagcaaagggatttaacctggggcattgagtgctttcaaaactactgggcactgcgggagtggtctgtaggcctccgggaatgcttcatgactgttccagcccacagttgtctctcctatctctgatgcatttcattcattcattcattcagtgttcatggagcagaggcagtgccggctgctagggacaggacaccaggatgaatgaataaaacatgatctcttctcaaagaacacagggcctacacgccctgatgatgaactctggataagagccatgaacagagtaatgcagggccccaggagggtgcgcctacctcagtgttggggaagcgtggaaggactgcggagtgcgcagagggcaagagcaggcctctgcccaatcatggggtcatagacagagggggtgtggaggaaccacacgtctttccctgtggttgcagtacagggtagggtaggggtgccgggacaggtgaccagagagaggataagctggtcagggtgaggggcttttggggcatgacctgaccattacgtggtgttgtcttattatttaattacagtggtcaagaaggcagacttaccagccagcctggctgagttaaaattctgctgggctcaaaacctactagttgtgtgacctcaggcaagctatccaacctgcggacctcacttttctcatcagtaaaatggggtaataacagtacccacatcatgggggtgctgtgagggttaaatgagttgatatgtaataacacacttagacctgtatctggccaaggtgtcagctgtcagccctggatgttatttaatgcctaactctgtaccaggcagcatgctggtgattttccataaattctctcaatcagtcctctcaaaggccctccctgggaggcaggcgttattgatctgttttattatacaaaggagaagtctatttctagtttcctctgagattttagctccttcactggctctgttctatttctgtctcccgtgcactgtcgctgcaggagccctgccagagacagagaggaaccaaagccccctggaactccaagaggaaggacaagttagatctgggcttccacagagccatcatgctctcctgccttagttactggaaagggatccaacgcactctcacaagcccacacgcagcccggacggcagacgtgccggtcaaatttgttaaagtcataaaatttggcaggacggagtttggtagaagtggaggatgaagtgagggatccagtcgaatgagtgggatgctctggaataagcaagaaccaagagcaggcactgcctggagcggcaggcgatgctcccacccctccagcgaggacaccctcaggggtgtgggactagtgtccccgaggctcccctcacccaggactggtggcatccccacctgcctagtggtaggaacaaacactgtatccctctgaccatacatttcctctaacaaaatattcattttcctaagaaaatgaacggaacgttccttcagctgggcattccgttcttcctttaagggagcctggcattgcttcgacaagggcaggcaggaaggaggctagcgttttcccctctgccagccgttccacgtgctctaggggactgtccgtttaattctcttggcagcctcctagggaggcactgtcatctccactctgtggatgagcagtcagggggccagcaagtccagccaagtccagagtctggccagaacaggccggccccttcagtggaggtgaacccctttcatctcagctctggtctctgcctttcaaggcagcagtggctgctggtgtattgcaggcgtcttgcccagggggctggcagtgaccatgagaatgtgagttgtccctggccctgaatcctcctcctcatgcaggaggcgggtgaggcagagaggatggtcatgaaggcagaagcctcgatcctgagccgcagggcctcagtgcacttgcacacacattgtctcattttacctccaaaccccggggaggaggctgcagtgttcctgtgtctcaggtggagaaactgaggcccacagaggtctaggaagcagcttgtgggagggccagagctttaccccacacctccacatggcaagtggctcacccggcaagtggcttacctgcgccatcggagcaaatggcttcctagtggacagcgatggggggctttcattagcccaggcaagacccctgccccatccgcatttccttatttacctcgcgacattgctctctgaggtcggtggtgttaggattatccccacttcacgggtgagcgaactgaggcccagagaggttaggtcacctgattaataaacaaaggcataaaaggggcattcgtttttcgatggagaggataaagcagcctggtttgtacattctgagaggctctgcggcttgttcatctcgagggctgtgtgtgctttattgggagctgtcccacctcctggggctggatgccaggcaggccatctgcttctggggctgggcgcccctcccacagtcattgccttctccctgaacgactggctcccaactggctgcagccgttaaagaagttccaggaaaaagatcttagccagcctcctctgcaacctaatttctgctgctgtgggtattgccttgtctgcataaatggctctgctaattttctgctgctgcctgttgttgaggttgcagaacggcaggggaagaagggcaggaaccaaccactttccttggcacctgctcagggccctgtcggccccttgatgaacgtggtctcttgtctcccactccattagcagcagccctgcaatcctcacaaagctgaagtcagatcaggtcgctgcccagctgggtaccatcctctgcacagaggagaaccccagtgccccactgctgcccctggggctgtggacccagccttccatgtacctctcaccttcctcctccacatggcgctctggactcggggccttccttctgcgcctggagtaggcacacctgtgtgtccccagcaggactcctgcaccaggacagctcccagccactcagacactcaggggccttccctggctattccctggagtctaggtcgggctcccctagtctaggttgggctcccttatctgtcgaccccctcatggtgctcacagtgctcctcacagtacacactcacaggcgtgttctctgctgagtggctgcaagctgtgtgtgggcagggacaacgttgtttgttcatctcagtgtcctgggggcctggcacgtaataagctcacattcacatttgcagactcggctgaagaaaagtaggacccactgttgttgccatcccattctttctacttcaatgccaaggagacaggccaagggccatcaggcgacttgcgcagggtcctgcgtggtcacactgggaatccaaccaggttgttctggctgaactttgctctctgttcacagcctcccagcaactgggatgtgcatttcctccacatctgggtttctcagtgctcagtcatgtatatatttggagcagaaatagaagcacaatgttttgtgaaaccctgaaggggaagcttccacacagtgcccagcatccagtggtgaatgtgaccttccatcaggaagcctggagctggggtctgtccctttacccagagagacaaatgcagacacacatagcttgggacatggccagctgtattcgtggcaacagggcaggaagctgggaagggccggccagaccaggccgggaagaggtctgaagagaggagggagcggcaacagtggctccacctgcagcaggtgtgtggggaaggaggggggaaggtctcacaggaggaggggtgtgctcacagggggtgaggtgaagcacctggaaaccctggtgccagtaagcacagcacaggcgggcttccaggaggctccaccctgggcactgcagtgggcagaggaaccctaggaccacccccacccccagttgttaaacatttaacagcacactatcgcctggcacatctgggcaccagaaaggaggcctcggagctcgggagcagggcagagggggagaggtgtttcagaggcagacaacctttgttctgttgcaatgcgaagtttctggaaggcttaaagcagaagggtaacatgatttgatttcgctttgctggacagatttaccaaacaccctaaggtcctgggaacatgtaaatgtggcagccagggggaaggggagattgagttatctgaatcggggtccaggcaggatctgaatccagacactaaggagaaacccacttaccacaatagaagctgaagatcagaatgagtccaggtgtccaaaggtgggctctcagggtgctgaccgggcctgggggtggaagtgtggggctgtggaaggctaagcctacaggtgctgccaacgggctcttcctgtgcagagagaagggtggcagtgacccccaccgcctgcagtgggacggctatatctgtcagcctctatggctagaactcgtggtctacccagcataccccccagggagattggtggccctaaggttgctctaagtttctacgatggctgcattctcaccacacttaagttccacttagcctctgagcagcaccatggcccaagctcaacattgtgatgagaacaggtgcttctccaccttggctgtacatcggagccactggggagcttttctaacctcagaccaattaaacccagaggtcccctgggagtgggacccaggcatcagcctttttgaaagctccccaggtgactccaatgtgtggccaaagttgagaacctctggattagaaggaattgctgtagagtaagagaccacttgtttttccacatattgacttggtgctggattctcttgacaggcaattccaggcatgatggcaatgccttgtgccatttctttggttgttaaatggaaccccgaagtccttttctgctgggtggcccctggctgcgatgagaggctggagagttgcatgatccagctcaacgacctgtctgtctgcattaacagtagcctgaattatgacagtagtggctgtgctcccaaagggggttaaagtacttgagctatcccttctggaagcacagccccttttgaagacagaagatgctgactaattagcagttccagccgtgctcctcagtagccaagggaaatgcaggaaagaaatcccatcagccaatcccagaaatatcaggtgggcaggtgtcatttacacaagtacacatctgattgagtggaggtggctgggcattccatggagcagtgaagagggtgtgaaaattcctctggcttctttaggaaaaaggcaggaaaaggaaaaggacagatggcaaaggtgatttgaaaaatggggctaaatgaaagcaccataaaacaaactggtgccattctggccttacacagcctggctgaaaagagtcgtaggaagaacacagctgttgaatgaggtgtctatgtcctcagctgggcccctgttcatgttgctcggctgggatacagctctggggtccagtcctcagaaggttgtgggctgatgtcaaggtgggggcatcaggaagcaggcaggcaactagagaaccagagtgacggtcagcaggggtgtgcagaggggccagagcccagcagaaaggcccgggaggggttgccagatcaggcactgggagcctccgccgaggcagcgtctgtcctgactccatggcttgtgttctgagccctatagcagcttcctggagaccagacagccagcggcaacatactctgaatggtgttttgccaacttgccatgtggctcggacaacttactttacttctttttttttttttttttttttttttgagacagagtcccactctgtcacccaagctggagtgcagtggcacaatcttggctcaactgcaatctcagtctcccaaatagctgggattacaggtgtgtgccaccatgcctggttaatttttgtactttttatagtgacggagtttcaccatgttggccaagctggtctcaagtgatctgcccgccttggcctccgaaagtgctgggattataggtgtgagccaccttgcctggcccaactcacttaacttctatgcatttcactctcatctgtaaagaagataaatcatctgatgactggagagttagaaatcttgcatgtggagttgcagaggaacgggtgcatagtaaatgctcaggaaggtggcagcttgttctcctcctcctctttcccctcatcaccatcagcagcagtagaagttggtgggtatcgctcatggcatttactccgtgcctgaaggagactctagctctccgtaggtcttctgctaagaatataggtcttgaaaattggatagtttggaatctaaatgctgccacattcgcccccgagggaggaagcaggccctggtggaggacctgcctgccccgcgccagcactctgcctgggccattggcatcgattagctcccatgagcctcacaagcacccacagggcgatgctcttcttaccatgttacaggcgaagaaatgaaccttcatgggactggagctctgcctgagagctcacaggaagagcagggatttgggctccattctgcgtgactctgaagccccgcattttaacagcaaactcctcttatttgacaatgcctggagcccatggtgtggctcctggtgttgctgaggttttgtaagctctggtactgctgcagcacagtggcagccatctgggcgtttcttttcttttctatttttttggagacagagtctcgctctgtcacccaggctggagtacagtggcgccatctcagctcactgtcatctctgcctcctgggttcaagcaattctcctgcctcagcctgccgagtagctgggatgacaggcgcatgccaccactcccggctaatttttttgtatttcagtagaggtggggtttcactatgttggtcaggctggtctcaaactcctgagctcaggcaatccgcccgccccggcctcccaaagtgctggaattgtaggcatgagccaccgcgcccagccccgtgtgggctttcctaaccaggctcccttcttgtctctgcagggccctcatctttgtgtcccatggagccggagagcacagtggccgctatgaagagctggctcggatgctgatggggctggacctgctggtgttcgcccacgaccatggtgagtgtcccagggtgccgtcagagctggctgggccctgacaatttggagatctccctctctagtccatctcactgccagcatccttctcaattcttctattccccacggatgtttcaaagtaaaaaaatgtagttatgcaaacaaacaaaaaaaatgtctgacgagcagattctgtagtctgagactgaatgcaggctgattagaaacctcaactggaaaaacaaagtcggatatgttcatctcagaacttgcctgaggctaaggaattctttcctgcatttataaagtgctttctctcaaaatgggccctggtttttctccaagtgccctcaaatgggcattgtgtagtcagttcaagtacagtgtaaaccctggtttaaccacacgaggtttaccaagcatttcagaccaggagaatagtagaagcctcaacaggccatattgttcacaagaaaacccaacacacacacaaatacaaggacacacagctacccatgcatatagtcatacacacatttgcacacatacacatatacatacacatgcacacacatacacacctgtacctatacacatacacgtaaaacacacatacacacatacatacacatgtgcacctacacatttacacacatatacacacattcacacatacatatagacatatacatgcatacataaacataccatccatacacaatcacacacacacaaccccaggccaggtctttgattctttgttctgtagcaaaatccacaaccatcaaaatccaatgttcattgtctgagtcggtatgtagttttgtaatcatgtttgcaacattctctatggctaggaagtctcccaatttagttctttgcctaacactttttaaaattaagacttctctgtgactgaacacggtgatttccccacagcttcaatgtaaaattctatcattgtggcccagatccagaaatgttgcttccattttatctgatttgaaaatggataataattaagtgatgtctctgaaaagagggacaggggagcaatgacagaggcctggaagtccttgtaaatgcgggaaagccttatctgtacggagaagctgcacaggaggtgaaaagcttgctgggacattctgtaggtaaagagctgcaaatgtgatttgccaggggctcttattcagctggatatacacaagcgtcctcataactgacagtattgactaattctttcttatcatagttgtgacgttctttagtgctttgcgaactgtcccagtaatatttgtgagactgtttgagaaataatatttgaggatcatctccgaggcttttagtatggggactgtgtcattattaactttggcacttcttacatgtaaaagcctcagataggaatttttttttcctattgcatttgcatcctttaaaatttgttacactcatcatcgttatgttctagagacattgtgaaggaaaaggatatttgtactatgcagctagagtcccaagaatctattttgtatcttagcaccaaccaccttcttatcggataaaacttggccaaatctgtgggattaagtaaatgttgttccttgtttattttgtctggctgtggcactttgagaaacaattttaaaagcctccttttttagaataaagggagaaaagaaacagcccaccttttgatgtttccagaataacatctagagttgaggcagagctctctgtgacattctaaatatagtgcgaaaatggctgttggtgttcacctgtttcaagctctttgaatgactcatggaaatctctctggcaagtgcctaagggaagtgtttaattcaggaaatgaacccagttgactgtgcgtgtgtgacttttgctgtggcttgcttagtagaaggaagccaagtaagtgggctgccattttggggatcttgtgcaggctggcgatgcaggtactggtggctagtgatcttggctgtatttccttcttgctgagaaatgtgctagtaagtgaagaaggaaggatttgaacccaggtcaaaccttctttagaaggttggggagggaaaggagtgaatggatgctaaatctgacgctaactgattttactagcttggatctcgttgctcaatgcattatagtatttcgctgttcagcattttaacagcaaatcctcttatttaataaggcctggagcccacagtgtggctcctgatgcattgctgaggttatgtaaggtcctgcgccgctgcattacagccacaactgtctagacttttctaagaaaaaaaaaaaggctggttctaaagcctggccttttttattactgtacaccaatgtttccaggcacaaatgcctacagagatatatgcagactgcattctttccaacatagcttttattttatttttttactttttatttttttgaaatggagtcttgctctgtcgcccaggctggagtgcagtggcgtgatctcaactcactgcaacctctgcctcccgggttcaagcgattatcctgtcttagcctcctgagtagctgggactacaggcgcctgccactatgcccggctaatttttgtatttttggtagagacaggggtttcaccatattggccaggctggtctcgaactcctgacctcaggtgatccactctcctcggcctcccaaagtattggggttacaggcgtgagccactgcacccagtccaacatagcttttaaatttaaataaagcaggcaaggtgcaatggctcacacctgtagtcccagcactttgggaggctgaggtgggaggatcgcttgaggccaggagtttgagaccagcccaggcaacatagtgagatcctgtctctacaaaataattttttttaattagctgggccccatggtatatacctatagtgccagctacttaggaggctgaagtgggaagatcacttgagcctgagagttcaaggctgcagtaagccatgatcacaccattgtacccagcctagaggaaagagcaagatcctgtctcaaaaagaaaaaaaattaaataaaacaaatattaggagaatgtcaggacatttattgtgcccattggaggtacactgaaaactaaaaacggagctgaaaacactgctgcagggcccatggcacctccaaggctccaacatccaaacctcccatgtctttagccatgttgtcatctgcactccagggtgtcgctggaagcatgctactgcactttcatcccagacagcagaagggctcagacactaatacacccagtccagggtccactcaacagggagtccaagccgtgtgatctgcaccttgtttaactatccccagtcttaattttctcatctacaatgtagactggctgctgtgctgtgtacccaggtgggcgtgaccccagggctctgagcaagaccagcaggactgaggctgggagttagggggttcttgtccccgtgtggttgccctgagcgggctgggtcacccctcaggcctgcacaggccgttctgaagatacagtgaagcaatagataggaaaatgctttacaaagtagacagagctgcctatggtggtttcactgcccggtttctatgacacgatttatggaaacactggcttctgtaaatctgatgctaactgattttactaccatgggtctcattgctcaatgcattacagtatttcactgttcagacagaaacctctaggcgccgcggttgtggcagtctggctgtgtctccagcatgcctggtaaattggtgggctcagagtcatgttcaataagcatctaatttaactttgttctccatgttaacctcagaatttgtacaaaatgaactcatgggtttgaatggcttgccagcagtgaaaattgtgattcctgccatttattcagtgtcaactgcatgccaggctctctactgggcacttttctcatatgatctctaatttctcacaacaattaatcttattttccccattttataagtgaggaacgtgtggctgtatattcaagcagatccattctcattgcgcatgtgttagcaaagggaagttttgtcttcttccagggcacgtgatgtctgaggcaggtgcaaggactccatggcaccatcagtgcccagggttccatctgtagtttgctcagctggtactacttagcatgtggctttcatctgtgtgggcactacctccagcctcatgttctaacaggtagaggaagcaggaagtgacagagaaaaagggctgggctcctatcaggaaggcaaagcttacttagaaatcctggcaggctctagccccactgcattgaccagtgctgttcacagggctctgcctagctgcaagggaggcaggaactgtaatttttaactactgacccaaacaacagaaacttctgttggtaaggtagacacagagaatggacattgctgatggctatccatctctgccatgccacactcccaggtttattattaaattagcatttccccgattgtttctactttatgtattttctgggcatttcagctcactcacaggatttcctttcatctcacccatccttgtgttctttctgaaggttttgatgtgaaggctattagtattggcatcattaataagcattggttgaagttcctaattgggtgtttgttctgggtgaggtgtgaagcaaggagaaatgcatggacacagtaactgttgtcctaatgagaacatgacccgtcttccccagagaaagcaagcagcccctctctaagggcatagctttttatagcatgtattatcctgcgtgggaactattcctttaggccaaggcagccactgcaggcaggcaaagacagtgtcttacattgtgttgtccattcgctcctctccctcccccaagacccttctcatcatctttgcatagcatagtccattcctggactgagcaggaagtggaggcatcaacagtgtttgctgaatgactggaagagtttataagccaaaatagatcagaccagaaatgctttaaatattaagggtagaacatccacattaaggtatccacgtaagcagggcactgccgggtcccctcaatgagcagagggtccagcagtgtggccactggacctgagtctggtgaccaagcaggtggagagcccgtaagtgccatggatgcgctgctgggacagaggcgccacaaggcccgcagctcaggaaggggtgtggcacctccaggctcagggcatcctcaatgcctggagggccagaagggtggctggcaggatggccgggtcttgtcggagagtgggagcttgtcagcaggaggaagggctccgatcgttgagagccatggttctcaccttgcctactgtcaggattactggggagtcaaaaaatcctgaagcctgggctccccctcccccacccctcagagatcctgatttattggtctttggtgtcacctgggcatcaggattttaaaagatacacgaggtgattcttatatgcagcccaggttgagaactaccactgagcagaggaggccacacaggcacaaagtttggagctggtgaagacaggatttattaggaaaggctctggggcctggaaggatggaaggccaccaggagactttggagatcctcaggagaggggcctcagagtagagcccatgagggagaggtgcacgggcagccagaaacggaggggctgctgccatgtgtgaacaggtggggacaccagaagatgggattttccgcaacattctaaatatagcagggagaaaaccggggctggcgttctcttggtccctggtctgccagctgctgcagtgactcactggaaaccccttggccttccatgcaggcagaagggccagtctcacccagagggggcaaggaggactccgggaggagggcacacatggacccacccaggaggcgctgctgcgagagacggtgggaatctgaggcccatttgcccgcaggcctgctccctgcagtcctgctggaaagggcccttccccagggagcagcctcctgacttcctaacacgcactctcggctccaggagcacttgctggggccagagaagcctcctctgtatttacaaagtataaacgaaccatcctcaactgatgaacagtgaattaattatctgcaaatatttgagggaaagtgttaaagagggctttgtgtgtgtgtttttttttaactcagctggggcatgtgagaagaggaagttttgagggaatgtctgtgggcggcagttacgcgtggttctccttggcgggtgggtcctatccagtcagaagaagagtatttaggaaattcagggggaataattgtatatgggtgtttttcatccagggagacagatttgagtcaaggtcgcttgctggaagtattctaaaataaactgccataggtttattttatttcttgtaagtaatatatttttgtttgaaacgtttgaaaaatgtgttaaccgtttttcttgccttagtaaatatgagaattaaaataatggagtgagttgccctttaagtcttcaagagttccttgggggcccaactccgagggtgggtgacagtgaacttgctgcaacttgtagagtgtgggagagtggactgtgccaccctgagacccccatagtctctgctattccccaactcattcccttcgtccccttgcctcctcctcttccttcttcattcactattaagcatagtgaatgctctacctttgatgaaagcctgttgagtttatttgatgtaagtctcggatatgagtttgtgtgccctctctgatatgaggtcatttgcctctgttgaacaaaacaaaaacctccatgtggctcagttgctcgtttgtaaaatgaggaccatgataataacaaggttgctctgtggccgtggagatgaaatgagatagcgcagggtctgaaactccagtggcagcagcatcccctgttgaaagccagatggctgggcccaccccaggattcagattcagttggtctgctgtggggcccaagaatgtgcatttctaacagcccctgggggtgctgctgctgctgctgctgctgctgaggacccctgagagagtgtgtgtaacaaaccatacacaacgccaggcatctattagacacgaagtacctgccagctcacctgcaaagaaaggtgcagggagactttgcagctattgaaagttctgtcccagacttcaaaggatgcttcctcaaggagatgaaattgaacagggaaatatggagaaagagcattcaggtgaaggaactcttcttccttcattctttgatattcactgaatgcccaactgcactcctaactgttctaggcacagaggtccagcagtgagccaggcagacatgagtgaataaggagaggtgttatgtcctgccaagtgcaggggaggcaagaggcaggaggctgccagggagaggggctccctctgcccaacagtttgggaagcctttcaagaggctgtggcagtcatttggacccattcttgcaaaggtctgggtggcagagggagtctagagctgggaacagtcagtgcaaaggcccgggggcaggggctagcagggtgctctcaggtcgccagcaagccaggatggtcagagcttagacagaacagcaggtgagcagtgatgggcaggggccttgtgggcccaaggaggaggaacagaggctgctctgggatgttggaagccactggagggagggctgtgagcaggggagcagtatactgtgatgtgtgtgatttctgaacgacctgaggctgctgtgcgaagacagattgcagggcgaagtcagggagtgtggggaggactttgggccgccaggctgggagggacttgctgtgtgctgtgtggcagtgtcaaccagacctctctgagccttgaacttgggtggcgaccctaggaataaagaggcctgagcagagtggagagacacagagataaaagcaacaagatttggcagagaggtgagagacagggaaggcccaacagtggcgagcctgagtctccttgtaacgacatctccctctagaaatggaaggctgagtctagtctgcatcatactgaactcaaggcctcgtgcatgtctcagggtccctcccccaagtccacatgttgtgggtgcaacttaaggcagcaagatgagagcaggtgcactctttaacaagtccccgtcatgctgtcccagtccagagccagcccggcacagcctgtgtccaccctacctgcctaggcctctcctgtcttgtggtgacccccagggcctgtcctaagaagacacaagtactgagcacccagcatgtgctcaacactgtgtttacatgttcataccttatctgacttgtcctcacagcgctgccaggaggtgagactgttgtctccctcttactgacgaggaagctgaggcacagacaggttaagccgcctgcccaaggtggcatggctgctacgtggcagagcctagactcaagcccaagctgtctggctctagagttcaaggggtctagaatttgaccccttcgggggaccctggcctctaagcagcagcccacagcattcttgggcccctcaaaaataataacattcacaagcacagaacctcacagtttataaggggcttcctcaaacatctcattccatctcagtaaccctgggaggaaaccagcccaggctggagcccagctgttgccttcagatctgccgagagtgcctcagtgcgtccaggctgctgtaacagaacactctagactgggtggctgataaacagcagggatctattcctcacagttctggaggctgggaagtccaaggtcaaggtgctgacagattccgtgtctggtgagagaaccacctcctggttcatagatgatgctttctcactgtgtcctcacatggtgggaagagggctagagagctctgcagcccctttaataaggcctctaaccccattcatgaggcctctgcccccatgacctatcacctcccaaaggccccacctcccaacaccatcacctttggggttgggatttcaacatgaattctgaggggagacaaacattcccaccacagcagagagcagcagttttggatgcatacacagcccccctgcaaatccagcctctccctagttgctggatctgctggagcccatggctttagcctcatgggagtcttggctttcctgcttctaggaggagcagccagaccactccctcaagagcactgtgggaatgctttgcatgcggtagtgtgcaggacggttcacgtgaccttccttccaccagccattggacagatgtgaaacaggctcagctttagagagacagaccttggctctaatttgctgtgtggccttggcaagttacttgacttctccggacttcacactcctcatctgtaaaatgggctaacaataccagcctgtggggtgctgtcagaagtgaactaccaatgcagcgtgctgtctgcacttagaggttgggggagcggggctctggaaccagacagacgaggccttgaattgtggcttcatcctttactacctgtgcggccttggcaagtctgcacaatcccctaagttgaaaaagcagggctggtaaggcttgctggggttatcccagggattcaatgaggtgaagtatgcagagtgcttggtttggggcctggggtttgataaacgcaggttttctttcttcctcccatgacacctcttttgctttttgagggacggtaggaaagtgcgaagctcagatgccctgagagacgttggtgtaagacccaccattgcaccactgttgtgttgagaaacagaacctcatggaggccaggaggagtccttgccaagacagccgggactgttgcaactaggctcaggtcccccacctgtccactccccacatacatgctgcccctggtgttctcaacatacgctatgttaccctgggttaaaattaacgtagggcttctctttataattttcaaatgccccttgagttaactgcagatggtaagtgtggcactaagtcctagaatgatgcagagccagtggtggacatttgtcttcttcctaaggcagatgaaaacgtttaaagctaaatggagaaggccgggcttggtggctcacacctgtaatcccagcaccttgggaggctgagggggaaggactgcttgagcccaggggtttgagaccagcctggacaacatgtcaaaaccctgtctcttaaaaaacacaaaaattagcagtgcttaaaggtgcatgcctatgatctcagctacttgggagactgaggcaggagctacttgggatcgcttgaacccaggaggtcaaggctgcagtgagctgtgatttcaccactgcactccaacctgggcgacagagcgagaccctatcgcaaaaaataaaataaaatgcataactggaggaagacagaaatagtaaagggttgccttgtgatgagcaggaccagagggaggatggtcgctgggtccacgaagctcacggtgagcagagagcagctgcctctgctcctgttggtgcaggagccaggctttcaaggaggcaggattgggagggtaactgcctgaggcaatgagcagttgtggttcctgcttacatgggcttggttagcacaaattgtagggttgagacataggcagatgggggtttaagcaggcttctggggcctaatcagggacaagcagcataaagagaaagaggaaattggtaaatcattcagtcttgtgaccttggacacacatccttgtgaccctgggcaccttgcctgtgaccctagatacctagcctttcctgggctcccagccttatgacctcgacgctcacccttgtgaccttgagtacccagccttataaccttgggtgctcagccttgtgaccttgagctctcagcctgtgacccttggcactcacccttgtgaccctggacacccagccttgtgaccttgggcaagtcactgatcctctgaccttggatcacaggccaagtggttaaagatgtttaaagactccaacagggttttgtggcctggttttgctccgtacagccctgcctcctggagactattccatattcttagatattcactgttcatttacgggactccctctatgcagctgcacctggccctcacgccttagttctttgaccaacccatgccacggcttgggcatgacactctccctcctgccatctcggttctttctgaaaggtgaagagacctggagtggatgagggaagttccaactgccctggggagcctatatcctccaaggggctgtggggagggtcccagaaacctagagggctgagcactgcattctttcccaccttatgcagggccattcagctctttttctgtacaatatttcatttgattaaaggattcacttaaaaaaaatgtttcagggtgaggcattacagtgggattacagtggttcacatctgtaatcccagcactgtgggaggctgaggtgggaggatcgcttgaggccaggagtttgagaccagtctgggcaataggatgtgactctgtctctacaaaaataatacaaaaattagctgggtgcagtggcgtgcacctgtccccgctacttgggaggctgaggtggaaagatcacttgagcccaggagattgaggatttaggaagtttcttccacttctagaattctctgattctaaatgagaaactaggtatgaaagctctttgcgagttacaagggaggatagttatgaagagaggcaccttattgctgttgcagcagagcggcctggggaagggcaggctgatgtcgagatgacaggtggaagaagaaagcagccatggcgcgcgccggtcactgagctgagcactcacaggagccccgctccatcctcaggacagaccccccagcactctgacggggcttcgggggtggggtgttgtggggtggaggcagggaggctgctctgctctccctccactcagcaagtatttattgaaactcactatgtgcctgcactgtctgggcactggggaaatgctgaaccaaacagacatcagcttgcagcctcttggagctcacttgctacttaaatatgttcagtccctcagggctaagccacccgggctggcagctcagggtccagtactccctggacctggagaagacctcagctctgatggcagcctccccctcaccagcctccctgggccttgccatcttcatctgagaagtggggaggatgcactacctccgtcacagggttttagtgtggactatggcactaagtgagggcagcgtctaggtgatgcaggttagttgaacttttgaaatgccagttgtttaaaaattgatttgtaggaagcttatggtcaaagacaatccaattcttttttttttctttttttttgagatagagtcttgctgtgttgcccaggctggagtgcaatggcatgatctcagctcactgcaacctcctcctcctaggttcaagcaattctcctgcctcagcctcctgagtagctgggattacaggtgcacaccaccacgcctggctaattttttatttttagtaaagacggggtttcaccatgttggccaagctggcctcaaactcctggcatcaggtgatctgcccacctcagcctcccaaagtgccgggattacaggcataagccaccgctcctggcctgacaatccaactctttctagcagagttttacccagagactccatatgctgaactgaaaggaaccatctctagatatgagggctgtgagtatggtagtggttctcaaagtgtgattctggtcaaaccagcaacagcaggagcagcagcagcaccacccagggatttgcaggaagtgcacactctccggctccagggtgggaccagcagtcagtgtttagcaagcccttaggcaactctgatggacactatagtctagaatcactgcccaggggtagacacatgagtgatgcgctaggttccctgaaagaggtgagcactggggcttggagagctggaggggtggacaggacagggagcttcagtaggaagaagagaggaaaggatatttctatccaggggagggggaaggaaatgccaaagagagaagggagagtcagagtggaactcttgggaaatactcccttacttagtcatcttggatgtcagagtaaagtaggtcaggcctcgattcttaacattttatttctatgactccagtagtcattacacatccccaaaatgagggctctgatccctaaaccacacaccagctgtacagaagcaactggcacaggaagtggcagtgtggtgtgatggttagacacacgggctttggcatcagctatgggctcaaatcctggttcagtcatttactagctgcagggctttggtctgcagtctgttttttgttatggccttctccagttttggtaccagggatattctggctaataaaatgaattgggaagtgctccttcttagttagttctgaaagaatttgtgtaagatcgttattattttttccttcaatgtttggtagatcagtgaggctatcaaggcctggagtgttctttacgggaaggattttaattataaattcagtttctttaactattaataggactatcccaattttctttttctttttgtgtcagctttagtagtgtttttcaaggagtttgtggatttcatccaagacatcaaatttattggcatacacttgtccataatatcctctgttatccttggacaagttactggaacattactgagctttggtttcctaatctatgaaacgaaggtattgaaatttctacctcataagttgttatgaggattaaacagtcatttaggtggagtgtttatcaaaggttctggcatatagcatgtattcacctgttcattattattactgatggcctcaccacattccagttacctgctgaagacatgtactgaaaagtgtttgaattctattgcttaatagctaaaacctggccacactggatattgtcaaaagcatcattctgagactataagtttacaaattgctgttccgtttctagagttaaacttgcttcaaaatttctttgagaacattttacactcttatggaacagagtgccccagggctctgatagtctctaatttcttaaataatccattcattcactcattcaaaaaagattcatcgagtgcctaccatgtgctttcactgtgggatagaaagaggaatgagacaatgctcctgcccttgagaatctcacaagctaaggtccagccccaaatgtgtttttgaattatttgatccttgccacgagccatgaaatatgggattttatgactgcaattataaacaattggttaattatttacaatctttggaaccaggcaggcaagaatgtcaccctgcccttgccactgactgcttatgtgaccctgggaaatttcctaacctcactgagcctccattgcctcatctaacaggatgggtgcaatagtacaaatattgagagattagataaatccaggctccatgacaggcacccatagatggtgatggtgatagtgatggtaatgagtgatggtgatgatggagaatatgaggaaggtaagccttaaaggataatttcctaactagttttttggggttttttttgtttttttgtttttttttttgatagagtctcactccatcactcgggctggagtgcagtggtgcaatctcggccctacctgcaatctctgcctcccaggttcaaccaattctcctgcctcaacctcctgagtagctgggattacaggggcatgccaacacactcggctaatttttgtattttttgtagagatgtggtttcgccatgttggccaggctggtcttgaactcctgacctcaagtgatacgcccacctcagcctcccagaatgctgggattacagatgtgagccactgtccccggccgtaactagtgttttttaaagaggtaaactaaggcttcatatttgaaagaaaagagctcattacaaatatcttttgtcataaaaatttatgtcatgtggttttgcattgattatggcacaactgacttccagaatcctctataatgaaccaacaaagccactgtcttcggagttctttgatgctgtttttgaggacacagcaccctttataagagtgcccctgcttggctgataaacaggccagaaaggcgcagttgggaggcgaccctgtgcacaactgaggaagtggattggggctcccactcaagagaggggtttggcagattgtaaggagaaaagagccaggggcactacgagtattttctgagtaggatttactttcaataaggtgcgtgtctacatagttaaaattagaaatgtatacaatatttgcaataaacagattcaacagctattatatgagaacctgccgtgtgctgggtcagtgctgggtgtggaatgaggaaatcacacagacctggttactgcctcaggaatccatggagacagacatgcttcaaaagcaaaagtagttggtggggggctattacggggttctggcagaagtgtgcatgggacatatgggagagggagagagggcccagactacctttgggagtgatcatggggaaatatcttcataggacatgacatttgtgacgttggacaagctactaaacctcactttaaactggtgagcctcagtttccccacctgtaactctaagtcatagtatctacctggcgaagattaaatgaatgtcttagctgctagcagagtggctgctgggcacatagtaggtgctcaacaagcccccatactgtcctcttccccaacacacagacccctgctctcctcaccacacattagtcactggctgagaagagaaactttttttttcagttccctgaaattaaatagacagcccccatcttttctatagaaagttgttcatgcttcccatgttagctaatctggagcgatgcggccacatgcggccgttcctgcgggaacactcttcttcatcagccttctgggcttcccttcagtgatgttgggggtacgtgtttctgttcgtttacccactgttgaacttgtttttaaaaatttacaaagtggttgctgtggcaggtacaatgtgaaccctgagctattcacacaggaattgggcacattgttcactcagcttcactgaagtgacaagaacacgtggctcttccgagggccgcagcaagtgtgccatctgaatgctgaatcgcagatctgtgttgggggctttggaagccaaatggacactcctggagacccagcaccatctcttctcattctagtgcccagcggcctgataatttaccacctggttatctttcagaaggaatttaccccaaaggcgtagtcattcattcaaaattattcatacggtctctcagatgaaaatatttaaggtttcctggtgagaagaaaacagacatcactctaggtccccagaagaagccgtttctgaagtgtttaaatgagtcacttgttggaggagaaaaaaagtcaaattacttacacgtgatcctgtgttaaaaagaaagactgaataattctaggaaatgaaattcttctcggcaccagggatgctatttgctgtggttcaggagctgagaaaagatgtagctaattataacatatatgcaggttatatttgggtgtagaacaaataggtggtccttgttgtctgaaaggcctgaatttgagtcagtttaaccacttatttgctatgtgactctgggcaagttactaacctctctgcatctcagttttctcatctacagtaaaggatgagtcaaagtctctaccccatagggtcagtagggggattaaaaaggaaccaaatgagctcctctatgtggggggcctgacccacagagagtactccataaatattggctatgttggggtgactacttttccgccttaggaaaacctgatttgactccagtcacagtttcatgctaactagtgtggcttccaaatttgaaaagtggtgtgatattacctacggcatggagtatttataagaattctcagagagagatgatattcatatttaacattaattaatatttatcatatgcctgattatcgatgcaaagcttttcagacgttgccttgaacctcattacagccttggagtaggtgtggtaattattacagatgaggagagcacgtgagcttcccaaacatgcacctcttctcacccacagcagagcacaactgtggcccgggcctctcctgggggctttccgtccttcttctcttttattctgcaccacaagtatatggccttgatatctgtacgcccattctgcaggcagggagacatagtaaagtcacaaggtgctgagaggccagtgggaccccttccactccaggtctgcagcctcgttctctctggcacgacttcttccccaaatgagacagagttgccctttgtctttaggccattaggcttcctagaaccccaggagtctgtggtgggagcagatgctcacagaggagagtgtgtgcccctcccagggcccatctttatcatgtcagaggtgggttcctgcatctgagaggaaaggggaacacagctgggggtggtattcaggcaacttcagcatcaggcatggggtgccacccagagaggccatgtgatgggcattggggatttgcagcttagacagtggcatgcaagctccgagaagctggaggagcgcctgagagccgggagggaggagggtggaggtggagcctcttgcttccacccatgtcggaacctgggtcttcctttcctgtcttcccagcacgcagctgagactgcacactgaggtgggtgtaatgactacggcgacatcagtaaacttagctgctccttgaggacaagacccatctgcagtttagccttacctccccctcccccacacaggggttcagtctctgggagagtttgaggacgggagggcagtaggaagaggagaaggggcgggaggggaaggaaggaagctcagcgaggcagcacagagggaaggaccacagtggccgagcttagggcacagacagaggtccactccaggccaggtcaggggctggattggcctcagcacaggtccaggtggggctccagggagatgtccccacccaggttgcttgggcagggtccgagatccagatggccgtggctgctgtggcaggccccttggcaagcagaagccacactgtggcatgcttgtgagggtcccccattctactgagtcagagctggccttgagcctgaggggcccgtgctaccacagcaactgggtacagcccagtgttttctgcatccaacctggcttcgcggggccagagggtgagaagaaaacagacatcactctaggtccccagaagaagccgtttcggtctttggcagttgttgctatcatcctcagactggcatcttcaaatccatcttggagatgatgtaccctccggagcctttctttctggcacacctgtcccctggctgctggggcagcctgcacactcaccgcacacctgacatcctatgaatccacatcgctgcaccctgcctaggtaataaggaccttgcatggtggttgttgtttttctatctccaaatactgagtatttccctaaagacattcaaggagggtggatcacacatctttccccaatcagagtgacacactgtgatccagcacacatgaagatcaagggcaaagctggggaggctgccatggggggaaggcagagtctggagtgacactgggttccagtcccagctgcagggcacaaacacagacctggcctgaggcgtccccatcacatctcctgtctgtgaagttgagatggtaataatggtacctaggtgtagagctccaatctgtaaacttaccattgataaattgcttggaacaggccctggcccagagcagcatgcaggaagtgcacctgttactacgtgcatactcataactgaagctgcagtaatgaccagaactgctctcatttgatggtccctgacagagcagtgggctgcaaggaacctgcaacgaagcctctgcccctccctttctcattgtacaagggtaggggacagacttcgaggtcccaccagttggtggcagttttggacccggatctcaggccccagctcccagaaccaggttctgtgcacctctccacccatttcgtaaattaaacttcaaaatcactctggctgcaagtggaccagaagaaaggactcctcaaaggaactttaaaataggtagggtcagggctggcttcgctttgacacagcccttaagaaaggctgggggtgggaatgggcagagtctgtcttgtgagctgagcctttctgaagtgggagctcaaacagcatgtgaccaggaaatggctggcccaccaagaactaaaaataaacggctgtaatgctgccaaccgtcagggcaggcggggaggacgcggagagctcaggagcagagcccagtggggtcctgctcaaaatgaaaagagaaccgcatgccggcagacaaggtgcttcatgtgtcactaacgtggaagcaataaaccacgactgcactgtcaggctgccctttctgaagggcttcatattctctatttcatttcatttcattttccaaggcaggtaaagccatcgtcattttcattttacaggagagacaacaagccaggagtggtagagccaggatcagaattccaaatcacagatctattaagctgtgttctcggtgtcttggtttctcccctgttagaggtaaagggagaaattaaaaagcaaacagaggacccaaaccttgcatgggatcctcagatgcagtcacaactccccggcaagtgcgctgggtgcactacgcatatttagtgcttgtctgggcatttgagaatgaagctctgcctggagtccctccctgaagagctggggtcccaagggcccggccgatgaagcgaggagccgaacgtgccaggagggaggcagcctgcgtggcagtccagctctgcccacggccggctgtgcgccagccctctctgtgcctccgtgtcctcaccagccaaaagaggaaacccacagtacctttgtggtggactggtgtagcccagtcgcttaggggaacacgtggacacacacacagaaggcacttgaaatgcagcttgaagggcagtttgcagtctctggtccaggcagtgcagaagtggcctctttgactgctgtctctgagtgttctgtggcttccaccctggctgtggaggttagtactgcttgctggagaaggaggagccctggggaggcctccaccctggtccctcaaagcttctcatccccaccctaaactaagccagcacccccaacacaacacggtggctctaacaagacacagcagcaggggagaagccagtttgcccagtgggccctggaaagtgacgcagtctggtcatcagcaccccagaaatccctcccaggcggtgggccccttgatagtgcgaagggtccggatggccacagggaattgtacgttatctgaacacagcaactggggcctctgctctccgcatctgtgtggcaccttgctcatagcagctgctcagtgaaggcttgcagaattacaaggcatttcacagaaatgatggtttctttggatacgctcaagttcacacttgtgaatcctgtatgtgtgggtatgaatttggcctggaggatgagccctgtttaaagaaaatcaaataacgcttgcccagctggaaaaatccatgacttctgtgctaataattttttccacggatcaccccatttaatcctacggcagcagagtaaggcaggcaacgtccctatggaggaaacaagctcagagatgctgcctgatttattcaagctcacagtcattagggggcaaagtcggactgaaattcttacacacttgcaccttgctacagttttaacttttgggaaaatgctttggggtgcagagccgcaggttccattggaccagcgccccccaatcagtgctgtgcctctgagcagcttggcgtggggcacagcccccaggcgagtggccctggggtttctgcatcatctgacagaagtgccgcagcggctccaggaatagcttgcgacgcgcagtctgtcaggggtgccgtgccagctcctcacctcgcctcctgccaaggctctgctagaagatgctctgactcccagaggtggcgcctgagcctggatgagggacagagccagcatcggggctgactgcagggggagaacaaggtcctttcaccttcattcctcagcacccacgtgccctgtgtggcatggtgtgagcccagaggggttggtcccctgttgacaagtggagcttagcccagagagttctgttatgtgaacctgctgggtggaggcagagtggcctggcctactctttatacctgtgtgtccaggacagtcacttgacctctctgagcctcagatttcccatctgtatgttaggcctgaggcttcctatggaaacgttagctcataggaccccacacaaactcaatgtcccataaatggatgcttccacccctgtgtggctctgcccttccctcccgtcatctttcctttgcttttctttgaaagctgtgtgcacatccagcgctctccctgctacaccactggcttcctttctccaacgcagaaaaccaagccgtctaagcagggcctgcccgcaaagacagtcaatgtgagaggcaggggccagctgcctcctcctcagagtcgtggagaagtgctggatcattcagaccccataatcataattatttctctcctcagttattgtacagacgccaccagattggaaaaatcacttaaaggttttattcagtggaagctttcttaccaaaaaaggagaatcatctgaaggccaaagggaccgattccaaggaccctgtgttgagtgagggagaaggagctgggctgatctgagcaggtaggagctctgcatcaggccactccttcctcccagtccacacgagaaccaagagtctctgaagtcatcgggatctctgggctcaaagcatctctgtaaagtggcactgcttctgtgaattacattctctcttcccttccttggaaaatgacctctaagcaggggaaggtgcagtgagacatgagaacatgcccacagctgagatttttaaatggccgcaggtgaacacagacatccctcttgagcacgtgattcagaagagaggcacacccacctccagtgagcatctactgtgtaccaggcacggtgctgagagccttggtcacatcaggtgtggtaggggaccaagggaggggtaaggacagtcccgcagaggttggagatgttagccagggtcacgcatagcagagagaagggttgagagccgcctgactctgtgtctcagttgctggggtcacagaataggagagctggtttataataatggacgctgtgagaaatagctgccagggccgggcgcagtggctcacgcctgtaatcccagcactttgggagaccgaggcaggttgatcacttgaggtcaggagttcaagaccagcctggccaacatggcgaaacctcatctctactaaatacaaaaattagccaggcttggtggcatgtacctgtaatcccagctagctactcaggacgctgaggcaggagaatcacttgaacctgggaggcagaggttgcagtgagcctagatcacaccactgcactccagcctgggcaacagagcaagactctgtctcaaaaaaaaaaaaaaagaaaagaaaagaaaaaaaaaagaaaaagaaagaaataggtgccaggagcccccagaatatcctttcctgtgagggtcatgtttacaacttacagccagtgcacttttgcacattttcaagaatgatatttttctccctagcaattgcttgtcatgatatgaaaaatcgacccattatcccattgttttttataacacatatctgatttttaaagacccttttaaaggggaagacagaaaagaaaattacaggtgacttcccccattctcctcgctcggtacagccgaattgttaggaaaggagactggcactttgtcagcactaacaacggaacacaccatttaattatacaaggctcaggggctgctctaagagggccaagctgacctgggcttctgtctagcttgaaaaacttctagctattgactttttgcaagctccttcacatctccaagcctcattcgtgtatttattcattcgttcagtctataatgtattagcttgatgcccagttaccaactccaggcatggtgctgggcacaggagatgcagctgtgaacaaaacagacacaagtccctgcccttggcagacaatgagcagcaataaatgactttagggtatgtccattggagataagtgccacaaagcaaaataaaaccttggaggaggagggcggggcagtgggggcagggggccatgctcaagctgctggctccactgagaaagtggtagttgagcaaagacccaaaggaggcaaggaggagcctcacagatgaccaggggaaaagggggtggccagtgcaaaggtcctggggcaggagggtgcctgactcatgaacagtcgggagacaggaggtgaggtgagaggagagcactgtaggagaggagacagaggtcgtgtgcagctggccacacagggcccagagatcctcagttttctcctctataaaacaggaacagaagcccccaggcagctcccgtacagatttgatggaataacatcagccaagtacctacaggtgtgctaggtgccccaccagtgtaagcaagtgtgcgtttcttcccggcactcctgtatcagcaatctgtttacaaggtgtcgatgacacgtggctgaacacatctgggtcaggaggaccctgagcttggattcggatctacccaggttggggtcaagaaacactctctcggaggcaggtcccccagcttcgtgacactgtcacagctttcttcattgtccccaaggttctttgggtgctttttcttttagggagttcaatgaagagtttctttctctggtgtagtcacttcacttggagttacgattcctgctggagttggcaactgggcatctagctaatctcagtgttctttgaaagcggagagttccagagctaagtcatcaatttcttgaagccaaaagccatctcactggttgtatatatgtgtgtgtatgtctgtgtgcatgtgtgtctgtgtgtattatatattatatacaggcactgggatatgcctagggcagtttctaatttaaaaattagaaatcaataaatatatgtagattgctgccttcccgactgagccagtagttactgcaataatgctgcataacaaatacccccgaaactcaacagcctaaaacaacaactcatgctttctcctgtgtctgtaggtcagctgttttaggctgggcttggctgggtgtggctccaggcctcaagttgggttcggctctctccacatgtctgtcagcttccagggacagtgggctaggagagtcatgttcttttctaggacaacagcagaagctgttgatggtggtgatgatttttaaagtctgcactcagactttcttaccatcactctgtccaccttccattgaccaaagcatgtcacatggccaagcccaacatttatttacagggtggggacagtggggacagatattcttcacctggtgggaggacctgaagggatgtatggcaagaaacatggatggaggaggtcttcctaggaagacgagggcccctcctgctactgacctaggtctgcgtcatcaagggtagcagccatggtggttttagacagcatgcaggcaatcacttttttcttatttatatgtatttattttatgatttctacatcagttaggaattaagtttgactgctagaaataaagactagttgtaacagtcaattacacaagaaaaaggtttatttctcttctgaaaagaagtctggagataggccaggcctgtgtttgaaaatgtaggttgtattgtgattcaggtatggtgaggccaacacatcaggagaggctgccattgaaaagatagtttgttcctctcagttcccaagagaaggggccacagcataccatgggggcatgtggggaagcaccagggctgatcggggatgggtgagatggggtgagcaggcttagaattagccagtttgaatgattttgtgggctctggggtgtaggggcttctggcatctggccctggggtgatgaaagcagagaaatattggcctggagtggaggtgtgggctctggaccagttaatttgcataggaaagatgtgcttccctgtaagacctttactatctctagtaattggctagccctagaacaggtaatttccccagtcagcaaggccctagatgccaaaatatcagaataaaaagacatacttaatacttggagtaacagctccattattttatcaagaaaccaacttcttctatctgctccccaacccttagagcacctagcttcatttacctctttgcccaagatggctgtgagagttccagccatcacattacatttatatttcagacataaaaaatgatacctatcttccacttaagaagcctttctggaagttccatctatccatgccatcctgtgtctcaatgaccaggagttagtcccatagccacactgattgctagggaggctgggaggtagagtgctctgcccaagcacattgccagtctgaataaaatcaggtttcagttactaagaagaaaagagagagtggatattgggtagacaaacggccatgtccaccagttactctgtgtttatgggaagtgacagattttctacaaacaatagtcatagaaagtgtctttgataaatacatcaatttaagggggcgagggaacatgagtgtgtaattaagaagtatattaggtaaataataatacaggtggtgcgcgaagatttggtgactctgcccggtatatctggggagacagaaggttggatgcattctctggggcccgcagtggggccccttgtcctcgttcggagcaacaggcacatgtgccagtgtcccggctgcactgagtctcgccgctgcatgtggtccgcccttgtgaccgtgcacctcccacccacacgcattcataagcaaccttctccttgtccttgtcactgaaaacccattgacctacaactggcatatcgtgtctcccatgtttgggggcctacagcgatggattgctgggtaagggaaggagctgagaccccagaaggcaggctgggtgggagaggcatgctatcctttataaagctgtgagcagctgtttaaacccttccatttctttaaacaccctcttcctccttttacaagagcgttgagtctagctcacgtgaacagtttcatctttggtttttcccttgttcccaggtcacagtggctaatgagaagtgaaatcatttgaatccaggttttatcttctccttttctctctggggttgagcaatgcatggggcatcccctagttgacgaggccgtgtgggcaaaaagaacagcccccgcaatggcaaggacctttcccccggggatgccacagctcgtgactgtgcagaaccaaaaaatgccgagaaaacaaacataaaacacccccaccatctcgtggaaacccgcgttcctcccacacaatcccttctctggggcgctaggtgaatttgaaagggaatgccacgtacctagggaacgcttccctctaaagagcctgggacacgtgggcatgagtgcacacacctagaaatacagctcccaagatgcacaccccacgcgcccctctctgatgacgttctcgctctctggtgtggttttctcagcagctgcgggggaggcacacgggaaggccactgaggcctgggtggagatccagcgtgaagcctacgctttcttgccctccgacaaggaaaacccatcctcctgcccgacccagcctcagaagcacacctgtaggtgcccactgggaccaacagcctgagtggtgagaacagacctagaggctgtggatcccagcccgccagccctctctcctctctgtgcctcagcgtccaccctggtgaaatggacacaggcggtactgctgcctagcggggccgttgcaagtactcatccagttaacgccggtgaggggtgaggccctgtgtagagttgaggtgcgtggagcagaaggggaggcccttccctgaagacggcttgcagtcctggaaggcacttgtgtggagcttttgatagatctggttttttttttctttcttattttgccttttatggttgtgggggtgacagcaggactgattccctaaaagggagagattttctcacttagtctaagcacctccttcttttcaggggaactgggagtgagcttggtggggagtgggcggcagtgcctggcgggtcgtgacctctgagttcacagagggaagcccctgccctgccaaggaggaagctggagagtgaggccagggcctgggtgagcgggaggctgtggcctcctccgtagagtgcagcatcaggccccagcgggccaccacccaaaagtgaccaaaacagaacagggtgccaacagaaacagctactgtggctacagaatgggctaggagtgcagggcgctgacagctgtgacgaggctggtgggaggaagtgacccctgaggaagacagggcttacacctggtgcctcccatgccaagtcaagggtgggaatggagacccatcaccaaggaagagtgttggggtcctgtagggccggtggagacctgcctgtgctctggaccaggctcctttgccatctctagctgtgtggccttgattcagtcattgggctgtttctgagcccaaatgcagaaggaacatttgtagatggaacatctcctgctcttcttgccccctgtagactatatgccgaccttattagtgtggccattttaagcgaggaaagtgaaggccacagaggttatgctgtctgtgcacagctacccaatcacagagacaaagctcaggcccaggagtgcctgatgctgattcgatgaggcaaggtctgcagaagcgcccagcacgtcagttgacatatgttgtgttctcagcaaacgctggtagaatccgtggaatgtgactgtgggaacaaagagctatgccaacttggaaacccatgggcaagggccattttgtgcagggacagatggcctcacacctaagccctgagaacatccctgggttctgagagtatgttaaaaactggtcacatcaaggacccagcatcagcagggaaagggcacattatcgtcactatggtctgctttgggtgaagggaattcatcgtcgacacctgcagcccctcacctgtccagaacactcaccatccaggttgcaggagagtgactgggtgataggctcctagagatgctggggaggttgctctgcagctcttccctgtgtcgttacttctcttctggcttcttgttttcttttggggcttcttttttatttacacctttgactattgtgtctctcatttttgtaatgattcctcttacagccttctgtccatacgaatcaggtgttccttttataatacaacagtagaaaatctttgtttttccctgtgcaggaccattgactcagaaaaaaatcaatcaagggcacaacaaaatgactaaatggagggtgatttctttcccctcttagaaaaatatagccacttcagtgcacattcactttagattaaagcaggaaaactctacctgacaagccccatgctaggtgcatttcaggctcggggaagagatggtaaggaggcagcctgagagcggtgggaggtgaaagacccagggctggggaagctcagccggttttgcagaaagggtcagttattggtctgtggattttgggaaggttccatctgccaccgttttcctttaaatgctcacttgaccagggatgccatatctctgcttgctcactaaagggatctgccgcatatgtacagagaaataaacctcattatcatgaaaagttgggaacaactcacatgcccatgagcacaggaagagtcagataaactaaagtactgtcatcctttgccatgattaaaaagaaggagttaggtctataattctggctatggaaaggcctccaagacctgttgttaagggaaaaaaataaagtgctgtttatggaaagaaaaagaaggccataaaacaaaatgacggccgggcgtgatggcttatgcctgtaatcccaacactttgggaggctgaggtgggtggatcacttgaggtcaggagttcgaggccagcctggccaacatggtgaaaccccatctctactaaaaatacaaaaaaattagctgggagtggtggcaggcgcctgcaatcccagctacttgggaggctgaggcaggagaatttcttgaacccaggaggcagaggttgcaatgagccgacactggccattgcaccccagcctaggcaagaagagtgaaactccgtctaaaaaaaaaaaagtgacacagagctgagacatgagtgtgagtgtgtaggaaaaagtctagaatacacatcaaagtgagaggattggtcacctgagggaatagtgagactgcgtacatgtattttgttactttaaataacaatttgtaaagcagtagatgcagtgcatgttaaccaagcatcattcacggcttttcacctgccacagtgcttgacctctgaaaggcccactgtgaattggaaagcccagatgcccatcatggtagagccacccttttggccagagccacagattctaaaatgaaattctctgagggacagtttcaatcaagccaaaagtgtttttagttttattttattttttggggtttttttttgcccaggtacatctgtgacagtaaccagttaatcaattagttacagctatgtaacaaaccaccccaaaacttaccggcttcagacaacagccatttatctatctcatgatgcttcaagccagtgcatgcgtctgggctcagctgggctgttctctcatctcagctgggcccctcacacatgtgtggtcagctgcaggtcgcatggcagctgtgtctgggaatcatctggctgttggctggggtgacagatgcaagagaggtgactaggatgtgtctctgatcacccagtaggttagcttgggcttgttcacctggtggcagcagggtttcaagagaccaagcagaagacgcaagacctttcaagcccaggctcaggcgtggcacacatcacctttgctgcattgtgttggtccgagtgagtcacaagcacagactccagccttgctgggaggagctgcagggcactttgcagagcggcatggacaggtgcaaatggaaggaggagggggagttgaagccatttttgcagtcagcctaccgaatgaccgagagcagtgtgtttcagagaaggcaacaatggcagaagataatgaaaaccattcctgggagctatttctgatcttcgcttttctccatcccagggatgtctcagtggtggtggtgattgtcttgaggctgtaatccagacacccagaaacaccactgctatggcagggcaatgccagatcagtgatcctcacctctggtccctccacacactcagctcattcattttcacatcctcaactgccagccttgcccctggcaagtccatttaatgcatgaaggcactaactccaattacagtggtttctcaagagcagatatgactgtgggctgattcagagccagctggttttgtcttcatgctttctgtactgtgcatatgtacagttgcagtttgggggtagggaagcctttatttttttcccctcatgacaaaataccagttcattgtagaaatcttggaaaacccaaaggacaaaacaattagccttcactcaattactcagagaaaaacagtacccattttgtggcatatcctttcagtggtgtgtgtgtgtgtgtcagtgtgcgtttgcccgggagtggaaatgactgaaacctgtggtttgccaacagaatggacatctgttccctgtgagtcccaggggccctggcctccacctgctgtttggggctttctcggtttcctccaccatggttctctctccctcgtttttgcactaccctctgttttttgataagctgcttctgaagttagagaatgagagtgcagcctttgaagcgtgacgggagatgtggagaccgtctccttggctgcgcagatgaagaggcacgtggcctgcccgaggcccccagtgagccgggagcaaaactggatctcagttcctagcccagtgtcccagaccaccttttatgccctccttgtcactcagatgccttctccacagcaaacccagaagaaacggtgccctgattacaccaggagacgaacgggacacagaagtagctttctcagcagggagcctctaccctcacccccgcagtctagtccccacacacgggcagagggatcccttcagcccagatgagaccatggccctcctcagctcccaccacctgtgtctcccacctccctcggggtaaaagtcaaagtccccaagaagcctacaaggcccccgtgacctggccccatctctccctgtccctggctccaactcactggcctcccctctgttcccacctactgggcccattggaatcttcaaacttgctgtcccctttgctaggaacatgtgtccccagatgtctgaatggcttgctctgtcacctccttctggtcattactaaaatatcaccttctcagctaggcctcctctaaaacagtaaaccccctcgcataacacacatacacacgcaccacatacccgctccctccagactgccagtggtcagactcgctttagattttctgtgtttattgtctgacccccaccatgacaaagatctgtactgatcttgtcatgaggggtgtgtataaggccctctttctagaatctgctctgggccacaggatgagaggcactggcgaggggtgcaatgtccactgctgaatgccaaaccatccccccagcacacagcaagtgctcagtgagtaaggatgaataaaggatggaatgtggaatgcgggagagctagaagtaaaggaatagaagagggcactgtgcacttttccttttataatgaatggtatctgaatttgtaaattctaattccttacagcagaaagctctgggaagcatttgctttatttctttcaatcagaaaatggtgtttgtttggagatcttggctagatgctgcacttcccaagttctgatgaaaatgttctttatttcagagtaatggggaggttccaggatgaagttttctgatccaaaagtcaagacagtcactaataaataaatagaagagttgagaatttgaatgaatacatggagagtctgcggcacgccaggccctgtgccagccctagagaggagtcctcattccagtgtcgagaggctccgactttgcccagatcacaggcatctcgacacattgccaaacccaggcttcagcatgcttagtaagagagtgatcagggttgtagacacagagaagagggagcactccctggggaagggggcagagggcaaggtgaggctgcacagaggaggtgctatctacaagggttttgaaggttgaatagaagtttgtgaggtgggcagaggtgggcatcattccaagcaaagagaattacatttgcaaaagaacagagtcacgtggcagtgagagttgtggagggagctgcacaccactcggggctgttggagcgtaaatgaaaagatgctatgtgtatgagtccgctagggccagcataacaaaattctacagactggggagcttcaacagcagggatttattttctcacagttctggaggctgaaaatgcaagatcaatgtgttgctagggctggttccttctgaggcctctctccttggcttgtaagtggccgtcttctccctgtgtcctcacatggtcctccccatctagtgtgtacatttgggttatagtggattagggcccacccatattaacttcattaccttggcaaagaccttgtatccattcggaggtactagaggttagggcttcagcctgtgaatctggggaaacagctcagcccataacaccaagataggaatatctctctctctctctctctccctctctctctctctctctctttctctctctctctccctccctccctcctccctctcccacctctgttgtgtggtctctctctctctggggaatgatcaaggatggaacaatgtcaacagactgcgatgcgtaaccctcagttgagaatgactcggatttaattcgaatggtcctctgagtgtcaggcgcctctttgtggtgtggagaggaggccaccctagtctgggtaggcatgcttttatggaaaaatattaaaccagccctgcccgtgttagtcagatccagtgaggggcgttgcaagttgttttatatttgttttggattactttcaacacttgtcctagaatgctccgagtctcttgctaatgagttttcctttacttaataccagacgctgtggctcctccccgcgtgaaatctcacgtggacttgggaagagagagcatctgtccccatttgactcattttcaacaccaggtccccgagtgccaggttgtggccaaatcctgttccagtgggaggaccccccttccctaggatgtggctgagtcacttgtttgtgcaggctcaggagtctgggagccaccccagggaccacaggtgtggaaggagaagcccgctccaatcacggtttctgggcgtcaccttggagacagcagctgaggagctcaaataggtgttaccgtggaagctcctgtctcaagggagcctgaggttttctttcccaagtctgtagacagccacttgatggaaatgatcatacctgtgcccatttgcgttgggctggaccagagaccctgtgcttacaagtctccgtggcctcttagctgccctggagggaacctcttgttctgtgacttaagaaaccacaagctcttgtcctgatgagttctcttattcttgagaatctgtggtgggcctggtactttctaggtgctggagatacaaagacaccacaaggcaccctgcccctaaggagcacacagtccagcaggggtctgtagtagaccctgattatgccatcctgtgataacactggagttggacctctagacacacaggagaaggctgggggtttttctaggggagagacaagacacgcagatgttccacagggtggaggggtgtttcagatggagcaggtgtgtgtgcaaggcccaggatgtgcaggagtgcaaggatgggtgagtggttgctgcctggaggcctgggatggtggccttgggtcacttcccctgagtcccagaccaaatctccagatgttcccaacagcccatcaaagagcaggtactgaagagggggctgaggagctccttatgtccacttaagtggagggacagagacacagtacaagagaagggaacagagacagggacacacaaaggcagacacagaatgacccacttgtgacctcaggtggctccatcagcaatcgagaacagggctgagtcacttgtttgcgcaggttcaggagtctgggagccaccccagggaccagcttcctagaccccgtcccctgaggaaaattcaggaaggaggagggaggggcagggttatctcctccccaggcccatggactgggtggatcttgtggaatgcactgggctggagggagattgggggctgggggtggggagaagggctggaaggccagggaaccagccccagtagacgagagggaggctccctacgggagtggcagaggacaagaaggatggcgtgcatgcctctggagggagtggacgcagagggagacggaagagtggaatgtgaacctgcagttctacccccacaaagacagggggtgcagctagaggtccaggttgggaggggaacataactggttccagacaggtgggaaacataggggtgggacctggagccaaatgaaacagaaaccagcccagggatcacaccagggtgtcttaagtgttctgtgtggatgaggcccccagaaccagagagaaaagggagggcagggtggagaagggaagatcgtggcagggtgaatggggaccgcctgggggcagttgaggcagggtggatctgtgagcccaggacaagagagtgctgtgagcagtgcaggggggactgccacctgcccaggagccacgaacagcttgaaggcagccagaaatgtaggaaggacgctgtgcagagctgccatgttagaaaactcaggagccatggccgcatgtttggggcttgttttctccctgaaggagagtcaggaggacgtgctcattcccgctggcctcagctccatcctcaccatcccaggcgttctcacaggctcctcttccccagtctccctggccggtgctgttggcttctcaatcttccatctcttccatctccaccttccttgtttctgtctgggcccccatctcccaagctgctgtcactcattctattcaaactctgttctttgcctttacttcagtaaagtcaaaataacttttgttaacatggtgcacaaaaatgtaaagttccagcgccagtcttgtgaagggtcagtccgttgtgcagccttccccttccatgccccgcccctgtgccttctgtccccacttgcagggatggcagctgtgacaccagtatgggggctgggactctttcagggcacagctttgggaaagcctgtgtggcctgagcaaggcagctgcatcccagaggatggatggacactgcaccaggaaccccggcatcctgaagcaggctttcttttttattattattattcatataaatgtatgggtacaagtgcagctttgttacatggatatattgcgtggtggtgaagtctgggattttagtgtaccatcccccaagcaatgtacattgtacccataagtcatctctcaatcccccatcccccatccttccacgcctccagtgtctgtcattccaccttctatgtccatgtgtgcacattatttcactcccacctacaggtgaggacattcggcgtttgactttctgtgcctaagtcatttcacttaagataatggcctccaggtccatccatgttgttgcaaatgacaggatttcattcgttttgaggacctagcagcattccgtgtataaatgcaccacattttctttatccagccatctgtttatggacactcaagtcgatccctgcaagaactaagcatgaaaggtggagaaaggaagactagcattttttggatgcctactgtgtgacaggtgctttcacttgcctcctcatttaaccctttcagcaatccactcagtaaataccctggccccgatggcggctttcactgatgaggaaaccaaggatcatagcggtggagacgtttgcaaggtcacacagctaagacgtagcagctgtggtctgtacccggatctgatgccattgcctgcctgctttctgctgccttccagggactctgccggtcagcaggtgtatgacagaagcatatatattagccaaaacatggtctctgtcatctgttttctaactcagataaaggtgatcttaaggacgtggacagcacagtttaggatcaaatgttctgcaaaatctgggtcaggtcaggaatttacctaatttgacatattgtttccgactcctttgacatttctcttcatttggttctgaatatacagtataggagatttttttcctattaaaccgtgtccggcggtgtaaaagctcttggggttgctgatctcatggagctctgcagtttgcctcaagcaattctttggacttcacagagcatcctgttattttgttacagacttaattccttgatctcatgcatcctggaagtttctagtggcaaaagcctctccccactctgcagctgtcacttatttataagccagaggcactttctgtatatgcaactttcatcatagagctctgagagaaaggtctggcatttctggatgattctggccaacccagagctgcacagagccctaacatttcatgagagagaaaatcaacaggagaatggccactgtgggcatgacacgtggcaatgtgatcgctaaccccacggaaccagccacttaccgctttctgaaacccagatcgtcatcccgcagcgtgatacaaaaggaagatcatcttgctagatgccaagaaccgtagttatgacactttttgtcattctgtttcctcttatttatacagtggagagtaggatgttttcaaataaaccttctaaatatgaaatcctgagaatgcattacttcaaaaatgctgcaccgttagcagccttttagttggttacattataaagcatgtagtaacagcttaaaaaaaaattctgagtcgaaatgtgtttccagagcccatatgctgaattctggcatctttatacctttttcaagctgttgtcaattagtaaagaaattaatttctgcctttatctctcttgtaaagccgagcttgtgcttggatgatgcagagagccacaaagggagacatccttcctcgctctaaggtaactcagtgcagtggtagtcggggggacgaaaacatgttgtgctgagtggccgtggattgaaactgggaccatcagcaaacagaagagaaggaaatggcttttgttgagggaaacaaactgttttccaggccaacaagctgtgatcttggactttttgccatctgtacattttttagaaagcgagaaaagcagagcccctgtggtcatacgctcttccttgccctggagagggaagggcagcgtgtaggggtggcacgcagttcttgtctaacacattgcctctccggccccttctacctgtgactttgagcctccctttgttccagtactctctgcttggactttttttttttttttttttttttttttagcattagtggaatgtgtcggctgatggccaaacatagttttgtagtggcagcaaaaagggacagacctatggcatttcatctaaggaagcggttcctttgcttttaatttgtcattggtcttatttccttatactttggtatataatgccctgctattggatgtcgcaggagcatagaaaacaaaccaggctttcattaggaaagtgtgtttttgaaacaatgatagctaaattttttaaaagcatattcaagttgcagcctgaagtaggaaggaaatatggagatgctggcatcctctctccaataaagcattgaggttaaagactggaatctgaaaatacacagcaatttcaggggaatctgctgaaactggaagattgtttcttggcatgtaggtggccactgagctggctttctgtcaaatcacttttgggtgcatttgaaatggctcaaacaggctgggtgcggtggctcacgcctgtaaccccagcactttgggaggccaaggctggtggatcacctgaggtcaggagttcaagaccagctcggccaacatggcaaaaccccatctctactaaaaatacaaaaattacacgggcatggtggtgggcacctgtaatcccagctactcgagaggctgaggcaggagaatcacttgaactcaggaggtggaggttgcagtgagccgagatcccgccactgcacaccagcctggtgacatagcaagaaatggctcaagcggccacatggtctcttcctgcaatcagggcttccaaatcagtgggctgacagcccagattatgttctgatccactgtttgggtcacgtgtagtagtgatacggctctctctctccccaccaaaggtagagaaaacaggttgccttaagaaaagaagcgaggagaaacacataacttgagctgcatgttcttcagaccaaaacaatgccttctgtagcttttttttttttttttttttttttgggacggagtctcgctctgtctcccaggctggagtgcagtgaggccatcccagctcactgcaatctctgcctcttgggctcaagcgagtctcctgcctcagcctcctgactatctgggactacaggtgcccaccaccaagcctggctcatttttgtatttttagtagagatggggtttcaccatgttggccaggctggtcttgaacttctgacctcaggtgatccacccacattggcctcccaaagtgctgaggttacaggcatgagccactgcgcctggcctgccttctgtagcttttgtctgtaaaccaagtactacagtagaaagaaggtgggttttgccacctattatataataaggacatttttttcaaatggtaactcccgtgctgacaaggatgtggcaaaactcaaacttccatactttgctgatgacaatgaaatgtcaagttgaaaagcatttttagttctatgtattagaactcatgaaaatattcgtatcttttgatctagaaatcccattttggtaagtttatcttgagaattccatagacatctgtaaaaagatgttcatttcagtgttatttataaaagcaaaaaattgaagtcactctcaatgctccacaataagtagttgagtcttgatgtatcccctgatgggatattatacagtcagtgtaagtcatgagtacaaatgatgcaataatgtgcaaaaaaatcacagattatgtatatgaagttacaagtcaactctaagcccccagcatctaaccaagacctgacacaaaacaggtatttaggaaatgcttgttacattgaaagtgacctgcttgcacgatcttcctgtagcagccagatagaaaaaggctttgtctagtagaagggctgaccttgtccccacccagcccctaaagcacaccttgggaaccatgagacaaggggatgttgactgagcaaggaggcaaattacactccctggctgttcctgctggaaggctcatctgtgactgctccccacaaacctctgcccgctccccacaaacctctgccccggtgtaacacacgcatcgtggtgtcctagcatgggcctcgtgctgacaaaggagtaagcccacaccaggcggctttgtctttcctgggagatggggtctggctgggaagagcctgagagggccatgccccctgggagcacccagcctgccctggcatccagcgccacactcagggccaccccacagtctgtgctggacaggtccactttcccccccaagaaagcatgaggagtgggcatggcctggagctggggtcgccacacacaccatgttgtatgtttccattctcattcactccaccccactgtgtctctggatgtcacatcctaggtgctactggatgtgtttcctgtgatgaagaagaagaacattgtatccatggaatgtagaggaaacagagacctagttgtcctgtctctctttgggcacagctgagctcaggcacctggccacagagaggttgtcactggtcactgtggctgaaggcccagtggttaggtctaccaggtcaggctctgtgctcactgggggtagccgtggggagcagcattttccctgctggctggggccaggcattggtacctgcagcctgggccagtccagccccagggaaagcttgcactgctttgggggcgttctactcccctaggccctgcctggctgaacagaacacttttcccgtgctgtgttcttgtatgaaaacagacgtccagaatccagccctgggaggtccccacactacgtcgacacggccacattttggcccctgcaagcctcacctccaccctcagtgtggggagctttccttccaggccagcgtcacaccattgtccccgcactggtgacttcatcctccacttggaatatattttcatcctgaagtttacgtgactcagaccacaggccacttcccttggggtgtaccccctactgccctgcacaacccccacagaactggaacctcagggcccccgcagagcccctgccttcctttctcttgaattctctaagctggagggtgaggccagcaaacggcgacctgggtcccggcagtcctcagaggggtttttgcgaagtccactcagactttttaaaactggaactgatatggacagatactctatgattccacctacatgaagtcctagagcagtcaaactcatgaagacaaaaagtcagtggtggttgccagggggtgggggcagggaagacagagttgctgaacaaggaccgcgtttcagctggggaggatggcagggttcgaagctggatggtgctggtagctgcatgtctgtgtgaacgagcttcatgccacaagtggtgacttcggacagtgaaggcggtcaatttaggttatgcacatttaccacaagtttttaaaaagagaactaggagacttgaccttaaaactggatttctagcttatcttgaacatttggaagactgggccacgctggacccacattcctgtgcggcctggacctgctgaggccagggcttccccactcagagctgcctgctggcccgcaggcctctgagcgggctcccacacaggcaaggggactcgctgtgtgtgtgtctggccccaggcccacacctgcattttatgagtctctatacgtgcttcacctagacactggccagcatacagcaagtgcttagcaaaggtgcactgggggctggctgcatgcacacttggaggatggtagaaagcatctccaggaacccccaaagcctcaaagaagcagcacagtaccactggtccacacccctgcgtggcatccagttgtccatgtaagagttccatgaatgaaatctcaggcctgctgctccatcccaaagccctccataaggtcaccagcatggccggtttgcagtataatcttccagagctttctctctgctttgatatcacgtatgagccaaaggaaacagtagtattttgtgggtttttaaaagcatcagtggtgagctacgtaggcgtcattcagcaatttaagctttttctatccacagtggctcttggaggtcttcccaggccagttcatacagttcacgttggcaagttattgaaaggagaccaaactaataatacttaattatttctggttggcaggagtggtttgacttttagttcttatttctacaaccaatatttactgcccacttactctgtgtcttactgctctaagcactttatagcaattatctcagttaaactcactaacaagccagagaggtggggactttcactaccctcaatttgcaaaggaggtgactgagcctcaaagaagttgaaccccccacaagaggcctccctgtggtggatccggatttgatctgaagaagtctcattctggggtctttgcactcagcggccacttgaggcttttcgggatttttcccagatagctcccttgaacatgttttacttttgcaatcagagcagagatgcagtgtgtatcatttaagatgcaggcaaatggacacaggcatttccttcattccacctggtgcctcctgaattgaaggcatcttcaatgctgcctactagaaatttctgcgatggtggacatgttctacctctgcccatcctgcgtggaagccactggttgcgtgtggccgtagggcattggtaagactacagaactgagtttttctgctttttcattttaactgatgtaaatgtaagcatagctggcctgtgcggctggtgcagattgggaccgcttctttatacagtcacactgtcagttggcatccagggactctgtgccctgctgcagaagcccctcacaccaccctgccgcttggtactcaggagtgctcactcctacaggggctggactggccttctcccccatgctggaagctgagcagtgtgcccagatggagagggccagataatccctttctaacctctctgcaggcaggcccaaggagtgggacccaggctgcagggtgctccagcctggcagatggctcctgcccaggacctccttctgcctgtccatggttgtgagcaacccagggctgagtgggtgctgaacaccagaagcctgaccagcctccacccttccaccagcagctccttgggaggtagaattgtgattccagaaacaaggcctcccaaggcgtggcttgctcctgtgtttgctggaggaatcaacaagaaagatctaggttaccatttcctgcttccaggaaccaagaacacattttttttttttttttaaagagacagaatctcactctgtcacccaggctggagtgcagtggtgaaatcacggctccctgcagcctcaacttcccgggctcaagcgatcctcctgcctcagcttcccgaatagctggaactacaggcatgtgccaccacacctggctaattttttgtattttttgtacaggtggggtttcaccatgttgtccaggctggtctcaaactcctggtttaagccatctgcccaccttggcctcccaaagtgctgggattacaggtctgagccactgcgcctagccacacgagcacttcttacgttattcttacttagataatattaccatgtgccatatgtgaatgcataattaatgcccgttttaagaaggagttgatgggcggtggctcatgcctataatccagactagggcaggggatcacctgcggtcagaagttcgagactagcctgaccaacatggtgaaaccccatctctactaaatacaaaaaattagccaggtgtggtggtgcatgcctgtaatcccagctacttgggaggctgaggcaggagagttgcttcaacccgggaggtggaggttgcagtgagccaagattgcgccattgcactccagcctgggcaagaagagcaaaaccctgtctcacaaaaaaaaaaaaaaaaaaaaaaaaaaaaagaagcagttgatgatttcactgtgtcctggaggtggccagtgatgtcctggaattgcaaatgacccgggcagatgttccagtgcggagaatacagggccgctttggtctgcagcctcaattttcataatgacccttatcatggcagtgggcatttattgagtgcttcctgtgtgccccgctctgtgctagccatcatccattccctccctcactaattctcacagcaccttctgacgtgggcttgtgagtgccccttattgcaggtgacgaggctgagccttcaggaagtgaagtcactgcccaaggtcacacagaggtgacctccaccttactacagtcacacatcagagggtgctgtgaggattagtgagggagggaatggatggtggctagcacagagcagggcacacaggaagcactcaataaatgctcactgctatgataagggtcattatgaaaattgaggctacagaccaaagtggccctgtattctcctcactggaacatctgcccaggtcatttgtaattactggccacctccaggatacagtgctactggccttagcctcctcatcttccaactggtagatggtgactcttccctcccagcttgggttattattaaacaagaggagggccgggcgcagtggctcatgcctgtaatccctgcactttgggaggccgaggcaggtggatcatttgaggtcaggagttctagaccagcctggccaacaaggtgaaaccctgtctctacaaaaaatacaaaaattagccaggcgtggtgacatgcgcttgtggtcccagttactcgggaagctgaggcaggaggatcattggagcccaggaggtcgaggctgcagtgagccgagattgcaccactgcactccagcctgggtgacagagtgagaccctgtctcaaaaaataaaaatacacaaataaataaataaacaaacaagaggagtagcaggcctgatggcctggcatggggccaggcataccgcaagtgcttaacaaatgaggctcttttctctttgccttcattacatcttagctgaattcaaatttggaatagtgcttattcattcattaaacccaggtgaaaggagcccttcccctcacccagccctgcctgggcagggatgcatgaagctgaagtctccagggcagcggagccatttctcacgtgttctctctaggaccagactcatttactctttgtgactcattactctttttcgctgacccaactcctgccttttctggaagctctgggatcctgacttcagctgtttttagttgcttatcacccaggctttctaaaagtttcacttcttgttaaaaaatatagtatctcacatcctagagtaatgaacgtccatttttttaaagcaatttgcttttcctcatgcaatcttctttgttttttaaagtgatacttaacaataatttcagcagaagtgaaacttgggttgccaggtgtctgtacttttattaggtttgactgaccctgagctccaaacaatggaactagcactgtttgggaacttctgtaatctcacagaggacaacagatctaactgaatgttttcaagggaaaataaaaaggtctgttccatgttaaacctgggagcttttagcgtgaaggaactgagccgaaagatggtttaacgcttgcactctaagagagccaggattctaactgaaggtgcagaccagctgccccatctctttgcagagctgaacaggagaaaatccttgtaagtgggagagatgcagactagattcagaaggatcttcccctggaaggatgcgagcaccaagagaatgccagaatttatacatttttctcctctgaaaccatacaaagggagggaatgggagaaggcggggagcgagcacgtgctggaaacccaccttttgccaggtatgttcagctgtttcatttattcccccaacaacttgatgagtagacaggaggtgactggaggtaactacaatcttggaatttgtgtttcattctcttgcttttttattttatgtgtttatcacataagtatgagtctctaaaaatatgtatatttgcttttgcttgttttcttaacattataaaatggagtcatacttactcagtcttctgtgatttgctttcttcactttgtgtttcttttctaagactcatcagtgctgctttgtgcagctctagtttatttgcttttcactactgtgtgataatccatttgccacaatgtatccattctctagttataacaacggggctgctatgaacagtccgattcctgtgtctaagagcttctcttggacatatatcctggtgtggaattgctgagttgtaaagtaaggaaattcaaccttaccggataccaaattgttttcccaagggggttgtactagtttctctccctcctgttgtagcatatatgagtttatgacttcctttagatctaaaaatggggactaaggcaattcttcctttctgctcctaaaacaaaggcttgttccactctggtgttcatcaacaaatgactttaattcttcctttgggtctgaatgagccaagactcccacgtcgggctcctccgggtctgttgtgtggttcttgaggctagaggccccacagtgatcgtctgtcttattgccctgaccacacattctgtaagattcctcctttctgatgctggctgacttcctgtgggttggccaggaatgcagggcagacacccaaattgtaagggaaggaagtgtctgtcctcctcacagtcaggggctcccatctctccagagcctcagcccgtgtgcctgccatgactggctggcttagtcacctgaggagagatgaccaggaaaatccagagagaaggcatttgctgggctgaggggaataaactgcctgtggaaaggtggattggtccttggatctcttcacctgggggctgtcaagttgggacagagccaagataagagccctttttcaaatgtgttctttcatcttttaatggagttggtttctttggcaggctagcaaatcctgcagggcccctgtgcagccactctggagggtcagggagacactctgtggttggcacctgcgaaggagcaggggtgagaaatgaggagaaatgtctgtctgtgccgaacccccagtggagagcgtgtgggctcagagttagggtaaatgaaggcacgggcgcactgcagacccctgatgggagaggcagtgggcgatgcttccatggtgaaatggaatactgggagccaggtgccctggcgcctcatggcaacgcctccttactctaggccggcctcgctggcattcctctttgagctgatgagggaccagaccagtcccaggttagcacctggatccactttcctgcattttgggtaacacatgttgcgtctttcctctggttatgaaagtgagacccggtcaaggtagattcaagggaaagcagcgctgcatcaaggcagccatggatcccacagggttaagggggtgggctccagaattagactccttagaccaacccggctccaccacaggaaaggctccagcagggttttctacttcagacctgggcctcctgctctgcaaggaacgcccactttcctctgcagggccacaacgctctacgctgtacgattgggaggcaggctggaggggctcggctgccctgccctctttactgggctctttagtgacttgctccacgtcagcacacccacccaggtgcagctgcgcacccagccactccatccctctgctcagaggcaaagcttctccctctgaaccctggaagtcagagcgatggctgcatagggtcctttctacccagggaggcatggagttggtggatgaagcttttgacaagacttttctataatgatcttgtggagacagtgatataatgaggccattttttaaaaaatgcaaacatccctcttgtgcctaaaactctcctcagcctcccctctctctaggtagaggccagcatccttaccatggtctcaggccacgtcctcccaagacagtgacacctctcctcccatccagtggtctgcatctgccttgcctcccaggcctgaatccccctcactcttgttaccagaaaggggtcctgatccagaccccaagagagggttcctggatcttaagcaagaaggaatttagagggagtccatagagtaacatgaaagcgagtttattaggaaagtagaggaatgaaagaatggctaccccatagacagagcagcctgagggctggtgggtgcccatttttatggctatttcttgatgatatgctaaacaaggggtggattattcatgcttcccctttttagactatactgggtaacttcctgacgttgccatggcatctgtaaactgtcatggcgctgttgagactgtagcagtgaggacaaccagaggtcaccgttgttgccatcttggttttggtgggttttagccggcttctttactgcaaccggttttatcagcaaggtctttatggcctgtatcttgtgccaagctcctatctcaccctgtgacttagaatacctcaaccgtctgggaatgcagcccagtagctctcagcctcattttacccagcccccgttcaagatggagttgctctggttcaaacgcctctggcactctcaccctccttccacccaccgctcctcccagctctgctcagacagccctgggctggaaaagtcactgaacctcctgagacccagtcatggtgtccgtcagtgcactcggtggcctcatagacatgaggtctccagtggacattggctgccatttgttgtggttacttccagggttagcctctgcccagcccttctgttcctattgtatcccacacttagaaatttgtgaagtcttcagaagaacatttcccagtggcctccctgtttgcacatctgcaggtgctggtgagtgtgaaccacctgtccctgcctgacacggaaccagatccttctcaggactcacctggggtgagcagctctaggcacaagccctggggtctgggcgtgtagggaagatgccagccctgtgttttcacacagcgggttctttatcttgttaagaaggcttttctttccctcctcaatcttcagtcccctgcttcctgctgtgttttgccctgagctgtgagagtgacaaccctgagtctggagttcacaccctgtactcaagtccctccctgtggctcacctactgggggctgagcgctgccctttagtctctccagggtctgtttcctttgctagaaaatggggaaagaatccctacctcacaagcttgtggggaacaaatgaaacaaactctgggaaaagtgctttgtacgttatgaactctcacacaaataccaagtgctgtttttactactttttaaaggcttcgtctcactttccttacgcaaagctattttttatcagctttttcttctgtaagaaaatgaatgctaagaaagcctggttccctgaaaaaagggaagggggaggctggctcttcccattccagcagtaacaggatcaccagggttctataggttcccgggggactcattttgtacatggtaacaacatggaaagttattttcagacagaaatattttgtaggagactatttaatcattcaacaaaggattatcacgaatttattatacttcgcatcgaatgcagtgctggggtgttttaagagtacctaggatctgttttaattggatatggtaagacacacagacatgaacattactgtcatgaggggagaagtttattccattgacaggtccctagaaacagatggcaaagcatgccacgcagggccctgcaggggagcacggggcaggtcaggggccagagggagagggaactgtgggccggggcttttattgtggcttccgaggggaagaacaggtgaggtgcagtgagcaggtttaggattgattagtttgaagaatttcagggctctcagatgcaaggctgtccttaattgtctgttgcctggccctgaggtgatcaggacagggggacagtggcctggagcggggagagtctgataaaggcaattgaagtcccatccatgatggggtgggactgtctttccaggatcagcaaggcctgagatgttaaagcatcaaagtacagcaaatttaaaaacatagttaatacatagagacacaaaactaaaaatatcttaaagtctgcaaagcagggttctttaaaataataataataataataataataataataataataataaaagccaccaagagagcagccaggcatagtggtgtgcgcctgtagtcccagtacttgggaggttgaggcaggggattgcttgagcccaggagtttgaatccaccctgagcaacataacaagaccttgtctctaaaacaaatgtgtaaatacataaataaaaccaggagaaaaagaattctcattacagatgcaaaactacttctcaacaaactctgtttccatggtggtcaaggaaacatattgcatcagctatagctagagtaatggaattgagtttctttggtaagtggccattatggaaacactgcctacaattcatttcaacagacattgatcaaacacccaccttctgccaggcccgtgccaggaaccctagggaatgcacaggtgaataaagtatgatctttgctctccaagacggccctggcagacatgggcacatgcacggtgcattccctccccaagtccacacaaacatcatcgttcactcaggactgttttgcgccccatccagccacactcaccttagaagccactgcagcacagagccatgtggcacccctgctctcaggaccctccatctatagggtgggggatggtgctagaggagaaaacgagggaggactgtgatcaactcacatgtgacaggggcaagaagtgcttcagggttatggaaggggtatgttgcctttgaacttgcagtagcttctccaatctccctgcccaccctaagctctccatgactcacctcctcttccggaagctgcacctgcatttagggaattacagtggatgccatggatgaagggatttaaagggccttaaaggactggggcagggtgaggacctcaaggagaggctgcctgttcagaggcacagggcaggaacgtgtgcgtatgcttcaggaaccgtgggcaggtgggtgtgcatgtggctcagattgtggcagaggaacaagtagaagccttcctgggaggctgggaatactgggctgggatgtgcaggctgcattctcaaacagtgggggccgtcggaccacgacaccatcagagcagcttccggaagaggaggtgggtcatggagagcctggggttgggcagggagattggagaagaagctactgtaagttcaaaggcagcaacagtctccacccctaccgggatataacatgcaaagaaggagactggatgcagaaatctagaaggacttggggaccaattgaatgtagaaatagaattaaagtcaaagacgacagccctgttttgagcctgaataatttggaaggctcacagggcctttaaccgctatgtgaaggagagccaattatttgcaagcaatctgaggagctgtggaacagccaggagagtctgaccacaggttggcaggatggatctgtagctctggaaagaagccagagtcagaaacagtttatccaggagatgcctacattaccatcagagtcaaagcatgggagtgatgcgcttggaccagggagagctcgcagagtgacctggggcctcctgcatgtaatgtgtgtcaagggcaggctcctataatgtctcaataatatgggggctggctcatgaataagcaaaccagtggagctgagcagaaatccagaaatagactgggcttgagtgaaaagggaactttaacacatgataaggatgacattgcaattcagtgaagcaatgaaggacttgttcataaattctgctgagacgattacaaaccatctacattttggaacttcttatagatagtgttgcaacaatattgtggacatactaaatgccactaaatcggtacactttaaaatggttaattttttgtgaggtgaatttcactgaattgaaaaaaaggtctggtaaaagatgggtatctcctaccctacaccaagacaaaattcaaatgggtcaaagattcgaatgtaaaaaaatgaaactatctagagatggatgatggtgatggttgcacaagaatgtgaatgtatttaataccactaaactgtacatttaaagtggttaattttttaggtcatgtatatttcactgcaaaagaaatataagtcacagaaaatatggctgaattcctttatacccgtggagtggggaaggcctttatcaccaagaatcaaaattcagaagccataaagtgaaaagattgataacttgactattcaaaaataagaatctcaaaagaaaccaaaaataagaatcttctgcttggctaaatacaatgtaaacaaagtcaaaagacaaatgaccaactaatatacaaacagctcctaaatgttaagaagagatgcgaaacccccatagaaaaaaatgagcaaagacatgaatactcagtttaccaaaaaagaagtaatggctcttaaaatctgagatgttcaacccacactttgtctcctatcatatgagcaaaaacctaaatgtcaaacacacagtctgctggtcatgccaagagaaagaggccctctcccgcatctcactcatagagtgaaaggtgacactcccacatggaggggaatttggtaatacctacgaaaattacatatgcatttacatttcagccaagcaatcctgcatctaggcacataccctgaagatacaacatcatgcagatgacataaaatagtccaagtttatctaccgcagccaactgtttaataaataagagcttggatacaatccaagtgttttgcgatgagagagtgcttgaaaaaactatggttcacccccacagggcgtactacgcaacagtaaggcagaatggaggcaggtctgggatctgtgacacagagtgacctccagaatatgttaaacgtgaggaaaagaaaacctggtagaaatccagaaatagacaagactgtttctagagtaggatatgtggcatactatcttttaagtaagaaaggaggaaaaataagaatagatgggtggatggataaatagattagacagagaatagatagatgatagactagatggataaatggatggatggatggatggatggatggataaacaggtagttttcttatttttgcaaaaagaaatgcttagagggaaaaaacagaaaataattagaatgattaacgctagggaacgagcggggagatggaggagatggggtagaagtgagacttcactggatgaattttttaatatatttctgactgttgtgtcaagtacacgttttcatatttggaaaagaaaattaaattgaaaagcaagaaggaaaaacctacaaatggaaagaaatttaatttgaagttaatgcatctaattatcaaattagtaacataagcacacagagaaaataattataacctgtttgtaagaatttaaacttcaaacacaatactctagtcatattatgattgaactatattctaaagacaaaaaaatgcaaagcaattctagcttcttgccgtaggcttattattggtggcaatattggtattgtaattttgacgctatgctataagtaaatatgttaatgctattaggaaccaagattttcagtgtaaaagaaaagagataaaatacaaaatcaaagaaggtaagagaaaactttagaacattgatttcttgctctgtttttttttttttttttttttttttagccttgctctgttgcccaggctggagcccagtggcacgatcatggctcactgcagccttgacctcctgggctcaaacgattctctcacctcaacttcctgactagctgggactacaggtgtgcaccaccatgctaggctaatttttgtattttttgtagagatggggttttgccaagttgcccaggctggtctcaaactcctgggcccaagagatctgcccaccttggcctcccaaagtgctgggattacaggcatgagccactgcgcctagccagaacattgatttatagttgaaaatatctatatggactcattttttaagaattaagttttcttaagtctcatgtaaaaaaaaaagaattaagtttttcagctctgcctaatgaagagcatgaaagcaaaggcacctcggtggcattggacactcccaactttaaatcttgatgtttaaacactgaaaggaagtggggctccctggagaaatggttaattccaaatctgggacaaggaaattataaggtgagcctagtacatttgtgttgaggaaggggggaagttcttggtaatgaatgggaacacagaaacaagtcaaatgacagaccatgacgggaaacaatcagatacaggatgtaaggcatttactagcctggcccctctaagactaaaggaacatagcaaacaaatacagcataagagttttgcatcctggttctaaaacaccagctgtaaaatacttggagacaatggggaaattcgaatttggattgtatattagatgatattagggagctattgctaatttacttaggcaggaaaatagtattgtagttttgaagagaatgtcactaagcatgctgaagtgtttagggtgaagtgttttaatagttaatagattatttttataacactttttattcagaaataccttcaacttcacagaaggtttgcaagaatagtataaagaacccctgtaggccaggcgcggtggctcacacctgtaatcccagcaatttgggaggctgaggtgggtggatcacaaggtcaggagatcgagaccatcctggctaacatggtgaaacaccgtctctactgaaaaatagaaaaaaattagctgggcatggtggtgggcacctgtagtcccagctactcgggaggctgaggcgtgaacctgggaggtggagcttgcagtgagccgagattgcgccactgcactccagcttgggcaacagagtgagactcctactaaaaagaaaataaaaaataaaaaaaaataaaaaacctttagatcctttacccagatttgtctgttgttataatctgcaacttacttttctttctttcattcttttccttctttctttctttcctctttctttctttctctttctttctctccctccctccctcccttccttccttcctctctccctccctccttctctctctctttccctcccttccttccttcctctttctttctctttccttccttctgtctttctttctttcttttcttttctttctttctttctttctttctttctttctttctttctttctttctttctttctttctttctttcctgctttctttctctttcttctgtttcttctctttctttccctttctttttttttttgagatagggtctcacttttgtccaggctggagagcagtggtgcgagcacagctcactgcggccccaacctcatgggctccagtgatcccaagtagctaggattacaggtgtgcaccaccacgccaccaatgtccagtttctgttttaaattcttttttagcaacagggtctgtcttgttatattgcccaggccaattgtgaactcttggcctcaagcgatctttccaccctggcctcccaaagcactgggattacagatgtgagccaccttgcccagcctgcaatttacttttaaaagattcagccatttttatattcataaatgtgtatgtatacagcaaataaaataacaactgttgaataaagatagtaggcatatgggtttttattggaatgtttttttcagtgtttttgtgcatttgaaagttttgtagtaagaagctggggaggagccctatttcaaacgttggaagatcttcaggatatggtgtcaagtgaacgaagccctacacagagcaggatctgttgtgtgtttctttgtgtttaggaccggggtaaaaattaggatttatatttgtatttgcttgtaaagaggctgagacactaagagaagagtttaggggaagatagggaatcgggtggatgggaggaagtgggaaagggaccgtcagtgtacatctttcatgccactttgattttgtaccatgtgaatcaaatgtcttttaaaatgcaattttttaattaaaaatgattgaatgaaggaataaatacagaaatcagccaggaaggaaaagagaaaaagaaaacacagccagatgagaaggaggagagccaaggaagtccatttccagtgcaccccatgacaaagtcagcaggagcatgtggtgctgagtgagccaagatctcggaagaggatggggtaaaggcttactggggtggactcagctgagggtcgcacggagcctccagggctggagagagaatgtaggtgggaaaagggccatgagtgtggaccaccccttaaggagggaggggaagagggcagcttgggggctgtggatgaaggagggaggatggggatgcagctggcacagggagcaggctgggccaggagtggtcggaatcagaaagggggatgcttccaacgtagagggccattttagactgtccccatgttttcaaaaaaatgagtgatactacgtccccagggttgtgaggtaggattgcaagttttgggagaatagaaacatacggaagagatgcccagatgagcttgtttggagaccaagcctgtgggaagagggagcctgacactgggcagccctggtgttgccttggctcagcgtttgtgtgcagccagccctcaggctttagagtgtggaggagcagcggctgcatccagagagatgttccacatggaaatgcggggtcatgcctcaaaaattcaacacagaatcaccatctgacccagcaaccccacttctgggtatataccccaaagaattgaaagctgggatgtgaagagatatttgcacacccatattcacagcagcatcattcacaatagccaaaaggtgggaaccgtccaaatgtccctcgacagacaaatggataaacacaacatggtccatccacagaatggaatatgctgcagccttaaaaaggaaggaaattctgacacacacgactacatggatgcaccttgaagacactgtgctacattaaataagccagacacaaaaagacaaatatggcctgattccactcaaatgaagtccctagagtagtcaaatttatagaagcagaaagtggagtagagggtgccaggggtgtgggggaagagagagtaagaaggaaaggggagttggggtttaatagctagtatgagtttgccagggcttccataacaaaggaccacagactggggcctcgacaacagacatttattgtctcacagttccagaggctggaagtccaagatcagggcatcagcagggttggtttctcctgcaggctctccttgccttgtaaatggctgccatctccctgcatcttcacataatcttccctctatgtctgggttctaatcccctctccttacaggacaccagtcatttggattagggcccaccctaaggacctcatttaacttagtcatgttttttaagaccctgtcttcaaataaggtcccattccgagatcctgggggttagagcttcaacatatggatttgggggacacaagtcaacccatatcaattggtatgtagtctcagcgtgggaaggtgaaaaagtacagggttgcacaataatgttgatgccactgaaccttacatttaaaaatggttcaaacagtacgatttatgttacggatatgatagcacagtaaaaagtaaaaataaattttaaaagagaaaaaagctcagaagggcaaggaaagggggagtgctgctgagagggtagtgggactcccgggcccactgggatggtcagacagaccgtgggggggcgactgggaaggtgggtgtgggggaagggccagtgggaaacacgggagcttggggcctgacagcaggagggtctccaagctggaggtctgggcagcctgtcagttccaggtggtgaccgttattactgcagcagcctccccagaggtggcagaggcttaatgagtgcttcaggctctcagcagggaaggtctgggcagcccctctggctgtgtggtcccagttctccagaagcgctttcttttttgccattttcaaaccatcacagctgctttcagcccgaatgtgaagccacagccagtgagttgtttctatagcgactgatgtccttcaaagagggagaaagtggagggccctaaggaaagaacaagggggtgaacagcacagatatgtgacagattaaactcaagagggagagaatgtgacctagtttcactgcagcttcgtcgagacgctttctggcaagcacacccgatgactacatattattttatgtttgtcatattatcttcacctaaaactgtaagatgaggggctgagtgtaccactctacctagtgaaaggccaatattcaggcacagctgccaggggcaaggaacagggaaaatgcaggaaaattctgagccttcttcgtcttactcccggctgctttgcagaacactgggcatgctgaggctctctgtgtacctgtgctttttcccttccttggaaaccacccccaagggagcctttgtagtaggtacaccctggctcgttgcttcctagtggtgtgatcttgggcacattcctcaaccactctgtgcctcagtttcctaatccataaaaagtggggagaagaattccaacgttcaagagtggctggaaagggttaaatgaggtgacacattcaggcgctcaggagagagagcgattgcagtgaggagaactctgggcttgtgtaggagtcgacctggtaactgcagctctctctcatctcccgttcctttccagttggccacggacagagcgaaggggagaggatggtagtgtctgacttccacgttttcgtcagggatgtgttgcagcatgtggattccatgcagaaagactaccctgggcttcctgtcttccttctgggccactccatggtaagcagaccacagaagacccaggttaaatccaccctggcttccagccttgcagggggaagggggtggccctgacttcctgccccccactgctctctgcctggctggcatgatgtctccctttgtgcactgcacttggagttcctgggcaattccgtgcttaggaaacaagggaggctgccagccggtccttagtgagcagcttgaatacggggcctcttggaaaactgatctttttctcaacgttctttggcccacttggtgccatttcatagtgaggctgctaagagccacttcttggaggggggaatagctccttcatcaataagaagcacatgaaatgtccccaaaccctgtgtgcttgtttcagaattgaactcagatgacaaatgttaactagggacagagggtccacatggaaacaattccttaaagcttattccaactccttccaccttttaaatatgtaaattgagcaaatataatcttaaaatgtaatcgagcaaatgtaatcttaaatcggggtccttaaactggcagcccacaggccaaatctacctacagacaaagcaggctggttggctgaccaagatatattgaactgcttgaatttgaaggcctggggacatctgaccagggcaggccttgcctcctgccccatggtcactgcctggctctgtccttacatttctcttacctgcccagccccgtgagcatttgcggttgcaacccttgcttttaagcacctttgtgcttcagcaaacaggtgaggcctctctccttcagcaccatccacgttcactcccatttttcttggaatttaaatttctaggacctttactaaaccaggaaaaagtatagtatagcaatctattattatgatcagattaccccccaccaaaaaaaaaaaaaaaaaaaaaaaccctcctattaagcctgtcgggatggatgaattggggttttgccagctttgggcttgaaatgaagtgggaatgtgttattgtttaacttgcggcccacaagcaggaaccttatttatatctctctgaaatgtttgctcttggaaaacccagagaaaaaaacatgtataataaaataattgcagatctagtttagccaacatttgatggtgcctcttccaaggtagtcctcctcagggctcttggccaggactgcagcttaagaggactgcattggtcatgtttattagaaatgtgtgcactggtgcaagccgaacacagcagctctgcccattctgcattacagggaggcgccatcgccatcctcacggccgcagagaggccgggccacttcgccggcatggtactcatttcgcctctggttcttgccaatcctgaatctgcaacaactttcaaggtaaaaggaccttccagtctgtacaattcctacaggttccccgggacatgggtcttccatttgtagcctgagtctatgtaaaaagaccaaaggccatccttggacctcagacactattgcgtgaggggttggacaaatatccaacactgttgccaccggggttctgtaatttctaaaggcaggtgccattttcccccaagacaaaaagacaatgccttcctgtttgtgcatgttttattgatgaattttaaaaggagacgaggttagacttgttatttgtccagcaaagtcacgtttgttaacaagtcacactcaaggcctgggctgtttttcactgattatttgccaacttcagcagaaagtgaacagtgagtggaactgcaggcactcctaactgcatgcagtatggagtcgcatccactgccgcgctcctccgccccgggcacttttgacctctgactgttagggatccgtgattttgtttttctggttggaatgacccataggaatgatataccctgtaggtactgggactctgggctgcttttgccaaggcaaatgaaccaacaaatgatacctagaggtggagcaggcaccttctctccccgagaaaggagatgaaaccagtggcctcggtagggcggcttgcttgtgactctggcttgttgacaaggtatcagtttagacccggccttgggggcatcaggcttaaggtagatacatagccgcagtgagggtggagaatcccaaccccacgtatccacaaggaatcctcagtctcaccccagtgctgggcaggggctgctgcctcctgagtcagttctggagactctcaaaggagaaagaggtgagatagtaggtcatggggccaggtgcactgggcagccgtcacccacaggcttaccctatgaactgtgggatcatttaaataatgacattagctcttattcccccaccgcactctcttcaacacagtacagggaatgaaaccttataacaacatcctcaaagggtttccttcagcccatgaccacagacttgctcctggctctagagacaggctttcaattaaaaacagaaaatttcagccatctgaaatggggctcggcttggcaaaagagaaatcagggactatctgatagtttagccagagaacgatgatttacttagtttgcgagagagatggatgatatctcctttgaattttactccagtttaaggaaatcacggacttactgaaattgactatcatgaatgaagttcagtgctgtgtgggacagtaccagggttctgtcacagagtgatcgaggtcccttagcatcacaatgcccggatgtgcactacctcttcatcattgaaacgtgcgattggggggagacatgacctactcaacatctcccgtgactatggttctaattatctaagtagaataagcaggcccagactcagcagcaggggcgttcccgctgcgttccatgggatttgctatatgcaggtctgcaaaattcagccaatgccaggcatgcactgtgctctcccaggcattgtctcatttaactcctctccagcccaggagcaggttgtagcagcactttccagatgggaaaacctgggcttaggaaagatgaatggctggccaggattgtgcagcccttgtgatgggtttgaatccagggctgcccactccccatctaggatatttccccagggaagaaaatggatgtttctgcaatggatgttttcccttacagaaaagccagggcccacaggacttttcagataaagtgcaccagggggacctggcagctgggcctggaggtgggaccaacaagggtttcctcccagagccccctgggctctataccgaccaggggagggggcacttctgggcaaggccaccactgtgacctttcaaagacttgtgctaatagatcaccttgtgacattcggagccagctgcccctgggggaacacaggtctcctcttattaaccaagacaaatgaggtttccctttgccccagacttgagggcccagcttcccctccctgagatctgttgctgctcctgcatctctggcaattttggctgacaaagtccatgatgcattcgtccaccctgcccctggaaggcttcatcactcttggcacattttctagtctggtctgacaaccttcctgaaagtctcacaggatctattttttaatgtaatttaaaagttttaagaataagacatttctatggttcaaaattcaaaagatatgaaggaggatgcagggagagtctctctcccggttggcgtgggcagcaacccatggtaccagcgagagtctctgcaactcccgtcaacgctcactccatttgttcttctttttcacacaaatgggagcttgctccatgcatgtcgggggtactctgtgtttgcttttgttgttttggttggtgtgtttgtttttgtgggttttgggttttatttggtggttttgcttagcaaccttttggtgctccttccccatcaggacctaccaagggtcccactgcagggataggtcctggtttcaggagggtgccctggggtcatttccagttgtttgctcttatgagcctcaatgatggaacaattcctagagcccacctcctccctctagcgttctgtttgggaaatctgtttggtggtggggctgaggggcttccctgagtgtggctgtgagtggtagcagagcacagtcaagtcccagcctcctgactcctcagacagtgttcaatccatcaagccattcaacagtttcccagcaccaggcaccttctagagcaactcccccagttagtaaggggcagcgtgagatgcccagtctgtgagtacagtctggcctgtggaagacggccagcccccaccccctgcaatgtgagaacgccagatcacccccaccctcctaaatctcgccaccatctggttcttatgtggatgctggttttcaacaagctgggatatatttagcctggagatgagacaatgaggatggatgggggggccccaaacattgtctctgctgagaaagtggtttcgcaaagtggtagcagcagaaattcagaaacaaaaactccatgcatctgaacaaatctggctatttgtgaggtcactctgtggggtttttcaccatggctcgcggctcgtgcctgggtacagaggtggaactgtggccccccagctggaagagtgtaaagctccaggtgcccctcgggatttcccacccttagttgtctgggacagcactcaggagcaactgcaggctgcagggcccctcctttctctgggagcctcttagaagagaaaaatccctctgggctaagcttgagggatgggggtctcagcctaccaggagagtaatcattctaaatgacctctccctgttgccaaggttgtcccttgggttcctggggcaggggtgcaggagtcagccagtgcttcaagatactcccactctccgccaagaagggcacctcgcccagtagggagaagggggttgcccctgggagcccagcactcggtgcctgacatgcattgtctccattcctctccagcaccgccctggaaggaggggaaattattcccaatttacagacaaggaaatgaggccaaatgtcttgctcgagtcagcttgagcaccagctcagaccagctagcatgccaggataccccctttcaccccaaaacacacctgaaatcagcttcccttaatggagcccactcccatctgaatgtcactcatctgtttttagccatagaatccagaaggcccttggggcagtgggagattgcagggagggaggggaaacaagtggaacatggccactctttcaagcttcaggtgaatttggacccaggatcccggaacttagccatgcactggccctttgggcagcagcaatgagctgccgtgggggttagttcacctctgtcctgtgggcacctgctctctaatagctgggtgttgggctttctagacacctgttattccaggaatcagctgtcttcctagcaagcctcctgccacacatctttgctgagcccctgatctatcaggaaacaaatgtcctggccttcccagcaagggtcactgggaaaggggcacagcactttctgttttatggctgccttaaggtgtcctctcactctcaagaaaatctggggcaaccctgagggtacctgctgtgtcccccacatggccgtcctatgacccttgtcatagtgctgtcccacggaaggtggggagtcctagcctcctgcgcacaggtcagcctgtgggagccacttaggaaacagcatctgtaattgccttcctcatggcaaggctttcactggcagaagtgaaattcacttagaaatgatcacagggagccattaaaaccttctggatcaataaaggcatttgtgcctgtctctagtatttaaagtgacaggcgtgatggtgcatcgggaacgcccctcaagcctcttgctcatcaagatgttgacttcagctgtgggacagttgccctatttgtggatgactgtgtcatttgttgcaaagctgcacgtcacgtgcttttcctgaagtctctactttgaatgacatttgctcattcattcagtcaaccaacacctatttattgggcctctccttagggccagaagccaggaagagagttagggacctgctgcagagcggttgagtctcatgcagctctcccagcatcccttcggagttagtttaattatccctgtcttacaggtgaagaaactgagatcatagactttctcgaggattcagaatcaaagttcaaatccaaatgtgcctgcttcgcgtctccaaatctggtttctccatttcatcgcctgtcccttccggggttggggtctagtgactgtgtagccatttgtcatgggttttggccccaaattatcctcaggcgacgacccctggggtctgggttgagctggcataattgggagctctgtggttacacaaacctggtttcaccagggtcatggggcaggtgcggggggtctcacctcaatgggggagccatgcaggggctcctctctcctgagctggatccaaggctctctcaatgctcctgtaggactattcgaggattttgaaacacttgatggaaaaggcatcaagaatgttaaagttttggattccacgtcctttttgggtgagcaactcccctctgaggcttccctggtgtgctcacagctcaggatggaggttgtgggagagcaggagcagcagtcatctggtcgacctcgacaatgtgatccatctgggtgcgggacctgccatgactccttccttccccactgcttcctcgtcatgccgcctcaatggcccctgctcaaccgttctgctttccttcatgcacaatcaacccacttcctctgcttagctctttctcctcccatcctaccctttcctccttcaggagagattaggctcatgaaatcaacaaatcttaaaagagcagcagggaaaggggatctcttttgcagttgttcaaaacatcctgcccctgcatggcagctctcctctttcttggggcttttatggggaagaggctaaacacctaatttgttttaagccatgaagttatcattaaaatatttgcctctacacaattgagtcttgttagaaatatggcttggaacttactatgcaggtttagaaaaagagctgaagatcagggctatgcaaacatctcttatggtggttcctttgaaagggcagcttgccctgcagggacgtgtacacctccatcctagccagtgcctgtcagaggcacttctgctctagctgcacacaggatccctagggaactttaaaaaggccctgatgccagggccccactttggccaatacaatcagaatctctcagggcagcactgggaggaggtgtttctggtgtttcatggacacacacactgccagcccctgagacttcaccacgcacatgaatgcccaggagccctgtgaagctacagatcctgacccagaagccaggtggccctggagcccctggcgctgctggtttgaggaccacactgagcagggaggccctgggatgttgggatgggtgtgctgtgcccgctaccatacgccaactggattgaaggaacagaacagtacaggcggttccatcttcctgggaagacagggagttacagatcgttttaagggaatcccaggactctagaagtctccttcatgggtttctctttctgcacctttcctgtgaatggtgtatccacccgggtcccctcctgcctctttgcacactctctgtggtgtaacttgcacccagggcttcagcagccatctatgcactgagacctttctgttcttggggtggcattcctcgggatttagtgccaggacacacctgtgtgcgcattcactgggaaaagtctgcagaatctacaccaggccttcctggagggcgtgttcctccatctacattcgtgatggaacaaccagttattgtcgccgggacaccagtgcctcatgcacaccatcagccacgggagttttactgttacaagcttgtcctcttaggcacattccctcatcctgaacctgctggcagcagctcctttaggggagcgagggtggctgcttgtcccttccgtccttgggcagccagcgctcagctggatgcatgcagtggaagtcaccttctgcctccactcctgagcaggatgtgctctccccacatctcctgtttgcgctttcagcaatagatcattcacagccataggacggggaggcctcccagtccttggctttttgtacctggaaggggatggtgaggcgttcagctgccaggaatcacttccttccctccagggaccagccccttgcattgttcattttctaaagcaaatacttctcaggaagtggctctcctctttttttttttttcctacgaagctcttttcttaaaagcttactttaactgcaaaaagttccactgttcatggaggaagaaaatcaggcttgctgggtgagacgacagaatagggcttgctgtaattctctcctggaggcaggctctctctctggctctctgttcccccttccccaacctctgtgaaaccacttcaaggatggctcaagctgcgctgatccttgaggcgccaacagcctaagctgtcagcatcttctccagagcctggaagtagaggccttgtcactttttggtataaaagttttgggttaagaggtgccagcagcagaaacatatgttcaaggatgaaggtaagtctgtcttcacaaatgactgatcctgaagatggactggcacctccaggcccaggtccctgcagaatcaggtgatgggtccccaaaacacaaatggtggcacaatgagaaatctggtggtgggcttggacgaaatggtgtggatgctgggtggtctcttgctttcacctctgtggcaggcactgctgaggtgctgggtccctgggccttttcttggctctgagccatctggtcagggaatgggtaggaagctggcttacataaaacagtcatgtccctgagaaggctgtgtgggccccagcaggcaggtgggttgacctgggagcagcgcctgcaaggctggcacttgcacaccatcccgttacacagagccttcctgcggttcctgagtgtggtggggatcctcccgccacagctggcagccccatgtctcctctggctgcacacaggatcactagggaactttaaaaaggcactgatgccagggctccacttcggccaatacaatcagtctctcagggcagcactgggaggaggtgtttgtggtgtttcatggacacacacactgccagcatcagggagtagtgacagggtactgagaacagcagaatatctagaagtgagttcttcataactgtggaacacagaagtcttccctcacagtgtggcccttgcccactgctgctggaggagagcgctaaggccctggaacactcgtccttacacagccagagtctagtgaaggccacagagccacagcccactgcctttatgcactgatccactccattttctcatttttagattgttttaacctttgaaagcacagatcccaatgcagacgagctcccaattcttggagttcacagacatttgatccgtgtttgaaaataccccagtccttgtgcagagttcccagaattccaagttttcctttcccaggctcgttcttggagctggcccatgatactagctggactcttgaacattcctgacccatcacggccacccttcgaggcttccgattatgcagacacaccatgcccctgcacagtgctcaaagtcaggctgccgcatgcttctatactagacagtcaaagtcggagcccagggctcagcaaagcacctggcacagtggcggctgcagaatgagatctgcttgcctggatgccaaggctggagggcagtaagcttcggtatcctcagaggcagggggctgccacctttgcactaagaaggaattactgatttctaccatttgagaaaaggagtgttgaccacatggaactccgaataggttcatgcacatggaacaaagccctttaggagaaaagcccgttttttgctgtctgcctgatactggatggttgagaaacaatcgtggtgggcagtcacgccacacttgtgcgggcctaggacacaggaaggtttagccctggcctacagggagggtgggcaagcacagcaatcttgtcccccaaaagaacatcagtggccgctggtgccaagacccacgggaaggttagagctctgggttacatttgtggagagagacacagacagcggcagagacagagacgtagtaatccaggctgtgtggcataagaagataaagcggccccccagcccggggcccctcccatggacctcatggtaccgagcctccattttctcatctgttcagtgaggatgaagcctcatctcccagggtttttgcaaagacagggagactggccgggcgccgtggcttacgcctataatcccagcaccttgggaggccgaggcaggcggatcacaaggtcaggagtttgagaccagcctaaccaacatggtgaaaccccgtctctactaaaaatacaaaaattaggcaggcgtggtggcacgcgcctgtaatcccagctactcaggaggctgaggcaggagaatcacttgaacccaggaggcagaggttgcagtgagccgagattgcgccactgcactccagcctgggtgacagagcaagactctcaaaaaaaaaaaaaaaaagatagggaaactgtgcccaatgcaccagaaggtggttcctcggtgcctgtgagtgcccttgccctctgccaagggtactgagctacgtgccctgtgcccttgatgtacactgagaattcactgcttgccaccttccgtccaattctaatttcagcatttcacagctcacttttgaaatagcatctttcatccccaaatgtctgtgcacattgcagaaatgaaaacagcccctctctgaaggcagaagtgtgagatccgggttctctgttttcctgggaaaacaagagatccagaaggagagatgggggagggggtgggaaggtttgggcctcaatcaggctcaagttcaatgagcatgtgttaagctcctgctgtgttccctgggcttttgcacacagggtgttattcaccttccccgtggtcctctgggggagggtcaaggtcccactggcagctgaggaaacggaggctcagcgatgtggaaatcccagcccatgttcacgaggcagcagagctaggaatcaaacccagcaatccttccctctgccacacagcctcctcatcgagctggtgctatttctacttccacccgagagaaatggacgcacactttctctgtgtggctcctgtgggcccttccgcactgccctgcttcgtgctcagttgatctgtgtgattctgcacctgccgtgtattttcagtaccccagagaaatggccagagctcatcccaggcaactcttgccagtgatgcaaaattacaacccatgagcgatcatggggagggtatagagcgggcaaaattcagacgtgacttcccaccttgggcgcagcggctgcctggccagctcccccaaggtggagcagagccaggctgaatagaggctgagtcagaagggagagtccttgggcatgcaggcttaaggacgcaggcttgggagacgaacctggctgatgttcagtttgggcatcactctccttaatgtactgtaaactgtcactgcggaagagccgggtgtggatgccacttgtgctcacagcccttgttttccctccccggctaggtccttgctgcgaaagtgctcaaccttgtgctgccaaacttgtccctcgggcccatcgactccagcgtgctctctcggaataagacagaggtgagaggctttccgaaaccccaggggtagcttgggtggctgcccccatggggaatcagagttttggctccagccttggcattctctgctgccctttcaccgaggccctgtgcaaagtgacaaggacacagtggtgcattagacatggttggcttcaggtttgggtgaaaagggtgggttggctatgatgcctgagctgtgttctaaacatgaaaggagccaacagtggaagttgagtgtgtgccagtcaagtctcttggttgcaagagacagaaacctacatcaaagtgatttaagcaaaagcagggattttgtggtgaatggaactgaaggcttcagacatggctggatccagggcgttgaaagtcttattctccatcggtctcttcccagctttcatctcccctggtttggcttcattcccagacaggctttcccccagtgaaggccaagagggccaccagcaggtttacctgagcaaccccagtggaaaaacagcacctctttccagcaaaagtctcagggctgattcttactgactgattatccaggcctggattatttgtccaggaaaggggggtagtatcatccccacccactgagagtagaggaaggggatccctgggggtaactcagaatagtggtagcaaaggaaggacagacccatattgcagatgagcaaactgagccccataacgtgggatgacttgcttggggtcagccagtggtgaggctagcctgggaacgtgggtaggtgtggtctccagctgtgctctgtctgggtatgggagtgggcttgcagttaatgggtaggaagcatccagaagacaccagcattatcttcatgattaagcaaataagtttgccactcttctgcctcagttgccctcttgctttaggagtttgaaatcattgaatcactggctccctaaatcactgaatcactggctccctaaagggccctgggaagtggagtgcagtgctctagcattctggggatgttcccagacttccttgggctgttggactctagcttcattataaactgtggccttctggccctctgagtcacttagagagtgggcaactcaagaggaatagcccgtggtgtgtaggaaagagactttctagatcaggggttgaaaactcctaggcctctgagggccagctgcttaaaaatcagactggtgagagattctagcaagccatgaggcctgtgtggagccagagggcatctgatccatccaacccatccacattaatttaaaattctaatataatttggtttttaaagcccacagtgcctcccaaacctacatcttggggccaggttggacccattagggaccagtgtgtggcccctggtctttctgaaagaatatctgaataaaggaaaaaaactttaattccaaaaagcagattcatacagtgaaagagcacaactttaggacccagaaagaccaaagccaaatatacactgtttgatttaatcctgacatgaatgagatcgacattaaccccatttcacagatgaagaaactgaggcttggagaggttaaataacctgttcaagattgcacaactagtcaggggcagagatgggattttagcccattttattcaaaagtccatgctttggtgcctccctctagctagtaattatggtcattaagctctgtttcctgttttacaattgattgctggtccacgcagcccatggccatggccattgctctctgtacgggacccactttgacagggaaactcagtgtggggcaggggctcctgcacctgcctgcatccctcataatggctctagcttgaaggtgtggtgtctggtaaaaccagtgatctttgtagcggcagtgccaggacaacagtaggtttgagaaagatgggtcagggagggaggggcctccctttaagacaaagcacccaggtgcaaatccacgttgtttatctgaacacctgaaaatacacgggcaaagaggaagaaaaaaacaggtactaaaaagagattccaaaccctctctatttaaaagcatccaatttcagatcttttctctcctttttgcaataatgagaaattcttcggtcttactcaggatggaagcacctggtggggctcccctcctctgttcctgccccacccacagcccccatccgagccctcctgcctcgggtttctggctgcccaggtcatcagttatttagaaacactaataaatgtccctgctgagaagacatgaggaagggaggtggccggtcagccccaaggctggactgcagttggaaaaatcaagagcacgcctttccctccctcgcctgccgcagctctgcgtctccctctgaacgttctgctgagctttaaaaatagcaacgctgaggggaaaatgtgttgggaaaggcatctaacatcggggtgtcttgaggcacatctttagctaagacatttcccatggaaccctgcagctataaaagcctcaaaccaaaaagaaatgtttgcctaagaagctgagtgagcaggactatgggggatgggccactggccgggaatcgagggtgcaggggcctgggactcaagagtgcacaggccccagggaagatctggaattctgtctgaagggaagcgggttagctctgttgccagaatgtcagaagcagaatgtttggtgtttgctgtgacaagcattctcacaacccacccaggactgctagtgggctctcttcacttgcgtcgccccaaagctgccaccctatagagccacattctcgccgcatgtgtgaagccttcaggaaaaaaggcataagaggactttttattgtctcaacactacccaatgcacaatgatggcatcattcttctgtgccagacactagagcccttctggtctcaccatgaccccaggaagtcagtcttattaccagcatttgtagttgtagaagtgtgggcccagaaagggcaagtcacttgcccaagaacacagctactccgggccaagtgcccttggcactcaaacccagggaacaaagaagttgctacacagacatttattatgtttgtcaatatatttagggtccctgatcagaacatcagaatactgacatggtaatcattccaccccaaaaaggctttatcagaatgtgatgaatcccttcctactctgagaagccttgaacgtgattctaaagagttctatggccaaggacgctgtgggaggaggtgaggaggagaggttgttcagcatctgcccatgccctcagccatccacatactcaggcggaatgcactgcttcctctcccaggctgtggaaggggtggaggcgggaggcagaggccatgattctgagcacaccttgtgctaggaacctcagctgcttatctcctgaggccacttgtcttctagagcccagtctctgttctttataagtaccctgggaggcccttcctgcgcatctgctagtttatattccctcaggcaggccatatgctgagttctgagcacccgggagccatgaggagtggccactcagcttccttttttgtctcctctgcccggtgtttcggatgtgcccaatgtcgaggagttggctccaggtccccctgttgcctgcctgtcctgcacccatgctgcccagaggccctcggaaggctcctgccgggtcttggaaagctcggccgtgctgaggccttcgacttaagcgtaaccacagctaaagatgggcttcagcctcccacactgtccccaggacacagccttccacgggagttccctccgagaacgagctaagaaccttccagcaaactcggtttggctagcagattttattctgtggctctctatcgttcatcacttacattccccacagcatatacttgtctatttgagacagtcttattaccagtatttgcagctaaaaatttcccaatgccctaaaaaaacaacaggcactagaaagtctcttgggcatatggctccatgtggggtggtggcgagggagcgtgtgaattgctctacgttgcttttgcgccctgcaccaccctctgtagatgttccagctctggacccgctcccagtcccactcctgccggccaccaaggctgggagaaacggctgtgagctcatgacaggcagatcctggaagtatgatgctttaatggcagcagaaaaccagggactgcagagactgtcagggaagccacagctgccagcaaaatacaggacacactgaggagttctctgtgtccagcaggcccaactgagcttctttctcagtacctttgtgggtacgtgggacatgcacatagtagggccttggcagtggaggaaagaaagatgtgggctcagttgggcttccgtgggaacatagcctgggcaaagctctctcaaagacacctctcagctgttgtgaataacgctgctgtgcccgtggcggtgcagatatctactccagaccctgcttccattcttttgggtatgtatgtacccagaagtgggattgctgggtcatattctgctggtaattttggaggaaccatgctgccattttccacggtggctgtgccatttcacattctcaccaacagtgctcaagggttccagtgtccctacatcctcgccaacactagttaggttgtgttttttgatagtagccatcctaatgggtatggagtggcatctcagtgtggctttgatttctatttccctaatggttagtgatgctgagtgtcttttcatgtgatttttggatatttgtatgttgtcttcttcttcttcttcttctttttttttttttttgagatggagtttctctctcgtcgcccaggctggagtgcagtggcgcgatcttggcttaccacaacctccacctcccagattcaagcgattctcctgcctcagcctcctgagtagctgggattacaggcgcgtgccaccacaccaggctaatttcatatttttagtagagacggggtttctccatggtggtcaggctagtctcgaactcctgacctcaggtgatcagcccgcctcagcctcccaaagtgctgggattacaggtgtgagccactgcactgggaccttgtatgtcttctttagagaaatgtttgttcagatcctttgcccatttcttttctttttcctatttcttgtctattgtttttctttttcttttttttttagtttaatttaattttaagttccaggatacatacgcaggatgtgcaggtttgttacataggtaaacatgtgccatggtggtttactgcacccagcaacccatcacctaggtattaagccccacatgcattagctatttatcctgatgctctccctccccccgtgcccctcctcctgacaggccccagtgtgtattgttcccctccctgtgtccatatgttctcattgttcagctcccatttataagtgagaacatgtggtgtttggttttcagttcctgcgttagtttgctgaggataatggcttccagcttcacccacgtccctgcaaaggacatgatcttgttcctttttatggctgcatagtattccatgatgtatatgtaccacattttctttatccagtctatcattgatgggtatttgggttgattccatgtctttgctattgtgagtagtgctacaataaacatacgtgtgcatgtatctttataatagaatgatttatattcctttgggtgtatacccagtaatacccaaagggattgctgggtcaaatggggtttctgttgtcttccacgatggttgaactaatttacattctcaccaacaatgtaaaagtgttcctatttctccacagcctcaccagcaactgttgtttcttgactttttaatgatcaccattctgactggcgtgagatggtatctcattgtggttttgatttgcatttctctgatgatcggtgatgttgagctttttttcatgtgtttcttggccacataaatgtcttcttttgaaaagtgtctattcatatcctttgcccattattgatggggttgtttttttcttgcaaatttgtttaaattccttgtagattctggatattagacctttgtcaggtggatagattgtaaaaattttctcctattctgtaggttgtctgttcactctaatgatagtttcttttgctgtgcagaagccctttctgtgcagaagctctttagtttaattagataccatttgttaatttttgtttttgttgcacttggtgttgacattttcatcatgaaatctttgcccgtgcctaagtcctgaatggtattgcctagattttcttctagggattttatagttttgggttttacatttaagtctttaatccaccttgagttaatttttgtatatggtgtaaggaaggggtccagtttaaattttctgcatatggctagccagttttcccagcactgtttattaaatagggagtccttcccccattgcttgttttcatcaggtttgttaaagatcagatggttgtagatatgcagtcttatttctgagatctccattctgttccattggttatatgtctgtttgtgtaccagtgccatgctgttttggttactgtagtcttggaatgtagtttgaagttaggtagcatgattcctccagctttattctttttgcctaggattgtctggcccatcgtttgctttgctcatttcctaattgggttgtttgttatttgttgttaagttgcaggagttctgtatatgttctggatattaaccccttatgtggatattaaccacatatacaaatataattcgcaagtattttctcctattctgtgggctgccttttccctctgctgataatgtactctgaagcataagggtttttttctttctgatgtagtccagtttatctgtttttcttttgttgcctgtgcttttggtgtcatatccaagaagttgttgccaaatccaatgtcatgaagtggataccttgttttggctgaaccatgtgaaagtaaactgcagacaccacgatcctgaatgcgcctgaatacttccgcctgggttgcccaagaggaaggactcaaaacagaggctttcacacaggaccccatgccattatcacatttaggaaaagtaacagtcattcccccttgttgtcctcgatctaatccatgctccagtttccacagttgtcaccatttaagacttgagactgcatgattttgctgttctgtgatcagcagttatgaaagtggtcctgcaagacctgggaattctttcttgtttctcttattattcctcaaatccctgagcctgtgagaaggcagagaatgtggtggctgctttttcctttcccttggtggtcacctaggagcacttctgtgttcagagccacattccagggccctccattccaaaggacagaaagaggttgactttttgcatcacttctggttgtgaagactctgaagccctgcagaaggaatcctgggggaggagacagtggtggggcggggctatgcaaacagctctccccatttgccggggctgcgacctgcagagccattcctacctcactgctcttaaaagtggatgctagggctggatggacgcggtggctcatgcctgtaatcccagcaatttgggaggccgaggtgggcagatcacctgaggtcaggagttcgagaccagcctggccaacatggtgaaaccccgtctttattaaaaatacaaaaattagcagggcatggtggcgtgtgcctgtaatcccagctactcgggaggctgaggcaggagaatcatttgaacctgggaggcagaggttgcagtgagccaagatcgcaccactgcactccagcctgggcgacaagagcgagactccatctcaaaaacaaacaaacaaacagatgccaggatgtccaggagttcaaaccttcatactaaaaagtaatttggcggaaagaatgctcattaatttgcatacccttgattaagtggcaactcagaattgtaggctgatccttgattatcctctttctgtccaaaatggcactgcagcttccaggagaggagaatgtggagcaacatcttctttccaaatggccctgatctggttcaggaatttcagccactgaggctgggcgccagctggggctggcccaaggcagggtaaggtcactgtggggactcaggcctcctggtaggcagggcttgcttgggtctatcgagccggggaagctttctgctgagtcaggcagggcctatctcccctctgccaccctgcaggcagctcaccacaccaacaaactttctcagggttcccactccagccaggctagagctggaggctgtgacaccccatgagttgccctgttgtccctgccagccaggcccatcaactgcagtggcccagaggggaaagaggcggtaggctcagtgggaagagcacaggcttccaaaaggacctgagtctggaccccgctccatctcctcagtgtgaccttggaagccacactcagtcttgcccttcctcagatccctccagatgactgcacagccacctagcacagtgtggaccctagcaggtgagagctgttgctatcacagctctgagagaggcccactgaaggaggtgctggtgaagatacaggagcctggggagagaagcatggatgttggcgagggtgtctgggcacctgtccacaggaggaaatgcttaacctgggctttgaagagaaggaacagggttgctggcagataagagaaaggccgtggaaggggatggtggaaacggagatatcggggccagtctgtagtgcagacgacaagcacatgaggaaaggggtctggggatgacacacacgggaccggggaaggctgcctgcaggaagggcagctgagccgagggttgatagggagggagaaactccacaggcagccaaggaaggggtctgaaggctgaggggacatgctgtgcaagggccctggggtcaaggggagtggggagtgttaagggagggcagggatggaggtgtcccaggccataccaagaagttaggactttgccctgcagcccccatgggaagcaccacagggttcttcacagagggagacaggtacagatctgtgagtctgaaatgggacttatctctgcgtgacagggacccaatgccgtgagccctctgggggctgacagcagtggccagggtgctacaggcttgggagggaatgtgtgggagaggaagcacgccatggccacgccaagcacagctgtttccagccttcagcatgttccaaattcaggccaacttccacaggacattgacgttgttttttttgttgttgctattgttgttggtggtggcttttttttttttttttttggaggcagggtctcgctctcttgcccaggctggagtgcagtggcgtgatctcagctcactgcagcctccaccttttgggcccaagcaatcctcccacctcagcccccgcagtagctgggactacaggtgtgcaccactataccaggctaatttttgtattttttgtagagatggggttttaccatgttgcccaggctggttctgaattcctgggcccaagtgatctgcccaccttgtcctcccaaagtgctgggattacaggcatgcaccaccgtgcccaggctacggtacattcttatttgcgtttaggatattccataggcctggggttcagcacaatgcactgaaggaaagcaatgccaagcggctccaaaagcaagctatcggggctttccacgtgtgcacgcagaaaggccattcactgaatgaaatgacaagggcctcccctttcgagggtcctaagtctcattcccattgtggacactgtcttggccagcaggtggccagcggttgccagctgccgtgaggtctgtgctggcctctcagtacccaaaggtgctacttcttgggctggattagggaatggtttgcttattcatccattgcaccagagtttaccaaaggcttcccctgtgccagccaccgtgcaggccatgcagaggacaggacagacagagccctgaccctcacgtggggcagacatgtgggaagagatgtgctgattgcagaccaggccaagtgaggcatgggagaagggttttggggcagcagagtctgtgggggtctgggaaggctgagctgaggcctgaaagcggagtagacaatgttaattaagctaagagcaaggggctgaaaagctgtttgtgatgggagacagaagccatcacaggaggattctctcatccagctctttccaccacaaattatgtctccggccattcaagacaaaggtgggaaatgaggacatcgtctctgcaaagacttgccagtttttgttagggttcctgcaggtttctaaatttcacagagatcactcaggtagagtgtcatgcactctttctctattatgccagagaaggctatccgagttccctgtattggaaatggatggattaagagagatctaaacaatggaggaagaaggtgggaattccaggatgggctctaaagcccaggtggaagggtgacgcttccgtaggaaaagggaggagattgcagggaaggaggggcaggaagagccagctgtggacagatctacagggatgaagcctgctgggttgtatttctctgtgattaggggtgcatccaggagggcacatgcctgtctgtgcccagaagggctcccctatcccctctggctggctgtgaagggcggtaacccctgggccccaccagatcacttcaccatctgtcaggcccatctgcttatggtcctcatcagggaccattcctgccttttctgagagcactagtgcccctgccacctgcatagctcctggctgtctatgccccagcactgaccttcaccttctcctctcgagacaggcagcagagcatggtaagtggctaagaatgctgatggcagtggcagagtgcctaggttcttaccttggctctgcctcttgctgtgtaaccttgggtgagtcatctaacctctctgagcttgtctcctcatatgtaaaaaggtaataataatagttcctacatcacagggttcctgtgaagattaaatgagcaagtgcgagtgaagcacttactacagcacctagtaaagagtcaagggctccacgcattagttatttttcatagtattctaattaaactctgatattgcatttcatcatggaacaatttaaaaaaaaaatgggtcaagagatttgactgcaggggttgtgtctagattttgctcaaacgtaagtgtaagaaaactcccagctgaggattgcagctgtatttactgtacttcagtgcaaagtttcttcccacagagagacagtgctggaaattcagaagacccagctggtatattcctggctgtcaagctcaacaggaggccagcttgtgaaacttaaaacccaagaggaggctttggggtcccctgatggggaaactgaggcccaggaaggcgtagagccttaccatactcccaacccccaccccggggaaaaaaagacttcaactctcagccagtgggggctccccaggaaatcagttatctagagccatggtgggggtggtcacttggacctgggtccccagcttgggctcctgcttccagctgccatgtccccagcagaccctggtctcagctggtgggagccatggtgagccaaacaggaaggtggcggtgtgagagactgtgccaaagcctgggcctttgttacttgttcttagttaaatttttcatttaagatcactgtaactcacaagcagctataagaaataatacagagcgattccatgtacccattacccagtttcccccagcagtgacattttgcaaaacgacaggacaatatcacaaccaggatactgaccttgacacagtcaagtcacagatggctccatccccacaaggacccctcatgttgcccttttgcagctgcatcccctccccactcgccccacaccctcctcagccctgagagccgtgagtctggtctctgtttctctagttttgtcacgtgaagaacattacatcagtggaatcatgcagtgtggaatatttggggactgactctggtccctattgaatgaatgggctcatgttctgggcttgggcctggtttgggaggaaggggcctggctatctccttcctgggagccacaagccacattcctaggacttttggtggattgagatcttaagctgtcaaaaaatcaaggccattgtgcttgtgccagaactgccacttgaggggagggtttggcccctctgtgcctcagtctccccatgtggtacagccctccccaacctcctggtcccagtttccctctgcccctcacctccggtccaggctgtggttcacatcaggggcctgctctttctctgacacatctggtggctgggccccaggcccagaataggccattgtgtaaacagggcctacgtgatcaagacatggaaaacgaagccaagagcaggaagccgcttgggccgtcagtgcaattaaactcagaagcagagtccccgagcgcctgctgtgcccaggacacttggggtcagcggggcaaagcagcaggcctgctgcaggaagaaggtggttgtaagacatcgctagcaacaggggcgagggtgtggcccccaccccacaggtcccatgggagccctggagacagcatgggatggggtggtggcccagcccagggcaccgccagcctgctggaacccatacccccaacaacagcagcttaaccaagagagggggtgacttcttggcatcaggacacccatcttgttgctctagcttccaggggcgaaccttgtccacacggccctgactctttctgtggggcaaggagaaaataagccgtcaacccagaatgtgcacacagcccctgcctgctttctattggccagaacgtggtcatgtgaccacacctagctgcaagggagactgggaaatgtagtctctattctgagcagttgtgtaccgaaggaaacatcaaggttctgtagggcagaacaagaattggggcaactaacagcaggcaggttgacaagcctctctgtgccttagtttcctcctctgtgtagtggagagaatgagagcaattcctcatacaggggagttatggaggcccagtgagttactgcatgcaaaaacacttagtgccgggcagacagccagagctcagatgtagctattattacttttattactcaatgagaccctgcatgtcgcagccctgcacaggctggtagatggcgctgctgttggtgactccaagccccaggctcttttgcgggccctacagccctccttccctcagggctcctggctgaccctggggaagcaccccctgtggttgggcctggccatgggcccccatgaactgccctgccagtcccgtgtcctctcaggctccgagcagatggcccggcccagcaggactcatgccagctcagctgcaggaagtggctaatctgtctcgtgtggatttacacaaatggtctggtttttggtgctcagtccccagcatgggaaggaatccagggatggcaggggtgactgcaggacagcctctcccacttggtgtggtccagaattctggccgaggccttgtaggggtggcagcagaaggggtgtagctcagttcttggaaatgctgagtcctagcacagtgggcaccctggttgcccggggagcagctggcagcatgttccttcctcgtccccacatgctctctgaccctcacccagtcctcaccacgtggcccctccccaacccaccaagaacccactggcaaggatgacaaacatgaatgaagaagcatcatggggccgggcgcggtagctcatgcctataatcccagcactttgggaggccgaggcgggtggatcacctgaggtcaggagtttgagaccagcctgaccaacatggcaaaaccccgtctgtactaaaaatacaaaaattagctgggtgtgatggccggcgcctataatcccagctacctgggaagctgaggtagcagaatcacttgaaccctggaggcagaggctgcagcgagccaagatcgtatcactgcactccagcctgggtgacagagggagactccgtctcaaaaaaaaaaaaaaaaaaaaaaaaaaaaaaaaaaagaagcatcaggggctcactcctgccctctatgggcctgagagattcctagaaacttctccccgatcctgtagggcagatgctagagagatcagggcagtggagcctgagctgtctttatggaggcaggaagagtgaagccagaaacccagacaggccagggagagcaaggacaggggagagagcagccccttgaaaggcaagatccacagggtggtggttgaggagagaggacccacatcccgtagagggggagagttggccttgggcacagcctgtcagggcgtctgaccaccctgtgtagccctgaggggcacggaggccgagcccaccccagccagacccacccttgggcgtccctcaccccaaagcccattgtcagtgcctggccgaagcccctccaggggctcctagcatgggccctcgctttccagcacagaacccagtaaactgttcctgcagtttactgtttgcccctcatccacttccaccaggtggacaccaaatcagcagagacagagaacaaaaatcaagtgctaaaactgctgcagagctactttttaataaaataattgatgtgaacaatatgctgctgcttatattttttaaaatacaaattaatacttgaaactttcgttttttttaatttttttttgagacggagtcttgctctgtcgcctaggctagagtgcagtggcgccatcttggctcactgcaaagtccgcctcccaggttcaagggattctcccacctcagcctcccaagtagctgggattacaggtgcccaccaccacgcccagctagtttttgtatttttacaaaaatacaaaaaatcccatacagacgtggtttcaccatgttggtcaggctggtcttgaactcctgacctcaggtgatccgcccgcctcagcttcccaaagttctgggattacaggcatgagccaccacacctggccaatacttgacattttctacaggcacccatgtgtatgtgaaaccctcaagcctgaaaggagaggcactgccagtggtgcagatgaggtttgtggatgaacacggctggccttcagagccatgcccaagcccagctgacctgaatggaatcaacccttcaggccagagcagaaggaaaagctaccaggaaataggcctggcttatggaagtgagccctgcccatgctgatggaaccctctccttcttcctccaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaaggtgagcggctgccacttgcccacttccccccaaggtggaggggggacaggaaggcagcaccccttggggcacatctgcccagaccctcgagggccacctcccaggtctcaggatagggaccagcctgcttgaccgagaaataaataaataaaaggaatcccaggagcctatgaatttcaagagaacacgagtcatttgctgattgttttgcatgaataagcctcaaagggaagaagaacaatcaaaagatgttataggcaagaaaggaatctgcaactgggcactgagcaaataaaatctcctgagagagagacatgtccaagctccaaggacacgtgtgatgcccaagcctccctctgcaccagtggtagctgcagtagctcgggagccatggccaccagagggctcagggcacacaggtgctggcaggacttggcagagcctgatccgtgaagggagctgccagagctagctctgcagacaggggccctgaggacaggccctgcggcttggttatgtggaatattagacagcaagactatatatatatacacacacacatatatatacacacatacatatatatacacacatatatatacatacatatatatacacatatatatacacatacatatatatacacatatatatatacacacatacatatatatatatatatatatattttttttttttttttttcagacagagtatccctctgtcacccaggctggagtgcagcggcgccatctcggctcacagcaacctctgcctcccaggttcaagtgattctgctgcctcagccccctgagtagctgggattacaggcgcctgccaccctgcccggctaatttttgtatttttagtacagatggggtttcatcatgttgaccaggttggtctcactcctgacctcaggtgatccacctgccttggcctcccaaagtgctgggattgcaggcgtgagccacctcacccagcaaaatatattttttaaaagccacagtggaacactgcattcatccatgagagcatcactgagaccgcccttacaccaatgtgaacccttgccaagtccctgcgaaaggagtccgctaagattgtttattcattcatttacccagctatccattcattgcttctttaattcaagtatttatggggccctaagtttctgtcaggcccagagaacaagacaggcaaaggctctgccctgcccccccggaacctgtatcctggtgggatgagcaaataaatgaaacggatgatgatggagaggagtcggtgcccctaaggaaactcagcagagtgtagtgtaggcatagagggggacagggggaaagcagcactttagatgggacagccaggcctgcagtctgttggtgagaagagccagtggaagaaccttccagactgaggcaagagagagattgaggacctgaggctggcataggcacgcagccataagaagagcagccagtgaggatgcaccagtcagggacgctggtggcggggggcaggggagccccaccacctgtgaagtctaaacttcttctcttggttagatgagaagccacatgagcatttcaagccaaggagtgacgtgctgtgattttcattttaaaagcatccccccgtggccttgggaagacaggagctggggtaaggaggaggtaggagacagtgacaaccaaggcaggtcaagccaggcagggtggcagagagtgagatcactgtcatgaaggacgacccctgggtttgggcttgcagtaatgaggaggctgtaatgagaccggaaacgccaggcagagagactgacgtgagcaacggctggagtccacctggagatgcccattagcgtcgcactgaagtctggaggtccctgccagaaattcggatggagatggcaggtcggcagtctagaggcagaagggaagtctggctggagatgtaaattccggagtcatcagcccaggatggattttaaaaccactggactggacaaggtgaccagggagagtgaaggagggcacagccaagcccgtagtccagccgcctgcagaggccagtgggtggggtgagcctggactgagaaggatctgccggctaggttgaaagaaaatcaaaagttaaagccatggaaccacaagaggaaagtgtttctagaaggtgacagtgagcagcttatgaatgaccagcacagtgtcccctgccacagcaatggaggtccctggagacctcgccaggctagccaccgtgggttggcgggagtggaagtcggcttgggatgagctgaggaccccgtggaggtcaggatgtgaggccgggagtggaaccccctcttttgagaaggttgcctgactcagagacacagaaacgggtccagggatggggagagatgtggagtgagggaaggtttgcatttgagaaaggaagttcgagaacacactgggacattgtaacacatttgaaccatcttctgatagaaaggtgttggcctcctaataatgggaggtcagggccaggtcctcgggcatagggagagggtccggagaatgctgcagacccctgcccactgcccacggtctccgctccctgcacctgcctctgatggtgcagctctgattccgtgtctctcctcattgcagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaaaaatcagaaattggagaaatccttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctccctcccttccagcagcgacccagcttccctccacttccaggtggtgctgggctcaccgagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcgg

SEQ ID NO: 37478 - DNA, 116460 bp, Homo sapiens
cggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtaggggctgctggaggggccgagggagggggtcgcgcgggcaacaaaggacggagagatgcggggggcggcggcctggccgaaagcggggctgcgggcccggaggcattgtcggggcgtgggcgggggcgggagggttcgaggccggccggtgggcgtgggcgggagctggctggggtgtgccccaacttccccgttgcttgtaggagaggagggggcactgcttggggtgccagggttgggggctattcccgggctgcgggtccccctgttgaaggcatcaccagcctcatcggggtccctaccctcggacgggggtttggcccttctgttggagggtcgcccgtacccccttccaagggcagagcaagacggctggacgcgccgcagggctctctgggctcacagagcctggggagcacagcctggtgggcgcggccatgcagcccccatctccaaacctggggtctgggagaacagggactgcccccctctcctccctgctacaccctctggggtcgcctggccgatggcctttgcaaaacttggttgaagtgcttggctgaggtggggtaggaggagattgaggcgggcggcttctctcagggggtgtccccccaagctggcgctggtggctggtgaggcagcagattttctgccctcctcccggggaggggcggcggccgcggaggatgcttggctgaaccttcagggcccgcccgtttggacctttcaggcagagcttgggccgagcgggtgcccactgggcactgccacgcaggccccagccccaccctgggaaggacgggcagagggagcaccttggggggaaatcacccacccagcagtgtgtcccccaacgtctgagacccctcctctcacttctgggtgagaagtgggggtctgggatgagggggtctgccgtcactcttgcgcgatgcctgagggaggtgggtggggtggcctagggctgtgggcagaggaggaggagggtgcggggagcaccacgtgtgtgcttcagaagcctcttccctttcggttgtaaatgtaaacaataagcccttcattcagctgctgttacctggcctggcacttctaggggctggctggtccacaggacagcagcctcggtgtccccaaaaagtgcagccccgggggttgatgagtgcattagtggggaagctgggggcatagagggggtcccctggaggatggggcagaccaggaagcttcatagagcatcttgcagaagtttgctgccaggttgcctgaagggggtttcgtgcaggagaaatagcgtgaataagggcttggagtcagaaaaggaggctattgggttagagaaacagcttaggatttaaggaacttagacctgcgttgagcacaggatgcattcttgtctgcagtgccttgcgggggaatgatgggattctggcttcaggacaggtggaggcggtggagatggagaggggctccaaaggcagaagaggcaggtggaggcgcctgggaggagcctcctccacacacacctgtgtgcacctgcaaactccagccctcagcaccgtgcaggctgggaaggtggtgcctggaattctgcactcagagcccaaagtcccagcagggggaatttactccaaggagcagtaatcgctttccggcatctgctgtctaccttggcggtgaagagttcagatgctggagcttaacagcccgggttcaaatcccagctctgccactccctagctatgtgaccttgcacattgcatctctctctgcctcgacatcctcatctgtaaaattgggatccttatggtatctggcttttagggttgttaggagaactgtgtgccctgtgacagagtagatgtcctataagtgttgttgctgccgtacagagtggcttcctggccccactcacacacgtttcagggagaggaggctcgtgccccttccaggctgtttgtccttcttcagcacccttgctggttagccctgacccggcacctgctgttctctgcctcactgcagcctcctccctggtcctgcctcccttggtgatagaaaggccatctccccacagccccagttgtccctgctccccacctggcaggcctgcccacgtgtggtcccccagttccctcttggcctcccctcctggccctgccaccctgacagttgatcctgccctcttttttttttttttttttgaaatggagtttcactcttgttgcccagacttgagtgcaatggcgcgatcttggctcactgtaacctctgcctcctgggttcaagcaattctgcctcagcctcccaagtagttgggattacaggcatgtgccaccatgtccggctaattttagtatttttagtagagacggggtttcaccatgttggccaggctggttttgaactcctgacctcaggtgatccacctgcctcaggctcccaaagtgctggtattacaggcgtgagccactgcacccagccagttctgccctcttgacaccacctgctctacctccacttccatacacaggggagggaagctgcatttgtgaccctcagattccctgctcattggttcttgtgagaacttcagcttttgtgcaggttgaaaaaaaaagtatatattaagtgcttactttgtggagaattgttctgagcttttttgagacagcatcttgctctgtcgcccaggctggagtgcagtggtgccacctcggctcactgcaacctccacctcccagattcaagtgattctcctgcctcagcttctcgaatagctgggactacaggcccatgccaccaagactggctaattttttgtagttttagtagaggcagggtttcaccatgttgatcaagctggtctcaaactcctgacctcaagtgatccgcccaccttgacctcccaaattgctgggattacaggcgtgagccaccacgcctggcctggttctgagctctttaaattcattccttcatttgtggatattttaataaggttgcctacattttacagataagaatatcctggcacaaagaggtggctgtgtctgcccttgatggatttgctaagcacctactgtatgcctgggaggcatgcttccttcggccacaccattctacccaccctcttcgggttcatgtccctgaacaattatgattctgccttctcagacacctatcccttttgctcaggtgcaaagtccaaacacgctatctagcttttagggtccgcccccagttggctgtatctttccactgcagctctccccatgctcccaggctgggcacacccaggcttgcctcacctaaggctgacgtggcccctttaataaactgtgaggagtgggcatggtttgaggagcagggctggctttgagggtggtgtgggggtgccctccgatcccatacctttgggattattttgttgcaaggaacaggaacctgcttcaattaggttaagtgaaaagggacttaagagtggagaacagagaacttgtgcagcaaacaattggaggcgacctggccccccgggaccccggaagctggcaggcagctcctcctctggctttcctctctgtggactgcggtttcattttttcggcctctctcagcgcatctgtcccgtctccttctcctttcccctacaggctccgtctccttgggttgtgagtgtggctgtgttgaatggggctgtagcctgagtccacgggacctcccagtgggggtctccttcatcttggggtgcagagagacactgattggtccagcctggatgaggaagcccacccgcctctgctcggctagtgggggggcaggtcacgtggtctctggggctggcacagttgggataattggttggctgcattgatgatgaaggttgtgtgttaggtgaggaccagcaaatctgggcattcagggagttcatgagctgatgggggaggcagacccgtggtcaattagccattgtgccacaggatgtgggacttgcagcatgatttgttgaaagaaaccagagtgcactgatcaggccagtgtggggaggagaggacaggtgggatggccagggctgcctgccactggcttcccccagccctgccccgggacaggaggaggctctctcctttcaggacctggagatttgggtccaaccggcagcgtgggactcgggctttttttttgtttttttttttgagatggagtttcgctcttgttgcccaggctggagtgcagtggcatgatctcagctcaccacaacctctgcctcccgggttcaagtgattctcctgcctcagcctcctgagtagctgggattacaggcacgcgccaccacgcctggctaatttttgtagttttagtagagatggggtttcaccatgttggccaggctggtttcgaactcctgacctcaagtgatctgcccgccttggcctcccaaaagataaggagttcaagacctagtattacaggcgtgagccactgcgcccagccagagcctcctatcctggctcttctcactgggctgcaaggctagggccgtcacaacagaaccagtaatacaaaactcatgtttgcagaggaaatgcttcaaaatgttaatgaaacgtttcccttctgaatagaaggcagaacaggccagatggtttttattaacgaggcctgaatttaggaccttctctacttaacggcttctgtcttgatggagcgtttcttgctccatggctgggatcataccttccactctagcctgagccctgagcgacacccgctcccgattcatttccctcctttgcctttttggtcccttgggatgagagggcggaatttccggctcaccaggaggagcgcctggtttttcagcgtcacccccgtcaccctgaggtctcaagctggtctgcccttgcctgtagctaaacctggctgatgctgccctagctccttttgggggtgctccagcccctgcccacctcacaatgtgcagcattgagcttccacaagcttttactaaattgggaagacatccgccctgcttcctgacaatgtaaacaatatcagccctttccagaaacatttcaaggccagacactttgatgcctagtggagctgttggctgggcaacggctgcatattgatctgaaggttatgcagggaggctgggctctggtgtggtgggtggggtagtctgaagggcttcctggaggaatagaactggggctaggttttgttttgttttgttttgagacagggcctggctctgtcacccaggctggagtgcagtggcgtgatctcggctcactgcagctttgacctcccaggctcaagccatcatcccaccttagttagcctctattagctgtgattacaagtgcatgtcaccatgcccagctaatttttatatttttttgtagacagggtttcaccgtgttgcccagggtggtctcaaacccctgagatcaagcgatcctcccaccttggcctcccaaagtgctaggattataggtgtgagccactgcacccagctggggctgagttttgaagcataggtgggcttgaggcagttaaggagggcattcatgatgggggcaaagggagaaaagttgagaagctggggcagcagggagtagagtgtctgtctaggggctcagtgaaaaactcaccattctcccacattgagtgtgaagttgggggagttatactggcggcggggagaagtaacgttggatgtctgggttttttgccacctcgtacctttctacttcgctagcctgttcccttttgtaatgtaggctgttccctgcacaaatccattcatttgtttctttactttgctcatgttcagcttctttggagccaggggccacagaggagagggaagacatctgaaaggggcttgtgtgttcttcatctgattccagaaaggacttgaggtgatttacaaagataaacgcagtataaccagattaaaagtaaatgagaaaattaggccaggcatcagggctcacgcctgtaatcccagcactttgggagggcaaggagggagaatcacttgagcctaggagtttgagagcagcgtgggcaacagagccagacttcatctctacagaaaattaaaaaattagctgggtgtggtcccagctactctggatgctgaggcaggaggatctcttgaacccaggagtttgagtctgcaatgagctatgatcgtgccactgcactccagcctggatgacagagtgaaaccctgtctccaaaaaaaaaaaaaaaaaaaagcgtttttatagagataatcaagttcaaatgaggtcatttgggccctcatctaatatgactggtgtcctcatccaatatgaccattgtccttgtaagaaaaggacatttggacacaggcatgttcagagggaagaccacaggaggaaccagggagaagacagccatctacacgccaaggagagaggcctccgaaaaaaacaaccctgctgtgcccagcacggtggctcaagcctcacgtctgtaatcccaacactttgggaggctgaggcaggcagatcacctgagataaggagttcaagaccagcctggccaacatggtgaaactcttgtctttactaaaaatacaaaaattagccagatgtagtggcatgcacctgtaatcccagctactcgggaggctgaggcaggagaatcacttgaacctgggaggcagaggctgcagtgagctgggattgccacaccacactccagcctgagcaacagagcgacactaagagggccgagcacggtggctcacgcctgtaatcccagcactttgggaggctgaggcaggcagatcatgaggtcaggagttcaagaccagtctggccaatgtggtgaaaccctgtttctactaaaaagataaaaaattagccgggtgtggtggtgtgcacctatagtcccagctactcgggaggctgaggcaggagaattgcttgaacccgggaggcagaggttgcagtaagctgagatcgcgtcactgcactccagcctgggtgacagagtaagattttgtctcaaaaaaaaaaaaaaaaagagaaaagaaaaagaaaccaaccctgctgataccttggccttggacttccagcctccatagctgtgaacgctacatctctgttgtttaagccacctagtctgtggtcctttgtaatgacagccatagcagactaatatagtccctaagaccagcatttgttcccttgcagacaccatcgtccccagttacttgctgatcagcagtgggtcgcctttctgacacaggtatctgggctcctggcttgctgctttctccttggagtctgtgtcctcagtcagcttgggcctggggtgcaggggaagagatgcatctgtacagctgcggaatcctggtgtaagctcaagagagcctctaagggcagctgtcccaacaagagcagggaccagctgggtgtggtggctcacacctgtaatcctagcactttgggaggccaaggcaggaggattgcttgagctcaggagcttgagaccagcctgggcaacctagcaagggcccatgtctacaaaaaataagaaagaaataactgggcttggtggcgcctgcctgtagtgccactggggtgggaggagctgaggcaggaggattgcttgagcctgggaagttgaggttgcagtgagccatgattgtgctaccaccctccagcctgggggacagagcaagatcctgtctcaaaaaaaaacccaaaaaaccgaataagaaaacaaaagcagggccccccctttgagaggaagcctcagcctctgtctacttgaacccctccagtgatggggggctcactgcctgttcctttgtttgtgggacctacccctgggaacactccatgccttgcgtgcttaggggaccagcctttccagcacgacctgtcagttggaatgttgatctgcttctctctgtccttcccagagatagctccaagcaggctgggtgaatgtggctatggggtgtgaacaaggcactgtaagaatccaactcgatgggaggaggacgagagtagcggaggagggcatttttttcttttttttttgagatggagtctcgttctgtcacccaggctggagtgcagtcgtgccatcttggatcactgcaacctccacctccagggctcaagcgatccagaggagggcactttaatgcattcatatattcactaaacatgtatttttgagctcctctatggtctgggtgctgtcctaggtaccgagaacccagcaatgaacaagatatgcaaagatcttgccctcctaaagctgcacccacggtccggtgcagtgcccacgcttgcaatctcagcgctttgggaggccgaggcaggaggatcacttgagcctaggagttcgagaccaacctgggcaacatagtgagatcctgtctcttcttttatttatttacttttttttgagacacagtttcactctgttgcccaggctggagtgcagtagcgtgatctaagctcactgtgatctccaccttctgggttcaagcaattctcatgcctcagcctctccagtagctgggattacaggtgcctaccaccacaccctgctaattggtttttttttttttttttttgtatttttagtagagacagggttttgcagtgttggtcaggctggtcttgaactcctgatctcagctgatccacccagctcggcctctgcaagtgctgggattacaggcatgagccaccacacctggcccctgtctctatttttatttattttattttattttattttattgagacagagtttcactctgctgtccaggttggagtgcagtggcgtggcgtgatctcggctcactgcggcctccgcctcctgggttcaggcgattctcctgcctcagcctcccaagtagctgggactacaggcacgtgccaccacacccagctaattttttgtacttttagtagaaatgggatttcaccatgttggccaggctggtctcaaactcctgacctcaggtgattgtcaccgccagcctcggcctcccaaagtgctgggattacagatgtgagccactgtgcccagtctgtttctatttttaaaaaacgtttaagtaaaaaagttgcgcccagtgagaggaagggcattctaggaacccggcatggcacgtgcaaaagcctggacgtgtgacctagtggatatgaatgtgggtgggtgtctgtggctttcagccagaatttgatgactaacatgcagttccctttctggaagcaacaaaagaaaaaacactgatgttgaggccaggtatggtggctcacacctgtaatcccagcactttgggaggctaaggcaggatgatcacttgagcccaggagttggagaccagcctgggcaccttggcaaaaccctgtctctataaaaaatacaaaaattagccaggtacagtgtctataatcccagctactcaggaggctgaggtgggaggattgcttgaccccaggagtttgaggctgcagtgagctgtgattgtgccactgcattctagcctgggcaacacagcaagaccctgtctaaaataaataaataaataaataaataaataaataaataaataaaggccctgccttgaaggcttattagtgactgtcctaatccctgggccaccaagttctgttcctcctccactctccccacccatagtagtgtgctgggctgcccctcaggggcatagcaggtgctcatggcctgctgggttcatcttttctccaagccaccacaccctggagtggaccctggtttgcaccctgtcgcctctggctggggccgcttatgccactcagggaccaggcctgaacctcagtgggctcagcctcttccccagcccttgcctgcaggagaaggtgtgggagtgagagcaccctggggtgctgactcgaggcccttcttcttcttctttttttttttgagacggagtttcgctcttgttgcctaggctggagtgcaatggtgtgatctcggctcaccgcatcctccaccttccgggttcaagcgattctcctgcctcagcctcccaagtagctagattacaggcatgtgcccccatgcccggctaattttgtatttttagtagagacagggtttctccatgttggttaggctggtctcgaactcctgatctcaggtgatccacctgccttggcctcccaaagtgctgggattgcaggcatgagccactccacccagctttttttttggacggaattttgctcttgttgcccaggttggagtgcagtggcacgatctcagctcactgcaacctccgcctcctgggttcaagcgatcctcctgcctcagcctccctggtagctgggaattcaggtatgcaccaccacacctggctaatttttgtatttttagtagagatgggattttgccagtttggccaggctggtctcgaactcctgacctcaaatgattcacccgccttggcctcccaaagtgctgggattacaggcatgagcccccacacccagcctcttcccaccttttgtagtctccagcgtctattattcccctctgtattttcatgtatacccactgtttagctcccacttagaagtgcaatcatgtggtatttgattttccgagttgttttctagggataatggctcccatccatgttgctgaaaaagacatgatttcattcttttttttttttttttgagacggagtctcgctctgtcgcccaggctggagtgcagtggtgccatctcggctcattgcaaactccgcctcccaggttcacgccattctcctgcctcagcctcccaagtagctgggactaccggcgcccgccaccacgcccggctaatttttttatatttttagtagagacgggttttcaccgtgttagccaggctggtcttgatctcctgacctcatgatccacccgcctcggcctcccaaagtgctgggattacaggcgtgagccaccgtgcccggcctgatttcattctttttgatggctgagtggcattccgtggtagacatataccgcattttctttatccagtcctcccttgacggacacatatgttgattccatatctttgctcttgtgaattgtgctgtgatcaacataccagtgctggtatcctttggatagaatgaatcattttcctttgggtagatggcaattagtaggattgctggatggaagggccattctatgttcagttctttgagaaatctctgcaccatttctcataaaggttgtactaatttacattcttaccaacagtgtatacgcgttccctttcctccacatcctctccaacatgcattgttttcaggcttttgaataatagccagtcttactggcttaagatggtatctcattgtgattttaatttgcatgttctgatgatctgtgatgctgggcattttttatatggttcttggccgcttgtatgtcttcttttgtgtgcactctttttatgtccgacttctttcacttgagattgtaattgcaaggtccttacacatcattgcatgcagttggcattcattcattctcattgctgtatgttattctattgtgtgaacaaaccacaacttatttacttattattattattgttattattattgagacggagtctcgctcttgttgccaggctgcagtgcaatagcgtgatctcggctcactgcaacctccacctccagggttcaagtgattctcctgcctcagcctcccgagtagctgggattacaggcacccgccacaatgcccggctaattttttttttttttgtatttttggtagagacggggtttcaccatgttggccaggctggtctcaaactcctgacctcaggtgatccgcccacctccacctcccaaagtgttgggattacaggcgtgagccactgcgcctggcattgttttttgtttgtttgttttgttttttttgtttttttgagacagagtcttgctctgttgctaagactggagtgcgctggcgtgatctcggctcactgcagcctctatctcctgggctcaagtgatcctcctgcctcagcctcccaagtagctaggattacaggtgccctccaccacaccaggctaatttttgtatttttagtagagatggggttacaccatgttggccaggctggtctcgaactgctggcctcaagtgatccacccgccttgacctcccaaagtgctgggattacaggcacgagccaccatgcctggccttattgactcattctaatggtaatggatgtgtgggttattttcagcgttggacctttttttgtggctggtggttctgagcatgccaactctgtgtgtgtgtctagctcccgcgagacagacaggctgggcgttcccagggccctgtggtccctcaggctgttggcagggcaaggaagatgcctcctttattttttattttttttattttaaaaatttttttgaaatagagtcttactctgtcacccaggctggagtgcaatggcgcgatatcagctcactgcaacctccgcctccctggttcaagcgattctcctgcctcagcctcccaagtagcagggattacaggcgcacaccaccacgcccaattaatttttgtattttagtagagatggggtttcaccatgttggccaggctggtctcgaactcctgaccacaggtgttccacacacctcagcctcccaccaggcctggccagaagatgcctcctctaaaactgaggaaccacagccctgagctcggacatagtgagaaaggtagcatgtgggaccggaacccaggcttctagactcaacccttgcttgtctcccagctgcaggtgccagagaagttggggtttgactggggcacttggcctgggtctgtcctgccctgctcagcccaggagcccagagccctgcactgtgtaaacctggtccacactatccactgtggtcttgccagtttcatctccctccctcctgtttgaagccacgtgggcttgtggagcctgggttccagccctggatctgctgtgatgctggggcaaggccctatccccacgctggctgtcagctgtccccactatctggatggccgccaggccaatgggtgctctcagggcagctcgggatttatccccaccccattcttcctggggctccctcgtacctctactgctggccagcagctgtgtgtgttgcctgcacagctggggctgcagctccccgcaggcctggcagagaagactgaccaagtatgggtggagacagcagtacagacagccgggcaccctcccatcagctctcccaggcctgagggatagtgggtataaggctcagagcttcaggttccgcctcagagccggcaagactcacagggaaggggccgtccagccctgccctcttcttgccctggtcagggaggatgtggagactctagcttcaccactgggtgacctaagtcaaccttctcagattccctgagccttgggcaaatgcaaacaaagctgtgtgggatggatgggcagtggggtccgtggagcaggtgaggtgccagcctggagtggtgttacacccaagaccccctgctggattctgcatggtgcaggattggggtgggactggcattctagtgcatgtgtgggcattggggtgctgggtagggcttggggagcccccttcatgctcagagaagggctcaccattggctcagaaagcctggcctggcagtgagcattttggggtcctctctgttgggggcttgcctcttggtggctgtgcagtggagataatgtttccttctccctccccttgtgtctcttattttttttttttttttttttagaaatagggtcttaggtcaggcgtggtggctcacgcctgtaattccaccactttgggaggtgaaggcaggcggatcacctgaggtcaggagttcgagaccagcctggccaacatggtgaaaccccgtctctactaaaaatacaaaaattagccagttgtggtggtgcactcctgtgggctcagctacttgggaagctgaggcacaagaatcgcttgaactcagcaggcggaggttgcagtgagctgagatcgtgccactgcactccagaatgggtgacagagtgagactcggtctcaaaaaaaaaaaaaaaaatagagtcttgctctgtggcccaggatggggttcagtggcaggatcacagatcacagctcactgcagcctcaaacttctggactcaagcaatcctcccaccttagcctcctaagtagctgggactacaggtgtgtgtcaccatgcctggctaattttttttttttaataggaggtgaggtctcactgtgttgtccaggctggtctcgaactcctggcctcaaatgatcttgccttggcatcccagagtgctaggattgcaggcgtgagccaccgtacctagcctatctttatttttcttttaaaaaaatgattaagaagccgggcatggtggctcatgcctgtaatcccagcactttgggaggccaaggcaggtggatcacctgaggtcaggagttcaagaccagcctggccaacatagtgaaacctcatctctacaaaaatacaaaaattagctgggcatgatggcagatgcctgtaatcccagctactcgggaggctgaggccggagaatggtttgaacccgggaggtggaggttgcagtgagccgagatcacgccattgcactccaacctgggtgacagagggagactctgacaaaaaaacctgggcgacagagggagactctgacaaaaaaaaaaaaaagtttaagaaatctgttagatattcaaaggagtagacaggatacattgaacacccatgtgcaccccatagggctaggaaacaaaccttagaaatataacaaaggctgggcatggtggctgatgcctgtaatcccagcactctgggaggctgagccaagagaatcacttgaagccaggagttcaagaccagcctgggcaacatagtgagatcctctctttacataaattagccggatatggtggcatacacctgtggtcccaactactcgggaggctaaggaaggaggatcacttgagcccaggagttcaaggctacagtgagctatgattgcatcactacactcttgcctgggcaacagagggagaccctgtctccaaaaataaataaatgaatgaatgaataaataaataaataaataaagtccccagttaccccaccccagtcccctcccaccaccaaaccacccctccctgctcttacaatggagttcatcctgtgggtggctccagggcaggcaggccaattgccagggaggaccctctaggggaccatccatccctccactgtacacttacgttccctgtccagcccaggcactgtgccatccgtgcccacccacccactgctctgccccctctccaatacttggcattgccaggccttttgacttgcccattggatggggcaccctgggtttgcattttcctgttcctggggaggcacagcagctctctgtctctcagctggtgggttgtgcagcctggcctcccccgcaaaggctggtcccattcctgcccacctgtcgttgggttgccctcaggtttgtgccctgtggttgctttgagttctctgctgcagcccctacctccccccacctccctcccagtgtcccctctctgtcccagatcaggcctcattttgtttgttgtttgtttgtttttgagacggagtctcactttgtcgcccaggctggagtgcaatggcaccatctcagctcactgcaatctctgcctcctgggttcaagtgattctcctgcctcagtctcccaagtggctgggattacaggcatgcgccaccacgcccagctaatttttctatttttagtagagatggggtttcgccatgttgcccaggctggtcttgaactcctgacctcaggtgatcctcctgtcttggcctcccaaagtgctgggattacagacatgagtcaccgcacccggtcacattttagggatctgcttccatctcagcagcccccagctggcttctctccctgcaccccaacccccccccaccgcccctgctgccagttcaccatcatcctcagctcccagagcggtcttgctggtgtgcttgtctgattgtgggggacccctggcttggagtctctctgtggcccctcatcccctcagcctgattgctggggcacgtccaggagaccctgcctgtctctcatactctctagatcccctgctgccttccagccccaccagatccttgggtgttgggtggacctggcagagtgtggtcagtttcctttgcgggatcccagaccctctgccccgcaggtgctgcctgcccaggctcccggttacgggtcccttgctcctccgagaggtgctgttgtgcctggtgccctagggcttgtggcatgtgggcaggggctgtgctgagcctacctctggggcctgattgtggggactgcgggttacacctcaggaagtgtgggcatgagcaccccagctgctgggacccccgagggccctggagagagtgggctctggtgaaggctggatgtgacccaccccagccagcagcagtgtccctgccaagcacctgcccctccgggagagagccacgtccggggtctctgcaggcgtgcccgcttcctggctcctgcctccctcgccccaggatgaggctggcccgccaaaccaagatgggctttccactgctctatttggcacccgtccccctccgccggggccctgattggcagagttccgaggctgcagcccgccacccccgggcagctgaaatggaaggcgtgaaatgcagccggggcttgtctctgggaaacggcatcggagggtggcacaaaagggggactgttggtctgaatgccaccccgccctcgcctgtccgtcctgtgcaccagggcctccagagagtagtgacagtccccttcccgagcagccgggcatactcctggggtgtcttctctgcctcactcccaggaggtggtgacacttgtaccccattttacaggtaatgaaactgaggctctctctgggccaagggctcacagccactcggagaaagtctggggtttggagctgggactgccccaggcttccccgcctcccacgtcggccacagtgtggccagaggccaatttatcatcaagtcccagcgttttccaagaatccctctctcttcctctgtcccaccagcacagctgagtcacacgagggcaggtggcctcccccttcttcctgttcactattctcccctctccccttccgggtgctcctcggggacaggggggctgctccccctctgcacccttctccccctcccacagcaagggtggccgggcctgactgaatgccgccttggttctcctctcctgccagctctttggtttcctttgtgagccgtggcaggcggacgctgtccccagaggccagggggctcacaaatgttattccagggctgggctcggcaggatgggaggtagggaagggccagacccgggtctgattccaggacagccacttagcagtgtgtgactttgagtccccgaacttctctgcactcgggaagctccacctgtcagaggacctctgccttgtgcaggggctggggaggacatgaggccacattcgtgcaatgcctggtagacagtaggttcgtttttttgtttttggttttgttttgtttgagtgtcgatctgtcgcccaggctggagtgcaatggcaccatctcggctcaccacaacctccgcctcctgggttcaagtgattctcctgcctcagcctccctagtagctgggactacaggtgcccaccaccatgcctggctaatttttttgtatttttagtagagacagggtttcactctgttggccaggctggtctcaaactcctgaccttgtgatctgcccgcctcagcctcccaaagttctgggattacaggcatgagccaccgtgcccggcaacagtaggttcttcatactggaggctgctggggggtggttcaggagggctggaggttaattttgggagcgttccctgggagtagtgtttctggggatttgtgtcctctgggcggctgtaggtgtgttgtcgtgggaattccagatcatggctctgtgccaggcaccatggctcaggctgggttcccagagaggagagactatggccctgcctgaagttgcctgtaagctcccaggtggcatgacgaagacagacaagaacagcatactctctcctccttggctccacatgtgatcctgaggtctctgtgggccgaaggtcctgagagacttcctggaggaggtggcatcaggctaggtgtcagtaggtaatgcaaataggagaagtgaagcaggtgggagaaaagacacaggtggcctctgggaggtgggacagtgtcaggcgggtggtaaggactgcagggtcatctgcaggagcctccagtgccagggacagggttctcacgcctgatctctgcctcagaggggatgctggctggttgggaggccagaccggctgtgtgatgacctgtggtgtctgaccagctgggctgatcaccacaagccactcagacctgagtgctatgtcctaaggaggtgagaatggtgtcctggacttctcacctcttgggtaagtatcattcattcattcattcataatctagtttgtttatttatttatatttatttattttgagatggagtctcgctttgttgcccaggctggagcatggtggtgcgatgtcagctcactgcaacctccgccttccgggttcaagcgattctcctgcctccacctcccaagtagctggaactacaggtgtgtgccaccacgcccagctaatttttgtatttttagtagagacagggtttcaccacgttggccgggctggtctcaaactcctgaccttcagtgatctgcctgcctcggccgtcttttcatgtgcttatgggctgtttatatatcttctttggtgaaatgtgtattcaaagtgctgagattacaggcgtgagccaccatgcccggccctttttaaaaaatttttttaacttttttagagacagggtctcactctgtcacccaggctggagtgtggtagtgtgatcacagctcactgcagcctcaacctcctgggctgaagcaatcctctcaccttagcctccccagtagctcggactacaggcatgcaccaccacacctggctacattttgtattattttgtagagatagattttcgccatgttgcccaggctggtctcaaactcctgagctccagcaattcacccacctcggcctcccaaagtgctgggattacaggtataagccactatgcccggcctctcccatcttaagtgtatggtttgggcccagcatagtggctcacacctgtaatcccagcacttggggaggccaatgcaggtgggtcacctgaggtcaggagtttgagaccaacctagccaacatgatgaaaccccgtctctactaaaaattaattgtatggtttgatgacttctagtataaacatagagttgtgcaactatcaccacaccccagttttaggacatttctactacccagaaagttctctgtgcccatttgcagccaatctgtgtttccaggcccaggcaaccactaatctgcattctgtgtatacggttttgaaatttcatatgaacggattcatacaatatggagtccttcgtgtctagtttcttctacttagcaaaatgttttaaacattcatccggccgggcgtggtggcacacgcctgtaatcccagcactttgggaggctgaggcgggtggatcacctgaggtcaggagttcgaaaccagcctggtcaacatagtgaaaccctgtctctactaaaaatacaaaaattagccgggcgtggtggcacacacctgtagttccagctacttgggaggtggagacaggagaatcgcttgaacccgggagaatcgcttgaacctgggtgacagagcgagactccatctcaaaaaaaaaaaaaaagcattcatctatgttgcacatatcagtagttctttattgctaagaagtattctattatataaatataccactttgggccaggcatggtggctcatacctttaatcccagcactttgggaggctgaggtggggggaattgcttgagtccaggagttcaagaccagcttgggcaatatggcaagaccctgtctctacaaaaaaaaaaaaaaaaaaaaaaaaaaaaaaaaaaaaaaaaaagttcagccaggcgtgatggcgcatgcctgtagtcccctactggggaggctgaggtgggaggattctttgagcccaggaggtcgaggctgcagtgagccatgatcatgccaccacactccagcctgggtgacagagacctgtctctgttctaaaataaaaatgaagactggtcatggcggctcaatcctgtaatctcagcactttggtaggctgaggcaggaggatcctttcagtccaggagttcgagactagctttggcaacatagtgagactccagctgcaaaaaataaaaagttagctgggcatggtagcactcgcctttggtcccagctacccaggaagctgaggtgggaggatcacttgagcccaggaacttccaggctgcagtgaaccatgattgcaccactacactcagcctgggtgacagagtgagaccctgtctcaaaaataaaaataaaattaaaatgaaaaacagctgccctacttttgtttgtacaggcactggttgatggagattttacttttgggctgttatgagtaaagctggtatgaacacttgtttataaaactttctatggacacatatttttgcttctcttgggtggttgggttatatgggaggtgtatttttaactttctttttttttttttgagacaaggtctcactttgtcatccaggctagagtgcagtggcacaatcttggctcactgcaacctctgcctcctgggttcaagcgattcttgtgcctcagccttccaggtagttgggaccacaggcacacgccaccatgccctgctaattgtttttggatttttggtagagatggggtttcgccatgttgcccaggctggtctccaactcctgggctcaagctatctgcctgcctcgagctcctatttttaacttttttttttttttgagacggagtcttgctctgttgcccaggctggagtgcagtggtgcgatctcagctcattgcaagctctgccccctgggttcacgccattctcctgcctcagcctcccgagtagctgggactacaggtgtctgccaccacgctcggctaattttttgtatttttagtagagatggggtttcactgtgttagccagaatggtctcgatttcctgaactcgtgatctgcccgcgtcagcctcccaaagtgccgggattacaggcatgagccactgcactcggccactatttttaactttttaagaaactgcccaactgttttccgaagtgattgtaccattttttatttccaccaacactacgagcatttcagttgttctgcatcctcatcagcacttggtattgtcagcttttcaaatttttagccatttcccttgatgggaagtggtatctcttgttttgatctgtattgcctggatgagtaatgatgttagtcatcttttcatgtgcttatgggctgtttgtatatcttcttcggtgaaatgtatattcaaacctttcacccatttttaattgggttgttgtcttcttagcaagttgcagagttcattatgtttcctgaataccagccctggctgggcgtggtggctcacacctgtaaccccagcacttccagaggcagaggcaggaggattgcttgagcccaggagtttgagaccagcctgggcaatgtagctagacccagtctctacaaaaaataaaaaacaattagccaggcatggtagggtgcacctgtagtcctagctatccaggaggctgagacgggaggattgcttgagcccaggagttggaggctgcagtgagctatgatcgtgtcactgcactccagcctgggcgatagagcaagaccacatctcaagaataaaaaaaaaaaaaaagaaagaaagaaaaagaaaagaatgcaagtcgggccaggcatgatggcttacacctgtaatctcagcactttgggaggctgaggcaggtggatcatttgaggtcaagagttcaagaccagcctggccaacatggtgaaacaccatctctactaaaaatacaaaaattagccaatgtggtggcaatgggacgcctgtagtcccagctacttgggaggctgaaacaggagaatcacttgaacctgggaggcggagattgcagtgagctgagattgcaccacctgggtgacagagcaagactccgtctccaaataaataaataaataaaataatgaaagtttgttattagatacgatttataactgttttctctgtgggagggattttgggcagagaagaggccctggtgggggggcgggggtcaggaggcggagggagttccttgcacctcacttgagtctcagcaatgctctcccttctctgcatctggaattcctaggtgagagggtcccccagctgagccacgggagcaggaggctcatttggtcacccacaaggtgggatatttactgtcaccagagaccatccccactcacctttgctggcattggaaatgctgacccagcctaaccaagctctcggagagctgtgcccaaagctcacagtccggctccctcattgaacaagccaccaggagggccaggttctgaggacgaagggagcagccttgtaccccagcatgattgactcccggcccccagaattcccggggcaccaggggcgttggaatgttggatttagcagccctgagggccagggctggcaggcatgcccagtgctctcgtgggcgcaccccggcatgtcggctccactgctgtgtgcctgggggcagcttgttttcctctgctcttaaaactgccagtctgagggaggaagtgatccttcactcggatgtgccaggacaggtagtagcattgctgactcatcggatgccctcacgcacattcctgacgcgagcattgtgggttggcatctgtattcatcagaatttttttggaaatgcaaatgacattgtccctcaaataggtttaggaaaaaaaaaaaggccaggtacagtggcacacacctgtaatcccagcactttgggaggctgaggtgggaggattgctttaccccaggagtttgggaccagcctgggcaacatagtgagaccctgtctctacaaaaaacttgtaaacttagccggggcaggggatggtggtggtggcatgcacctgtggtcccagctactcgggagcctgggaggttgaggctgcagtgagctgaaattgtaccactgcactccagcctccagctggagtggctcacgcctgtaattccagcactttgggaggccgaggggggcagatcatgaggtcaggagatcgagaccatcctggctaacatggtgaaaccccgtctctactaaaaaatataaaaaattagccaggtatggtggcaggtgcctgtaatcccagttactcgggaggctgaggcaggagaatggcatgaacccggaaggcagagcttgcagtgagccgagattgcgccactgcactccagcctgggcgacagagtgagactccatctcaaaaaaaaaaaaaaatgaagagcccaagtggccagcttcaggctcagctggatctaggccctcctcgggactcagctgtgctgtctctgtgttggcaccgttccctggcaggctctcccatgcggtaaccaggatggcccctgcagcttctggcttccatcctacacccaggcagccccagagcagggagaattcttcctaaaggtttcagccacagcctaggccctgagacgcctcacctgatcttctctgatggccaggcctgcattatgcatcccctctaggagtgggaatcgggtcaacccacataagtcatatgaaccaaggatggggaaaatgtaggctgggagcagtggctcatgcctgtaatcccagcactttgggaagccgaggcggtagaattgcctgaggtcagcagtttgagaccaggctggccaagatggcagaaaccccctctctactaaaatacaaaaattagccgggcctggtggcgggcgcctgtagtctgacttactcagaggctgaggcagaagaattgcttgaaaccaggagatggaggttgcagtgatccaagatcgtgccactgcactccagcctgggtgtcaaagtgactctgtctcaaaaaaaaaaaaaaaaattggggaaaagggaccgggtgcggtggctcatgcctgtaatccctgcattgtgggaggcagaggtgggaggatcacttaaggtcaggcgttcaagaccagcctggccaacatagtgaaaccccacatctacaaaaaatacaaaaattagccaggcatggtggcagatatctgtagtcccagctactcaggggactgaggcaagagaatcacttgaacccaggaggcagaggttgcagtgagctgagatcatgacactgcactccagcttgggcaacagagtaaaaccctgtctctaaaaataataataataacaaaatgagtgaagaaaaggtttcttcaaaatctgtgaccacagatatggctggacagacaagggcatctcctgtatcagagatttcctgtgtttccgaggtccagacatgaggatgcttttgcctggaatcctccatccgactatggtgctctgaattttctctccccattggacggtgctccccagggcagaggccgagtcctgcctgcagctctggggcagagatggggcctggctcatggtgagccttctggaaacattgggtgcaggaaagtttgtgagtataggatagtggggaagaggcctgggggtggggggcttgtccacccctccggccccctgcagccagtcccatcttgctgccccctgaccccctaaacagatagcatcatgcctggaggctttgctcctctccagagtcccttttgtaaagcgctggtgctcctataagctcttctgtgcttcatcataaggacacaaagctggccgggcgtggtggctcacgcctgtaatcccagcactttgggaggcgaggcgggaggatcacttgaggtcaggagtttgagagcagtctggccaacatggcaaaaccctgtctctactaaaaatacaaaaattagccgggcgtggtgacgggtgcctgtaatcccagctacttgggaggctgaggcaggagaatggcttgaacctgggaggtggaggttgcagtgagccgagatgctgtcactgcgctctagcctgggcgagagagcgagagtccgtcacaaaaatacatttaaaaaaataataaagacacaaagcttttgattctgaggttactgtactagcaagcatcacacactttttttttttgccatgattaatatgtaatctttgcttttagcccttttaaaaatattttgtttttattatttgtagagaacagggtctcactatgttgcccaggtgggtcttgagttcctgggctcaagtgatcctcctgccttggccccccaaagtgctgggattacagacatgagctaccacacctggcccttgttttttctttttttcttttctttcttttttctttttttttgagatggagcctcactctgttgcccaggctggagtgcagtggtgcgatctcggctcactgcagcctcctcctcctgggttcaagtgattctcctgcctcagcctcctgagtagctgggattacaggtgcccgccaacatgcccagctaatttttgtatttttagcagagttggggtttccgccacgttggccaggctggtctcaaactcctgacctcaggtgatccgcccacctcagcctctcaaggtgttgggattacaggcgtgagccacctctcccagcccttttttttttttttttaaattttaaattctgggatacatgtgcaggatgtgcaggtttgttacataggtaaacgtgtgccatggtggtttgctgcacctatcaacccatcacctaggtattaagcccagcatgcatcagctatttttcctgatgctctccctccccccgcccccacaacaggccccattgtgttgttcccctccctgtgtccatgtgttctcattgtccagctccgacttacaagtgagaacatgtggtgtttggttttcttttcctgtgttagtttgctgaggataatggcttccaactccatccatgtccctgcaaaggacatcatcttgttctattttacgactgcatttttttgtttttgtttttgtttttgttttgagacagagtcttgctctgtcacccaggctggagtgcagtggtgccgtcatagctcactgcagccttggcctctcaggctcaaaaaatcctcccacctttgccccacaagtagctgggactacaggcatgcgccaccacgcctggctaattttttattttttattttctgtagcgacaaagtcttgctacgctaccaaggctggttttgaactcctggcctcaagcaatcctcccaccttggcctcccaaagtgttaggattacaggtgtgagccactgcccccagcccttttagggctttttttttttttcttttgagacaagagtctcactctgttgtccaggctggagtgcagcagcgtgacctcggcttactgcaaccaccgcctcctgggttcaagtgattcttgtgcctcaacctcccgagtagctgggactacaggcatgtgctactaagcctggctaatttttgtatttttagtagacacagggtttcaccatgttggccagcctggtcttgaactcctgacctcaagtgatccactcgcctcagcctcccaaagtgctgggattacaggcatcagccactgcacctggccccttttagggcttttaatgaccatagtcagcatgcagctcacgctttgaaaaggttttactctgtcacccaggctggagtgccctggagctcactgcagcctcaaactcctgggctcaagcgatccaccagcctcagcctcccagagtgctgggatgacaggccactgtacccagtctaaaagtggtctttgttgcaaacagtttgatggatgctcttgggatagaagatgaaacatctttcaattgtaataaatttctgcaaccaaataaataaagacacaaagctttaatggtgggaaggcaggcagaggtcatggctagatgacggcctggtgtggagttgaggcaggtaactgcacaccaggatataagagggtaaggcaatagcctctctgtgtgtttgtcctgcccatgcagtagagggggtgcgtgctgggatggtgagtctgagagcgggaatctggcctgtgcggcaacgggagcagtgagctgataggttaaatcgggtgttgcctcgtccagcccacctcaggagggatgtgtgttgcttgatggcccttgagggtctgggggccattgggaagtgatgatgtgatctctcctgtctctgcccgcaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggtacgtggcacaccaaggatggggggtgaggggactggctacatgggatgagtgttcttctggaagagccccaggagcacaggccactctgtgaccaatctgatgggggacgctgagtgtcatgagctcctgtaatggggcctgatcaacactgggaggttggcagaggtttccccagggaggggacatgggcgctgaggtctggagggtgaataggtgattcactagctgaagaggaaaaggttcaggtacggtggctcacgcctgtaatcccagcactttgggaggctgaggcggctggatcactggaggtcaagagttcgagaccgaaaccagcctggccaacttggtgaaaccccatctctactaaaaatacaaaaattagccaggcgtggtggcaggtgcctgtaatcccagctactcgagaggctgagagaggagaatcgcctgggcaacagagtgagactctgtctcaaaaataaaaaaaaaaagagggaagagtattccaagtagagggaacagcacatgcaaatgctcagaggcagaaaggagcgtcatgcgtacagaagagggagagagcgtgggggtggctggggcagtctgctgcaatgcaggtggacctgggtgacttggaggtgtgcggggagtttcattttcatcctaataatgagagctacgggagggtttaaaccaagatgagtatgatggaaggaactagcagcaatttcttacctattctctgcagtttaaaaaactgtaattgagctgggcatggaggctcatgcctgtaatctcagcactttgggaggccgaggtggaaggatcacttgaggtcaggagttcaagaccagcctgggcaacatgggaaaaccctgtctctgctaaaaatacaaaaattagtcgggcatggtggcgggcgcctatagtcccagctacttgggaggctaaggcaggaaaatcgtttgaactcaagaggaggaggttgcagtgagccgagatcacaccactgcactccagcctgggctacaagagtgaaactccatttaaaaaaaaaatgacgatcgtttgttacttatcactttgataaatgatgctgtgatgaacatctttgtgcacaaagcctggctttgatgatactccagccagcaggataggtcactgcccatcttatctgattggtacaaagtttggagagacaaacacagctggggccagactggacaacctgggtcctggggaagggggtcaaggaaagtttgagccaaaatcatgggcagttggcaggacagggtccctggcagagccaaatgggcagcgtgaaagggcgaggaagctgcagggtgaggcccgtcggcagaagcccatgggaaaggcctgcccagtgcagccttgtgaaggcccaggctctgctctagggtggcaaatcctctccagcagtgagaagccagacaagagaaaattcgggggatgaggtggggtggggaagaggtgttccacgtggagggaatgggtgatgcaaaggccctgaggctggaatgaatttgatttgttaagaaagaaaaaggccggggacggtggctcatgcctgtaatcccagcactatgggaggccaacactggaggatcacctaggtcaggagttcgagaccagcctggccaacatggtgaaaccccgtctctactaaaaatacaaaaattagcgggatgtggtggcacctgtaatcctagctacatgggaggccgaggcatgagaatcggttggacttaggaggcggaggctacagtgagccgagctcatgccactgtactccagcctgggcaacagaacaagactctgtcaaaaaataaaataaaataaagaaagaaagagaagccagcatggtggctcacgcctgtaatccagcactttgggaggctgaggccagaggatcacttgagcctaggagttccagaccagcctggggaacatagtgagaccccagctctacaaaaaaaatttttttaattagccaggcatggtagtgtgtgcctgtagtcccaagtactcaggagggtgaggcaggaggattgcttgagcccaggggttggaggctgcagtgagccatgatcacaccgctgcactccagcctgagtgacagagtgagaccctaaaaaaaaaagagagagagaaagaagaaaagtctggatggagaggagtgtgaaaagaggttagggagggcagccaggacagatctgaaggacacagggtttgggtttgttttaagagtggtgggggctgggcacagtgactcaagtttgtaatcccagctctttgggaggctgaggcgggaggatcacttgaggttaggagaccagcctggccaacatgatgaaaccctgtctctactaaaaatacaaaaattagctgtaatcccagctactcgagaggctgaggcaggagaattgcttgaacccgggaggcggagtttgcagtgaactgagattgcgccactgcactccagcctgggcaatagagtgagattccatctcaaaaaaaaaaaaaaaaaaaaagaaagaaaaaggaaaaagagcagtgggggccgggcacagtgactcaagcctgtaatcccagcactttgggaggctgaggcaggaggatcgcttgagcagtagagtttgagtccagcctgagcaacacagcaagacctctcatctctacttaaaaaaaaaattaggcacggtggtgtatacctgtggttccagttacttggcagcctgaagtaggagatccgcttgagcccaggaggtcgaggctgcggtgagttttgatcacaccactgcactccaacctgggtgacccagcgagaccctgactcaaaaacaaaacaaaaaaaggatggtgggagcggctggaggataccaatggaagagtgatgggaccttgttcacatcccttgggccactgtgcagagaacggattgtagggttaagagccaggtggggataccagtgaggaggctgtggttatccgggggagggaagggctcattaccatgcgtgggcaatcagggaagacttcctggaagaagcgtgaatgagctcagccttgataatgggggcagggcagtgggtggagtttgaaaatgagaagaggaggaggaggaaggatctgcagacagtgggggaaggtcgtgagtcaaggcacccagtgggctgagcttggtccagtgaggagtgaggctgtgtaacctaatggctagagaagggcacccgcccagcccaaccctggggctggggcatggcgtgcagcgagagagtcttattgaaccttctgggtactttcccctttgttcctccccgatctagagaggcccaaattctggctgtgatccagctctcatgcccctcctagccctgctcctgctgtgtgaccctgggagagtgacctaacctctctgagccacaaatgggataatagcatctccctaatgggatcaagcgagttaatgaacatggagtgcctgcaggtagaaaactcattaaagattaatttctttccctttcacccatccatcatctcattacaggaaaatttgaaagtgataaaagaaaaaaacgtccattatcctttaaccttctcccttcccccttaccacttaacctcatcactgcacagcctaaccaggattccgtgaaggatggaccatgtttatcgtggtcccacaggattctaacagagctgagcatttcctattgccgacattggcagttcctgagttttagccattgtcatgttgcagcgcaattactttattttatttattattattattattttttttgagatacagtctcgctctgtcacccaggctggagtgcagtggtgcgatctcggctcactgcaacctccacctcccgggttcaagtgattctctgtctcagcctcccaagtagctgggattacaggcgcccgccaccacgccaggctaattttttgtatttttagtagagacagggtttcatcatcttggccaggctggtcttgaactcctggccttgtgatccccccgccttggccccccaaagtgctgggattataggtgtgagccaccgcgcctggcctttattttatttttattttttaataaaaaataagcgtgcagtgtttataaagtctgcagtagtgtacagtcatcagtcatgtcctagaccttcacattcactcactcactcacccagagccgcttccagacgtgcaaactccattcgtgttaagtgccccagacaggtgtaccctattttcttttcttttttatttttattattttattttatttttcctttttttttttttttgagacagagtcttgctctgtcgaccaggctggagtgtagtggcacgatctcacgatctcagctgattgcaacctctgcctcctgggttcaagcgattcttctgcctcagcctcctgagtagctgggactacaggcatgtgcaacaacaccggccaatttttgtattttttggagagacggcgtttcaccatgttggccaggctggtctcgaactcctgacctcaagtgatccactggcctcgacctgctaaagtgctgggagtacaggcgtgagccactgtgaccggcctccattttttaatcttttttttttaagagacaggatcttggccaggtgctcatgcctgtaatcccagccctttgggaggccaaggcaggcagatcacctgaggtcaggagttcgagaccagcctgggcaacatggcgaaaccccatctctactaaaaatacaaaaaaattagcctggcatggtggtggatgcctgtaatcccagctacccaagaggcagaggtttcagtgagccgagaccacaccactgcactccagcctgggcaacagagtgagactccgtctcaaaaaacaaacagacaggagacaggatctcattatattgaccaggatgcacctcctggcctcaagcaatccatcctcacaccttgacctcccaaaattctggaattacaggcgtgagccactacacctgtcccattgtttatctttgttttttgctgttgttgtttgtttttttgagatggagtctcgctctgtcaccaggctcaagtgcagtggcgcgatcttggctcactgcaaccttcgactccctggttcaggcgattctcctgcttcagcctcccaagtagctgggattacaggcacacaccaccatgcccagctgatttttgtatttttaatagagatggggtttcaccatgttggccaggctggtcttgatcttctgaccttgtgatccacctgcttcggccttccaaagcgctgggattacaggtatgagccaccgcgcctggcccgtttatcttttaaaacttatttttactgtaccttttctatgtttagctatgttttatttatttatttatttatttatttatttatttatttatttatttgagatagggtctcgttctgttgcccaggctggagtgcagtggcgtaatcatagctcactgcagcctcgacctcctgggctcatgcgatcctcttgccttggcctcctaagtagctgggaccataggcaggtgccaccatgcctggctaacttgtaaattttttgtagaaacggagtcttgcatttgttgtcctcattggtcatgaactcttgggctcaagcgatcctcccacctcagcctaccaaagggcgtgagccaccatggctggcctagatatctttttttttccttttcttttctttttttttttcttttttgagatagagttttactccatcgcccaggctgtagtgcagtggcatgatcttggctcactgcaacctccacctcctgggttcaagcaattctcctgcctcagcctcctgagtagctgggattacaggcacccatcaccatacctggctaattttgtatttttagtagagatggggtttcaccatgttggccaggctggtctccaactcctgactcaggtaatctgcctgcctcggcctcccaaagtgctgggatcacaggcatgagccagtgcgcctggccctggcctagatgtcttatgttcagatgtacaaacacttcccctcgtgttacagttgccttcagcattgagtactgtaacatgctaaataggtttgtagcctaggagcagtggactagaccatataggtttgtgtaagtacactctgtgatgttcacaggacaacaaaatcgcctaatgatgcatttctcagatggtatccccgtcgttaagtgatgcatgactgtatttccttccagtcttttttcctattacacaagttgtggttttatttattatttatttttattttttgagatggaatctcgctctttcgcccaggctggagtgcagtggcacgatctctgcaacttctgccccctgggttcaagcgattcttctgcctcagcctcccaagtagctgggattacaggtggccgtcaccatgcccggctaattttgtatttttagtagagacagagtttcgccatgttggtcaggctggtctcaaactcctgacctcaggtgatcctcccgcctcggcctcccaaagtgccgggattccaggtgtgagcccccgttcctggccacaagttgttttaaacagctagattgtgcattctactttttctcatcttattgcatcctatgggaagcacctccctgtgctactgtgatatcacctgctgtcatctgaatggttccctggagggaacggactgtagtgtggtgtgtggcgtgccacctgcttcctagtcacattgcccggtggtctggggatggggacaaggactgggtggtcggactgccttgggcctccaccctcaaagctgtcccagagagagaaagtgtccctccgagaatccccaattgacaggggagccacaccttgtgcctgaccttggagatggtggcagcagaggctgtggctgggcttggtggtgtcctctcccttcactgcaccccggctgctgcctttgcagggcagaactagactcccaggctggggaaggaggtggccagcctggagcaaaaccgagttggctgagacagccaaactccaggagagagaaagggagaattctgctgcttttgttcctgttccaagatcttgagaaaaaaaaaaaaaaaaaaaagcctctgggaagagtgacaggtggaagagccagggaaggacggtccccccagtcctgttggcccttcgggctccctcacccacccatgcaactgtccatctgttctccgaggggctggaggcggccacatccatcagaggctgggaccctgggcagtgggcagctcgagatgtgtgtggcagaggccggggcctggcagtggtttgtggggaggggagcacgctggagtctgctctgggaacggggttgtggctgcctcccaaaacatgagctcagcctccggcagaggatctggccaagggacagggcctggactggtgcccttgctgcccacccagtggagaggggagggcctgtatcctcagagctgtgccacacagggagcagcatttgagggggacctttgagagggtctctcacgctaggaggtggtgcagggctacaagggagaggtggtcagagcaggtgggcaggagggcggtttgggatccacctgggggcaaagtcctgggtggagcagcgtggcgagggacagcctggccgggtgtgaccgagcacacctggaggctggtgcagacagggtggtcagggacggcctggctccagtggtgacattggagcaaggattcaagtgatgagcaggagtcgccccagctgccgttcagggaaaaacatccaggcagagggaacagaggctgcaaaggccctgagggcctggcatggtggctcacgcctgtaatcccagcactttgagaggccgacgcaggtggatcacttgaagtcaggagtttgagaccagcctggccaacatggtgaatcctcgtctctactaaaaatacaaaaattagctgggcgtggtggcacacatctgtaatcccaggtacttgggaggctgaggcaggagaatcgcttgaacccgggaggttgaggttgcagtgagcttagatcacgccattgcacttcagcctgggcaacagaacgagactccatctcaaaacaacaaaaaaaagttggggggctgggctgcagtgacctggatcctgggtgaggactgatgggactgatgagcacaggggccaaccatgtgccattgttttcattttaaagatgagaccattggctgggtatggtggctcatgcctgtaatcccagctctttgggaggccgaggagggcagatcacttgaggtcaggagttcgagaccagcctggccaacatggtgaaacctcgtctctactaaaaataacaaaaattagccgggcgcgacggcacatgcctgtaatcccagctactcaggaggctgaggcaggagaatggcttgaacctggaaggcagaggttgtagtgagccaagtttacaccattgcactccagcctgggcaacaaaggaagactctgtctcataaaaataaagatgagaccaccgaggcttggagtctcagctgcgttgcccagggttacagggccagagctgagactcatgccagactgagcgcctgctgcctccccaggggtggggtgcctgggggaccaagtccagtatcagccccacacatttggctcatgccccagacaggtggatgggaggaggacatacctgttcccattaggttggtcacaactgtcccctaacattcctgtggccttgcctcatgctggggatccaggagattgaggacaagtatgtgtgggagtgttacccacccttagacggggagttgggctatgtgaggcaaggcccacctcctatatgctatcctcagctgctctctagtacacacacagggctgggcccagagcattttttttttttttttgagacggaatctctctctttcaccccggctggagtacagtggcgcaatctcgactcactgcaacctccacctcctgggttccagcgattctcctgcctcagcctcccaagtagctgggattacaggcatgtgccaccacgcctggctaatttttgtatttttgagtacagacggggtttcaccatattggccaggctggtcttgaactcctgacctcgtgatccgcctgcctcggcctcccaaagtgctaggattacaggcctgggtcaccgtgcctggcctgtttttgtttttgagatggagtctcactctgacacccaggctggagtgcagcggcacgatctcagctcactgcaacctccacctcccgggttcaagaaactctcatatattgctggtgggaatgtaaaatggtacagctgcttcaggaaagtttggcagttcttcaaagtttgttttgttttttgagagagagtctcgctctgttgctcaggctggagtgcagtggtgcaatcttggctcaccgcaacctccacctcccaagttcaagcaattcttctgcctcagcctcccaagtagctgggattacaggcatgtgccaccacactcagctaatttttgtatttttagtagagttggggtttcaccatcttggccaggctggtctcgaactcctgatctcaagtgatccacctgcctcggcctcccaaactgctgggattacaggcgtgagccacttcactcggtcagcattgtggttctagttcactgagctcaatgtccctgtaccccgtgagtgttccagaccttggcaccaacctgaagtgcccgaggtggggcccccacccccacagaggatggtgcctttctctttcctttccatacatttctaggagccttcccagccccaggagagcaggtaggattgtccccattttaagtgacttgtctgagatgttgggcaaattcgtcccttcaagggcaacttctcggctctccactgaccacatcctaaactttttaatggcatcaggacggggaagccaagcccgctcttctgtggctggtgggggtgggggcagggctgcctcctaatgtccctgacgtggtccaggatcgatctgacggggcgggggtccggctgccagcacctgtctgcctgcctggtggcctggccacgggcttctccatggggagctggctctgttctttccagggtaagccatccgggccgctcttgccctgggttccccggccgcctctgctgagcagagactctgttctcctggtttgggaggagggggcacagaagtggggtttggagttccatttggttcaggaagaatgcccagcagagcctgggattcaggacggtgtgggctgctggagggaggaacccttctttagggctggatgctgcagaggctgggcctggggtgaccacaggagagaggtgagtttcagacggacccctccctggtcggggtgggctgggggatgtagactcggtcctccctggagcaggcatggactgaggggtggaaacaggttggggtggacccaatgcggggactgccggagggaaagtggcctcttcaaggaatgctgtggagaccccattccttccttcgtaacctctgcctttgagcaccttcgggagagaaaaggaggctcaggagagaaagccatttgagatttttggggcactgatgcatgttcctttggggccaccaggaagcgggagtcaggtgtgtggcccgtctgcatttcagcccagggggtccaggggatgagaggggagttggtgtgagtccacctcctggggctcatgttctgggggtgtgcagacatgcaccccagttagcctgggagtcaggttgtgcaaaccaagggggaacagagccccatggggttgggagggagagagacacagtgggccccttgagatggctgcagatgaggggatgtggagttgctatggacgggcatgaggacttccttaggtgatcctaagggtaaagtgctgtactcaaggcagaaggatggagctttgcctgaaacagcctgcttgatgcctgtggtattggtaaaatgcctttttttcttttcttttatttcttttgagagggtctcactctgtcacccaggctggactgcagtggtgcgatcatggctcactgcagcctccaactcctctctcagcctcccaagtagctggtgcgcaccaccatgccctgctaatttttgtattattatttatatatatatatatttttgagacagagtctcattctgtcgcccaggctggagtgcagtggtgcgatctcagctcactgcaagctccgcctcccgggttcaggccattctcctgcctcagcctcccaagtaaccgttaggcacccgccatcatgcctggctaatttttttttttggttttttttttttttttttttagtagagacgaggtttcactgtgttagccaggattgtctcgatctcctgacctcgtgatccgccctcctcggccttccaaagtgctgggattacaggcgtgagccaccgcacccggccatttttctattattttatagagacaaagtctcgctatgttgcctcctgagctcaagtgatcctcccgcctcggcctcccagagtgctgggataacagacatgagccaccacacccggccagcatgatgctatattaagagcacctctcattcccagaagcacccgggtttgaatgttaaatcatgtggtcgccttatttatagcccctcctttgtggtcaccgtgctcattggtacatcaaaggctctgaaaagtcctgcagacaagtacccttcactttgttgaagttgctgtttctcaagcttctttgaacttggaggttaaattgtttgtttgtttgtttgtttgtttgttttcataatacctaggaacagcctgtggagctatgttctgtggaacatttaagaaggaaccagatcctagcagaggacacttttttatctgcccccaaaccactggggcagagggctgagttcatcacacattcacttcatcacatgtcaacattgtgggtccctgcaaggtccctcttggttattttatttatctatttatttatttatttattatttgagacagagtcttgctctgtggcccaggctggagtgcaatggcacgatctcagctcactgcaacctctgcctcctgggttcaagcaattctcctgcctcagcctcccgagtagctgggattacaagcgcgcgccaccacactgactaatttttgtagttttagtagagacggggtttcgccatgttggtcaggctggtctcgaactcctggcctcaagccatccgcctgccttggcctcccaaagtgctgcaattacagatgtgagccactgcatccggctattttttattttctattatttttacttttttgtagagatgagatctctctatgttgcccaggctgatcttgaactcctggcctcaagcgatcctcctgcctcagcctcctcagtagctgggactacaggcttgagccactgtgcctagcttcctcttggtgtttcttttcttttttttttttttctttcttttttgagatggagtctcgctcccgtcacccaggctgaagtgcagtggcgcaatctcggctcactgcaatctccacctcctaagttcaagcgattctccttcctcagccttccgagtagctgggattacaggtatgcgccaccatgccttgctaatttttgtatttttagtagagatggggtttcgccatgttggccaggctggtctcgagcttctgacctcaggtgatccgcctgccttggtctcccaaagtgctgggattacaggtgtgagccaccacacccagccggtgtttcttaattgattcattttttgttgttccctattcctcttcccctacccccaggccaccatgccctgtgctggatgtcgggatgctcctgaactctgctgtgtcaccaagaatcacatcataaacactgtcctacataacctggacaaataatgttttaaaggttgcttaataatctgaataatgtgaccataatttatgtaactgctccttggtttggaggctcttagattcagttttttatttttgtgaaggtcaaaatagtgagtcagtttttccttttctaaattatttccttgggaaatagactaaagagtgcattccttattttattttttcttttaaaacatattaagatttctggctgggcactatggctcacacctgtaatcctagcactttgggaggctgaggtgggtggatcacctgaggtcaggaattcgagatgagcctggccaaaatggcaaaaccccgtctctaccaaaaatacaaaaaattagccaagcatggtggtacacgcctgtaatcccagctactcgggaggctgaggcaggagaatcacttgaacccaggaggtagaggttgcagtgagccgagatcatgccactgcactccagcctgagcgacagagtgagactccatctcaaaaaaaaaaaaaaaaaaaaaaaaaaaaaattcaggtgagcctctgagccctgagaaggaggcataaatgaattaggagtgatttcttccgtggaattgctagactgggggaaggatgagccagtagagcaatggcgatttgcaacctgagtgcatgggtggttgcagggcctcctgagatatggaggatggtggaggagctttggcaagagctgaggaaggaggtcatgtgggttcaggatgttgggtgtaaggtcctggaggaggcaggtcttgatcctgactgaggtgagcaagaggggatcaatttgtttctttctttcttttcttttcgttttctttttctttctttctttctttttttttttttttttttttttgagacagagtctcactctgtctcgcccagactggagtgagtgcagtggcgtgatctcggctcactgcagcctctgcctcctgggtccaagtgattctcctgcctcagcctcctgagtagctgggactttagatgcctgccaccacacccagctaattttgtgttttttaagtagagacggggtttcaccatgttggccagactggtcttgaactcctgaactcaggtaatccacccgcctcagtctcaaagtgctgggattacaggtgtgatccaccacgcccagccgggatcagtttcattctacatcttcctgtgtcatttgaatcatttacaaggagagtgtatttgtgtcttaaagaaaaaaatgtggtcacatgtaggcagtagctaaagctgtagcagttggtagattattgtggtgggtggggggcaccatgtagatcggggtcccctgctactgatcagagaagaaggtttgttgttgttggggttttttgttttttggagatggagttttgctcttttgcccaggctggagtgaagtgatgcgatctcggctcactgcaacctccgccccccaggttcaagtgattctcctgcctcagcctctcgagtagctgggattacaggtgcccgccaccatgccaggccaatttttgtatttttagtagagacgaggtttcaccatgttgaccaggctgttcttgaactcctgacatcaggtgatctgctcacctcagcctcccaaagtgctgggattccaggcatgagccactgtgccccgtgtaatttttttctcagaggcagtgtctccctattgcccaggctggattgcagtggtgggatcatgcctcactgcagcctagaattctcttttttttttttttttttttagagatggggtcttgctatgttgtccaggctggtcttcaactcctgacctcaagtgatcctcctgccctggcctcccaaagagctgggattacaggcacaaaccaccatgcccaaccagggtgatgagttttagataaagcagtcaggaaaggcttctctgaggaggtgagggagccagctctgtaactttcctggggcaagaggtcgtgggaaatacccacacccacatcattcgaggtggagccctccctcccgctcccccgggtaccacattttgggttccttcctcagttacgcacatggcgtggcaagctgaattgtagttgctggcatccccactccacccccttgccgggccccgtttggccatgcctcttgtccagtgtctgacacagagtctggcacctagtaggtcctcaggaattggggtccctcctgatgagattgagcaggaaaagccagtccccacctccacaggcagggcaggacccgcgtcctcgcaggcggaggggagaatgcgtcatctgggcgccctttttatccccaccggctgcaggaccacgccaccagctgcagccaccctgcaccgtgtccttaggcccttgtcatgctttgaacttgaaacttgcagtaaattcctttgtggctcttgtctgggtgggaatcactgtctggggaataaatcaactgcatgtaggaggtttattttaatttttttttgagacagagtcttgctctgtcgcccaggctggaatgcagtgatgcgatttcagctcactgaaacctccgtctcctgggcttaagcgattctcctgcctcagcctcccaagtagcttggatcacaggcacctgccaccacgcccagctaattatggtatttttagtagagatggggtttcaccatgttggccaggctggtctcaaactcctgacctcaggtgatccacccacctcggcctcccaaagtgctgggattacaggcatgagccaccttgcccagcctattttaattcttttggagatgaggtctcgctctgtcgcccaggctggagtgcagtgatgagatcatggctcactgcagcctccactccctgggctcaagcaatcctcctgcctcagcctcccgagtagctgggactacaggagcgagccaccatggctggctaatttttgtatttttttgtagagacagggtctcactgtgttacccaggctggtctcaaactcctggcctcaagcaatcctcctgtctcagcctcccaaagtgctgggattacaggcatgagccatggtgcccagcctcatgtgaggtttaagtctgtgttgctgggcccagctggaagtcactagtggctctttgccttcgcgggggtttgctggggaactcagagggcagtgaggcccaggctgtgcccacagggagctcccaaacagcttgcctttggcctgcgaggatatggaccgaggaagctcctgttaaccaggtttcaaaaactccatcgtatatacattggctcccctgggaggagacgtaggacatggagaatgtcagcgctggaaaggaccttagctatttctgacctagtcctttgttatgtcatggagaaactgaggcacacatctgggaaggccagacttggctcgccctggccaagccagtatgtcactgatgactccctggagggatagggaatttcccatggtttctcaactgcaggaagctgaaaatgtctcagcgtgcatggaatttgatgagcgttttgtccctgtgatgcgggggcagccgagagtcccactactcagaggaagaatgaagcgaagtatcacgtgcagttgccatgggctcgtggcttggatttttgcagctgttgaaacaactggtccctgggcctgtgacccctgggaggggagggagtcggggagagattacctgagggtccgcctgggcccggacagctggggacaaggacagctgagcaggcagcttctcaccaagaatagccatgctgggtcaccttcgacctggggacccttctctgggctctaagcacagagggcaggtagaaacagaccttagctgggctacagtggttctgttcagttagcagaggtcacagagctctctctgcataggaaagtgccctagaaatggatatggggtaggagctggcacctgccaggcacccactgtgcgtgtggtcaagagggagggttctggctgggcgtggtagcttgcacctataatcccagcactttgggaggccaaggcaggagggtcacttgaggccagaagtttgagaccagccttaccacatggcaaaaccccgtctctaataaaatacaaaaaaaaaaaaaaaatagcctggtgtgctggcacgcacctataatcctggctacactggaggccgaggcatgagaattgcttaaacctgggaggcgaagattgcagtgagcagagattgcaccattgcactccagcctggggactccagcctgggcaacagagtgagactctgtctcaaaaaaacaaaagagggagggttctgaagccagactagctgggtgtcctactcggcctgagtgaccttaccctctgtttccaaatctgcaaggtaaaaatatgatgtattcttataatgaatagcccagcgtggtggtgcatgcctgtaatcccagctactcgggaggctgaggcaggagaatcacttgaactcaggaggtggaggttggagtgagccgagattgcacaagtgtactccagcctgggtaacagagcgagactccatctcaaaaaaaaaaaaaaaaaagtgccctgtccattgaggagcatgcagttggcacttcataaatgcagctgctatcttaattattttattttgttatatttattttttgtagagacagggtcttgctatgttgcccacactggtcttgacctcctgggctcaagtcatcctcctgtttcagcttcccgagtagctgggattacaggctgcataactgcacctggcttatttattcatttatttatttatttataagagatgggggtcttgctatgttgtgcaggctgttcttgaactcctgggctcaagtgatccacttgcctcaacttcccaaagtgctgggattacaggtgtgagccactgtgcctggcttattttccttccttccttccttccttccttccttccttgcttccttcctttctctttttttctttctttttttcttccttccttcctttctttcttttctttctttcttttctttttttttttgatggagtctcactctgtcgcccaggctagagtgcagtgacgcgatctcggctcactgcaacctccgacttccgggttcatgccattctcctgcctcagcctcctgagtagctgcgactacaggcgcccaccaccacgcctgactaattttttatatttttagtagagacagggtttcaccatgttagccaggttggtctcaatctcctgacctcgtgatccgcccgcctcggcctcccaaagtgctgggattacaggcgtaagccactgcgcctggcctctcttcttttctcttttttcttttctattcttttcttttctttcagatagagtcttgctctgtcacctaggctggagtgcaatggtgccatcttggctcactgcaacctccgcctcctgggttcaagcaattctcctgcctcagcctcccaagtagctgggactacaggcatatgccaccacgcctggctaatttttgtattttcagtagagatggggtttccccatgttggccaggctggtctcgaactcctgacctcaagtgatccgcccaccttggccccgcaaagtgctgggattataggcgtgagccaccatgctcagcatgagactgggtaatttataaaggaaaagaagtttaatggactcacagttccatgtggctggggaggcctcacaatcatggtagaaggcaaaaggcacgtcttacatggcggcagacaagagagaatgagagccaagcagaaggggaaacctcttataaaatcttcagatctcgtgagacttattcactaccaccacaacagtatgggggaaaccacccctgtgattcattaagctcccactgggtacctcccaaaacgtggaaattatgggagctacaattcaagatgagatttgggtggggacacagccaaaccaaatcagtcctgctgcctattgtctgggagctcaggtgaagcacctgatatctctgagcctcagttttctcatctgtgaaatgggggcaattggggatcagatgagctatcgtatgttaagctcttagcacagagtctcatgcaagcctgtgattactatggttgtttgttttttttgttttttttttttttgtttttttttgttttgtttttttttttttgagacagagtctcactctgtcacccaggctggagtgcagtggtgctgtctcggctcactgtaacctctgcctcctgggttcaagcaattctcctgtctcagcctcctgggtagctgggattacaggcacccactaccacatccggctaatttttttgtatttttagtagagacggggtttcaccatgtgggccaggctggtcttgaactcctgacttcaggtgatccgcccacctcagcctcccaaagtgctgggattataggcatgagccaccaaacctagccacccttccactttccggggtctgtggaccctgaggccttaggctgggctgcagcttggggaggggagaaagggggaggcccaggagagagttaggagggttttctttcctgtcccaagagagacagaaggggacatctttatgcaagaagtctgtggctgtgtccctctattaggaaataggctggtagccttttgtgggccctgtaaccgtctgagggcgaggatgggggtctcggagaccacttgcacaacacctaggtcccacataggggccacagggggtctcgggtcaacagctgagggcctgagcccacctggtgggggggtggcttgtaatccttgagaacgggttcctccctggcccaggacttacagtttccttgagaagtggaaagccattgcttctttttttttttgtctttttaaaaatgaagtctttctctttcccctaggctggagtgcagtgatgtgatttcaactcactgcaatctccacctctcgagttcaagtgatcctcccaccttagcctcctcactagctgggattacaggcacctgccaccacacctggctaattattttatttttagtagagatggggtttcaccatattggtcaggctggtcttgaactcctgatcttaggtgatccgcctgcctcggcctcccaaagtgctgggattacaggcatgagccaccgtgcccggcctggaaacattgcttctgagggcgtactttcctggggacgctctggagggctggaagagtagggggagacctgaggaggacctgcccaagaccacacagccaaccattcctgcctcggtttccatggcaagaccatgtctctacaaaaaaatacaaaaattagcccagtgtagtggcaggtgtctgtggtttcagctactcgggaggctgaggtagaggattgctggagcccaggaagtcaagactgcagtgagccaccatatcgccaatgcactctagtctgggtgacagagcaagaccctgtctcaaaaagtaaataaacaggggttgggtgtggtgcctcacgcctgtaatcccagcaatttgggaagccaaggcgggcggatttcttgaggtcaggagttcgagaccagcctggccgagatggtgaaaccccatctctacccaaaaatacaaatcagccacctcccaaccctagactctgtgctcctggggccacccaggggccagccctaacagccacctctttccctttccctctccttctctgcaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggtgagtgcgggcagtactgggctctgggcccagcttcccttccctcccctgctccgccccacttggcgaagctggacccccctgggctgggcagggtggggactcgaagggggctcggacagggtccagcctgggacacccattccttatcaggaccatacagagtgacaagagagacaggtaatgtgggctctggagactgttgctgtgtgaccttgggcaagtgtcctaaactttctgggcctcgctctttctatcggtaaaatgggatatttatttatttacttattttacttatttatttatttatttatttttgagatggagttttgttcttgtcgtccaggctggagtgcagtggcgtgatttcagctcactgtaacctccacctcccaggttcaagcaattctcctgtctcaccctccctagtagctgggattacaggcatgtgccaccacgcccggctaatttttgtattttcagtagagacggggtttcaccatgttgaccagactggtcttgaactcccgacctcaggtgatccacccgccttggcctcccaaagtgcttggattacaggtgtgagccccagcgccctaccaaaatgggaattttaatcgtacttcagtcatagttggagatgcattaaaacgtatcactcatttagacagtgcctaatactaagtacccatacattttggctattattgatattatctattgatccagctcatccacatgcatgtgccaggcatgtactggaaaaggctgggaactggagttctcaagacccctggtcctggccaggcacagtggttcgtgcttgtaatctcagcactttgggaggctgagatgggaggatcacttgagcccaggagttcaagaccagcctgggcaacatagtgagaccccatctctacaaaaaaaaatacaaacaaaattagccaggcatggtggcatgaccctgtactcccagctactcaggaggctgtggtgggaggatggcttgatcctgggaggcagaggttgcagtgagccaagatagtgccactgcactccagcttgggtgacagagccagaccctgtttcaataataataataataataaggccaagcacggtggctcacacctgtaatcccagcactttgggaggccaagtcgggcaaatcatctgaggtcaggagtttgagaccagccttgccaacatggcgaaacaccatctctaccaaaaatacaaaaattagctggctgtgatggcgtgtgcctataatcccagctacttgggaagctgaggcaggagaatcacttgaacccaggaggcagaggtttcagtgagccgagatcatgccactgcactccagcctgggtgacagagtgagactctgtctcaaaaaagcaataataataacagtggtaatggttataaccccttgcccagggccaggaggtgcagacaccttatcagctacaactcgagtgatcagtgttattgaagttgagagaattgggtcactggagctgacagcttcctgccaggggcccctcttctccactagtcccagctgttggggccaggttggaaaggggacagtgacccccaagtcttctagagtctgaatacagcagtgacctgggttggtggtagtcaggtggatgggacagggctgtgtcttgctgtccagccaggctgtggtggccttgggctaaccctgcacctgggaccacagtgttgggaagagactcatagggtacagggaaggccctgacatggacttctgggcctggggtgtgaggagctgtcggtggggcaggggtccctgtgtcctgtctgcaaggcttcctgggggaaggtggttggtcattccaacccgaggtggggagcacaggcttggagctccaaagccgagtggagaagggcagggggtctggggacccagagcagggatccccaaagcatattgctgcctgggatcctcccttcctgctctgagaacctggcaaaggtttctcctggaggtttctgggaggagcctttggggttgtgggtaggggagcgagaggtaatgtttacacccatggccccgttgaatcttcaagcctgtgctgtgatgctgcgatgtggttttatcatcctcactttatggatggggaaactgaggctcagggaagtttttgtttgtttgttttttgttttgttttgtttttctagtctcactctgttgccaggctggagcgcagtggtgcgttctcggctcactgcaacctccacctcccaggttcaagcaatcctcctgcctcagcctcccgagtagctggggctacaggcacgcaccatcacgccctgctaattttttgtatttttagtagagatagggtttcaccatgttggccaggatggtcttgatctcttgacctacccacctcggcctcccaaagtggtgggattacagacgtgagccaccgtgcccagcctcaggaaagtttaataacttgtctgaagtgacatgtgacaagtgcctgcccactgttcactgagttgtatttcctgtctgccctgccctggccatggtgagggctctgcttttcttttcttttttttttttttgaaacagggtcttgttctgttgcccaggatgaagtgcagtggtgcagtcatagctcactgcagcctcaaacttggactcaagcaatcctcctgcctcagcctcccaagaagctgggactacaggcccatgccaccatacctggcaccacgcctttgctagcctggttcctctggacagaacttcccctgggtgacctggtggtgagcgtggccagatgtagtccctgccctccagccatctccagcttacaggagagagaccacgaggccagtgatcgcagacatcagtgtctccctacagagtctgccaagtgtgctgtggtgctctcagagcctggcctggtggggaggctgccccgaggaatggttcccccgagggcagaacttagggaatggcctggcattggcctagtgatgtggggccagagcatcgtgccaggcagagacccatggcctgagagactagagaaactgtgagaagaggcctggcatggtggttcacacctgtaatcccagcactttgggaggctgaggcaggtggatcacctgaggtcaggagttcgagaccagcctcaccaatatgttgaaaccctgtctctactaaaaatacaaaaattagccggatgtggtggcacgtgcctgtagtccgagctactcgggaggttgaggcaggagaatcgcttgaacctgggaggcggagattgcagagagccgagatcacgccattgcactccagcctgggtggcagagcgagactctgtctcaaaaaaaaaacaaaaaaaaagaaactgaaaagagcagggaggctgagtgggcagtgggggaagccagggaaagatcacatcccagaggctgacctgggtgaccccacagggccagggacctgggatggagccagggctttgctctaagagctgaggtagccatggaagctgcagctgtgtgacaggttcatgggttaaggacatcacacctgctgcttggtggggatgggatcggaggaggcaagagtggagcaggggccgtgtgcggtggctcacacctgtaatcccagcattttgggaggccgaggtaggcggatcacttgaggtcaggagttcaagaccagcctgggcaacatggtgaaacctcacctctactgaaaaatacatggtggccgggcgcggtggctcacgcctataatcccggcactttgagaggctgaggcaggcggatcacgacgtcaggagatcgagaccatggtgaaaccccgtctctactaaaaatacaaaaaattagccgggtgcagtggcgggagcctgtagtcccagctactcgggaggctgaggcaggagaatggcgtgaacctgggaggcggagcttgcagtgagccaagatggtgccactgcactccagcctggatgacacagccagactctgtctcaaaaaaaaaaaaaaatggtgacgggcgcctgtaatcccagctactcaggaggttgaggcaggagaattgcttgaactcaggaggcggaggttgcagtgagctgagatggtgcggctccactccagcctgggcaacagagcaagactccgtctcaaaaaaaaaaacaagaaaaaaacccagagtggagcaggaacggcagggcccaggaaggaggctggactcctggacccctgcaccatcctgtccaaggaacttgttttgggaccgtcactctgctcttcctcctgtggctcccaggaaagccaaccccatccaacaggacctgggcaaacagcttagtctccctgacctgtccttcaggatctccggggtctgtgggcacctactgggggtgggtacagcagggaaatcaggcccaggtctgtgatattgggcaagtcacttacagagcctcatcttcattcattcattcattcattcattcattctccatgtgtctgttcagcaaaatggccatggcccagcactcttgttttgctttatgcttttatggagagcattaagagagctgatggcagccgggcacggtggctcgtgcctgtaatctcagcactttgggaggccaaggcaggcggatcactcaaggtcaggatttggaaaccagcctgggcaacatagcaagaccccgtctctactaaaaatacaaaaaaaaaaaaaaaatagccgggcatggcggtgcatgcctatgctcccagctactggggagactgaggtgggaggatcacttgagctcagggggtcaaggctgcagtgagccacgatgggaccaccgcactccagccagggtgacagagtgagacgctgtcttaaaaaaaaaagagagagagagagaactggtggatgtgaggatgagtcatagtctgcaaggagctatggctgtgcacagtctgactaatgtcgtgggagtgccctgggcatgggcctgtgaccctgttggggtgggaagtggaggctctgggggttactgaccagcccagattgctccctggattggggagcagtaggtttaaccctagtttgatcccgcctggcattccctctgcacctgctctccctgcagggagtagatgcttctgaccatctctgggtgtggtgtgcaagagaagggcatgaggtgggcactgccactgccctagaagtgtctgctaagccctggcctgtctgcagggttggcagcagcaagggggctgggctatcttgaccttagcttctcaatctttaagtagattgcatcctatggttgaaacactgctttctgggagggcatacctcacactgggcactgtgcctagcatggttttttttgagacaaggtcttgctctgtcactcaggatggagtgcggtggtgtagtcatagctcactgcagcctcaaactcttaggctcaagcgatcctcctgcctcaacttctcgagaatctgggactacagatgtgcaccaccatgcctgcctaatttttttaatttttattatttatttattttttttgcagagatgggggtctcgctacattcctcaggctggcctcaaattcctggcctcaagcgatcctcctgcatcagcctcccaaagtgctgggattacaggcatgagccactgagcccagcctaatcgaggatttaggctagggaagagaaaggacattcgaggttggaattacagagcagcaggatccaagactgattgtgtagacagagtggcagagacctggtgccagagaggaggggctgagaaagcagtcccacctgaaggccagagaccagagagaacaacccagtctcacagacgggcctccatggcagagacaccagggccctacccaaggaggagacagaggagggtgggatctggtctggaatcaagcccagctgggattgagaaggccacagagtgtagtaagaagaggtccacctgtctctttcactccctggctactctgaacttcagtctcttcttccatgaatgtggtaacagtacccgcctcatggaaatgtcagatttggaattcttgtctttcatgtgccaggcacatgtagttggccctaggagatggtgggacaggagctagttttaattggggagctggatttacttaggcacaatgaggcatacttggggtgtcaagagaaattaacattttatttctttaatttttttttagacagagtcttgctctgtcgcccagagtggagtatagtggcgcgatctcgactaactgaaaactctacctcccaggttcaagcgattctcgtgcctcagccttccaagtagctaggattacaggcatgcgccacccacctggctaatttttgtattttttagtgagacagggtttctccatgttgccaggatggtcttgaactcctggcctcaagtgatccacccacctcagcctcttgaagtgctggtattacagtgagtccagaagtaaaatgaaattaacattttagaaagtcataggccaggcatggtggctcatgcctgtaatcccagcattttgggaggctgagggtgggtggatcacctgaggtcaggagttcgagaccaacctggccaacatggggaaacatggggaaaccccgtctctgctaaaggtacaaaaattagccgggcatggtggcaggtgcctataattccagctactcaggaggctgaggcaggagaatcgcttgaacccgggaggcggaggttgcaatgagttgagatcctgccattgcactccagcctgggcaacaagaatgagactctgtctcaagaaagcaagagagagagagagaaagaggaagaaagaaatatttaggttcagataaacatggtaaataaacatacacatttattttcaatctctcctgaatttgcactagaacaacactgaagagatgtttgggttttttctttttttgagatggcttcttgctgtgttgtccaggctggagtgcagtggcatgatcctagctcactgcaccctcaaactcctgggttcaagcgatcctcccaactcatcctcctgagtagttgggactacaggtgtgtgccaccacacccagctaatttcttaatttttttttgtagagaggggtcttgctatgttgcccaggctggtcttgaactcctgggctcaagcaattctcctttctcagtctcccaaagtgttgggattacaggtgtgagccaccacatgcagctatgaagataaatttttttaaaagagctagtggtaggggaagaggagaagcaatcagtgtccatccggaaaccctagatgttcagtaactggccgcatgttggcctctagaaatgaggctgccactggggccaggaacagaattggtttaaaagtctttgcatctgggcacagtggctcacgcctataatcctggcattttgagaggccaaggtgggtgaatcacttgaggccaggagttcaagaccagcctggccaacatgacaaaaccccgtctctactaaaaatacaaaagttagctgggtgtggtggcgcacgcctgtaatccaagctcctcaggtggctgagtcaggacagtcacttgaacctgggaggcagaggttgcagtgagctgagatcacgctgctgcactccagcctgggagacagagtaagattctcaaaaaaaaaaaaaaaaaaaaaaaacaaaacactggccatgcacagtggctcacacttgtaatccaagcactttgggaagctgaggtgggaggattgcttgagcccagcagttccagaccagcctgggcaacagagtgagaccctgtctctacaaaaaaataaaaaataaaattattcaagtgtggtgtcgcatgcctccagtcccaactactcaggaggctgaggagggaggactgtttgagcccagaagttcgaggctacagtgagccatgaatgcaccactgcactccagcctgggtgacagagggagaccctacctctaaaaacaaaacaaaacaaaaagaaaaacaccttagatcccttgccccgtccccgttcctgccttgcctgatgactactcgttgcctggtgactgttccccttgcctggtgactgttcctctagctgatgtctggtatggacacttggtctcctgagaggatgacagagaattattggatagaggggtcccaggcaggagggactgaaaaaggtagatgaagtgaacatgtgtattctttttctttttaagatggagtctcactctgtcgcctaggctggagtgcagtggtgcgacctcagctcactgcaagctccgcctcccgggttcacgccattctcctgcctcagcctcccgggtagctgggactacaggtgcccgccaccacgcctggctaattttttgtatttttagtagagatggggtttcactgtgttggccaggctggtctcgatctcctgacctcgtgatctgcccgcctcggcctcccaaagtgctgggattacaggcgtgagccaccgcgtccggccaaacgcgctgtactctaagtcccccttacccccacgcggctccctgagccctggcggccacgcctactccctctacaatggagattacaggaaacttctctggagaaaacagctggtcctctgagaaataagagaaggtgatacaggcattaaatatgaacaaaaacgccactgaatatgtgactatgaatattcatgagcatgaatattcatgttgtataaatattcagctctgggaaatgaaaaatatcacagaaataagaaactgcacagaagtgttagaagataaagataagaaaatatttcaggaactagaacagaaaggaaacagcccaggggcgggggctcacacctgtaatcccagcactttgggaggccaagacgggcggatcacttgaggtcaggagttccagaccagcctggccaacatggtgaaaccccatctctactaaaaatacaaaaactagctgggcgtggtggcaggtgcctgtagtctcagctactcgggagaatgaggccgtagaattgggaggcagaggttacagtgagccgagatcatgccactgcactccagcctggggaacagagtgactccatttcaaaaaaaaacaaaaacaggagccaaaagagaagaacattagagaacctatttacagaaaagaggaatggagaaaaaggaggggagaaaatcaaataattaattcaagaaaattccccagattgataagggtgtttcttgattgaaagggcccctaggagcccaggacagtggatggaaaaaggctcacatcaaagcacctcattgtggctgggtgacgtggctcatacctgtaaccccagtgcgttgggaggctgagatgggaggatcccttgagcctaggaatttgggatcagcctgggcaacatactgagaccctgtctcttaaaaaaagaatgagagggccgggtgcggtggctcacgcctgtaatcccagcactttgggaggccgaggcaggtgaatcacaaggtcaggagatcgagaccatcctggctaacacggtgaaaccccgtctctactaaaaatacaaaaaaattagccaggcatggtggcgggcgcctgtagtcccagctacttgggaggctgaggcaggagaatggcatgaacccaggaggcggaggttgcagtgagccgagattgcaccactgcactccagcctgggcaacagagcgagactctgtctcaaaaaaaaaaaaaaaaaagaatgagggtagcaagagaattcaaaacagatgttcacacaaaaacttgtacaagtaggtcaggcgtgatggctcatgcctgtaatcccagtactttgggaggccaaggcgggcagatcacttaagctcaggagtttgagaccagcctgggcaacatggtgaaacctcgcctatacaagaaaaaatttaaaaaaatcttgtacaagaatattcatagcaacattattcataatagccaaaaagtggaagcaacccaattgtccatcaacagataaatggacaagcacaatgcattctgcccatgccatgggatactatttggccacaaaacgaatgaagtactggtcgggcatggtagcttacgcctgtaatcccagcactttgggaggccaaggcgggcagatcacaaggtcaagagaccgagaccatcttggccaacatggaaaaaccccgtctctactaaaaatacaaaaattagctgggcgtggtggcacgtgcctgtaatcccagctactagggaggctgaggcaggagaatcacttgaacccaggaggcagaggttgcggtcagctgagatcgtgccactgcactccagcctggcaacaaagcgagactctgtctcaaaaaaaaaaaaaaaaaagtatgtatgtgtgtgtgtgtgtgtatatatatatatatatatatatatatatatatatatatatgtaaataaaaattaaaaatcagtggggtagtgatacctgctgcaatatgattggaccttgaaaacatgatgctaagtgaaagaagccagacacaaatggccacatattgtgtgattccatttccttttgagataaagtctcactcttgtcacccaggctggagtgcaatggcacaatctcggctcactgcaacctctgcctcacaggttctcctgtcttagcctccggagtacctggcattacaggcgtgcaccaccacgccccgctaatttttcgtatttttagtaaaaatagggttgcaccatgttggccaggctggtctttagctcctgacctcaagtgatccacctgcgtcggcctcccaaagtgctgtgattacaggcatgagccactgcacccagccgtgtgattccatttctatgaagtgtccagaagagacaaatctgtagcgataggatagaaatagactaagggttgtcaggggctgtcaggaagatggaacaggcagtgatttctcctgggtatggggcttctctttgggatgatggttattattttttgaaatggagtctcactctgtcacccaggctagagtgcagtggcgcaatctcagctcactgcaacctccgcctcctgggttcaagcgattctcatctcagcctcctgagtagctgggattataggcgcccaccaccacgcccagctaatttttatatttttagtagagatggggtttcaccatgttgcccaggctggtctcaaacttctgagctcagctgatccacccaccttggcctcccaaagtgctgggattacaggtttgagccactgttcctggcctgtatgtttattttttattgttgtattttattttttatagagatgagggtctcactatattgctcaggctggtctcaaagtcctggcctcaagtgatcctcctgcctcagcttcccaaaacactaggattacaggcatgagccaccatctttgggccctatatgttttaaaatggttaaaatggtaaattttacattatgtgaatttttacctccattaaaaaaaagagtgagccaggcacagtggctcacgcctgtaattccagcactctgggaggctgaggaaggaagattgtttgaggccaagggttcaagaccaggctgggcaacatagtgagctctcatctctactagaaaatgttcaaaaattagctaggtatcgtggtgtgttctgtaatctcagctacttgggaggccaaggcaggaggatcacttgaactcaggagttcaggctgcagtgagccatgatcgcaccactgcactccagtatgggtgacaaagtgagagcctgttgaaagaaagaaagagagagagagaaagaaggaaggaagaaaggaaggaaagggaagggaaggaagggaaggaaaggaaggaagggaaagaaaggaaggaagggaaggaaaggaaggaagggaaggaagagaagaaggagagaaagaaagaaggaaggaaagggaagagaagggaaggaagggaaggaagagaagaaagaaagagaaagaaagaaagaaagaaaaagaaggaagggaagggaaggaagggaagaaagagagagagaaagaaagagagagagagagagagaaagaaagagaataaaatattttggccaggcacggtggctcacgcctataatctgaggcaagcactttgggaggctgaggcaaatggattgcttgagcccggaagtttgagaccagcctgggcaatgtgacgaaaccccatctctacaaaaaatagccaggcgtggtgccctgtgcctgtagtcccagctacttgggaggctgaagtgggaggatcgcttgtccaggaggccaaggttgtggtgagccgagatcacgccactgcattccagtgtcaaaaaaaaaaaaaaaaaaaaaagaataaaacattttcagatatagaaagctcgaaaatttacctcctcgtgcatcttttcttagaaagctgtgggaagatgtgctctactaaaataagtagtaaaccagccagacgtggtggctcacacctgtaatcccatcactttgggaggctaaggagggcagatcacctgaggtcagaagtgcgagaccagcctggccaacatggcgaaaccccgtctctactaaaaatacaaaaattagccgggcatggtgacaaacgcctataatcccagctactccggaggctgatgctggagaaccgcttgaacctgggaggcggaggtttcagtgagcggagatcgcgtcattgcactccagcctgggcgacagagtgagactccgtctcaaaataaataaataaaataaaataaaatacaataacataacctaaaataagtagtaaaccaagaaagaagagtcaggggatccagaaaacaggagcaagcccaggacagaggtgaaatggttgacaggagactccaggccaatggccgcactccagagaggccagcagccagcccagctgggagtgggtcccgggagagacatcttcagaaagaacttgataaaattcccaatgcctctgagcatcttggcaggagatttagactattgaaagagttggggttgaattagtattgagactattaaaactaggcagacaggccaggtgcagtggctcacacctgtatcccagcactttgggaggccaaggcaggtgaatcacttgaggtcaggagttcgagaccagcctggccaacatggtgaaaccccatctttactaaaaatacaaaaaaattagccgggcatggtggtgcatgcctgtagtctcagctaatcaggaggctgaggcaggagaatcacttgaactcgggaggtggaggttgcagtgagctgaggtcgtgccactgcactccagcctgggcgacagagtgagactctgtcttaaaacaaaaacaaaaacaaaaaaaacactaggcagacaatcatcaaagatagttatttataggaaaaaaaaatttctggaaaggaaaagtaactacaatacatcatcctcatctatgagtactatctacttagtcatagtactgcaatcctggagtcagatcaaaatttagatatggaatacaaaaattagctgggcgtggtggcgcgcacctgtagtcccagctactcaggaggctgaggtaggagaatcaacactgtctcaaaaaaaaaaaaaaatttttagatatggaccaggtgtggtgattcacacctataaatcccagccctttgggaggctgagacaggaggattgcttgaagcccggagttccagaccagctcaggcaacatatcaagaccctgtgtctacaaaaaatttttaaaaacttagctgggtgtggtggcacatacctattgccccatctactcaggaggctgaggcaggaggattgcttgagaccaggaatttgagaccagcctgggcaacatagcaagatcctgtgtctacaaaaaattttttaaaaacttagctgggtatggtggcacacacctatagtcccagctactcaggaggctgaggtgggaggattgcttaagcccaagagtttgaggctacagtgagctatgattataccattgcactccagcctaggcaacagagcaggaccctatctcaaaaaaaaaagaaaaagaaaaactgcttttagggttaccatttattgaagctctagtatatactagacaccgtatatacagtacttaattctcacgaaaaccctttttttttttttttgactcagagtctcgccctgttgcccaggctggagtgcactggcgcaatctcggctcactgcaagctccacctcctgggttcatgccattcttctgcctcagcctcccgagtaactgggattataggtgcccaccaccaggcccggctaatttttgtatttatagtagagacggagtttcaccatgttgggcaggctggtcttgaactcctgacctcaggtgatctgcccaccttggcctcccaaagtgctgggattacaggcatgagccaccatgcccagccccgaaaacccttttacagatgaagatgctgaggctcagagaggttagataacttgcctaggcacacacagcttctaagtgacagagtttgaatgcaggtctgtgtgtctgtcttcaaagcctgtgcccttgcctgtgtcagccctgggaggcactggttaacctgtctccatctcaatcatccttaggtgtctctccctccccactcctggctcccgtgtcctctgcatgctggaagggatggatgggataagcctgggctgggtgcccctgccatctctgcctgtgccactgcatcctctagacctgagtctccctgtgtgccgacaggttggcgggacgaagactggcgtggtgcggtacgtgggggagacagactttgccaagggcgagtggtgtggcgtggagctggacgagccccttgggaagaatgatggggcggtggcgggcaccaggtatggtgggcttcttctggggagtatgggagggggctcctctccccagggtgggcgcaggggatggagatgggacattggaggaagcgagtgtccagcatgtagtgtcagacaccataagtcctttcccattccctccttcccaacagcccactaagctgggtagtgggattatcatcccattttacagatgagagtatggaggccaggaggtcattgttcaaggtcgcacagtcacaggcaagcgccaagagaatctgtccccgtgttctcttctttgtgtcactcatgtctaagtggggtgggagccctcaaaaaggagagggaggctgcgtgcagtggctcatgcctgtaatcccagccttttgggaggctgaggcaggtggatcacttgagatcaggtgttcgagaccagcctggccaacatggtgaaaccccgtctctactaaaaatacaaaaaattaactgggcatggtgacacacgcctgtaatcccagctacttaggtagctgaggcacgagaatcacttgaactggggaggcgtcggttgcagtgagccaagatcgcaccactgcactccagcctgggtgacagagtgagactctgtctcaaaaaaattagccaggcatggtggcatgcacctgtagtcccagctacttgggaggctgagacatgagaattgctggaacccgggaggcgaaggttgcagtgagctgagatcacgccattgcattccagcctgggcaatagagcaagactgtctcaaaaaaaataataaaaaataaataaataaataaataaaaggtgaggcagcagtccctgtcatctggcattggggtcccctgaatgacacatgaaataatcagacaatgcccagcgctatatggccagaggcaggcctcacagatgggttccaggtctcacagcatctctgatgaaaaggaattgactgctggcgttgctgggttaggagggtctaaggctgtgtctgggcttatggtaggtgggggagtgatgtggtaagtggaccatgtctgtcacggatgtggactaaggtgaggccacctgagtccctgtgcagtccctgtactggagtctgtggttgagacgaggctgtgactgctttgagcaggagtggtcaccatggcacaggggaagagctaggcttggaccaggcctcgaaagaaggtagggtttccttttggaagaggcttgagagaggctgtgctaggcaggggctgagagcacagtatgaacaaagacctggaggtgggaaaaggcagaatggggcagcggtttcaagtgaatcagaagctggatgggggccaggcatggtgactcatgtttgtaatcccagcactttgggaggctgaggctggaggatcacttgaagccagcagttaaagactagtctggacaatatagcaaaacctcatctctacaaaagatacaaaaattagctgggcgtagtagcacacacctgtggtttcagctacctgggaggctgaggtgggaggattgcatgagcccaggaggttgaggctgcagtgagctatgatcgcaccgctgcactccagcctgggtaacagagccagaccctgtctcgaaagaaagaaaaaaactggatgggcccagttctcgtggtccagtgtggaatccgtgaccagagaggtcttgacagaagacgagaatccagggtttccataacaatgctttgccttcctgtttgcaagatgaatgtttcttttgactcacttttgctttcagaattcaggggtgggttggacagcagtccccatcccaccccaaggtttctctttcaagcttttgcttctctatgcagggattctgtgggcagagagctgatgggaatccttcattctggggatggtctgagggtagcctgaaagtggggctgcagctgtggctggggtctctgaacagtctgtgggagccaagcttagcgggtgttggagcccagcacactggaggaccagtctcagctttgctgcgtaaccagctgtgtgactgtgggcaagttatttaacctctctgagcctaaattttctcatttgtgaatgtagataactttgggggatggaaatgagcattcatttaaagagactggcacaaagtgggtcccagtaattatttcctacttccaagagtattctcattggctgttcacagctgcagagactctcagaccctactcacctatatcctttttttgagagtcctatctctccacctggaagatttccaccttggagtgtctttccacatgggccccaaggaggtgtctttctctctttctgccaggctctgaagaggcagaggaggcaggggaggctctccaggctttggggccgtgacagcagcttgggtctctcctgcttccacaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctggtgagggtggggctgcagaaggggattctctggtgtgcgtttgggaggggtgaggatgtaagagatccaggtgttctggtctgcccctgacttactctagttccagtttgggatttttgaacaaagaagaaagtgcatatcttttaatagggaaaattgagccatttacctttattgctgtttttatataactgatttattggaaccctaagcctttctctggaagttaaggagggttatacagatgcagggcagggagttcagaaaggttggcatcaaaccctggatgaagggaaaagaggaggctgcttggtggctatgggcagagggcattctgtccaaacccaatctaggattggaggttcctcctttcccaggaaaaagtggccaaagtgagggagtcagaggctctggctatcaggagctgactctcctgagatggggagtttcctgaatctcaaacatcaagattccccgctgggtgagtcagcaggggccaggatgtcagagtactggcaggggaagagcaggaccctgggagtcaaggcacttgggctcccacctgctatgttgctgtagattaggctggacagagccagtctgccctgcagtgcttcagatccctgagacccgcctgcatccacaccttcctgcagctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcaggtgagtggcaggtggggctgggggcagagcttctccagccagcctcatagagtctcacccactcagagcggagaccctggagggggtgggtgcagagaaatatgaagataacacaagcagtacctgtcccccgctttccagagataagcctcagtgacctggtgaatttccttccagtcttttctgcctatgtataaggatacatacacctactttcagaatctggttacaagcttgtatatcctgctttttaattatttatttatttattatttttctttctttctttttttttttttgacggaatctcattctgtcacccaggctggggtgtagtggtgcaatctcggctcactgcaacctccacctcctcggttcaagcgattctcctgcctcagcctcttgagtaactgggattacaggcatgtgccaccatgcccagctaatttttgtacttttagtagagacggggtttcaccatgttggtcaggctggtctcgaactcctgacctcgtgatccacccgccttggcctcccaaagtgctgggattacaggtgtgagccactgcaagggttttttttttttttttatgagacagagtctcactctgttccccaggctggagggcagtggtgcaatctcagctcactgcaacctccacctcccaggttcaagcgattctcctgcctcagcctctcaagtagttgggattacagcacctgctaccaaaccaggctaatttttgtattttaagtagagatggggtttcaccctgttggtcaggctggcctggaattcctgacctcaagtgatctgcctgccttggcctcccaaagtgctgggattacaggtgtgagccaccatgcccagccctgcttttttatttttttaaaatatttttaatatagggatggggtcatgctgtgttggtcagcctggtctcgaactcctggcctcaggcaatccttggccttccaaagtgctaggattacaggtgtgagccactgcacttggcctaatctgcttttcttccccggctacttattatactgcaagcattttctaggtcctggcaaattcctcatcattcttttttttttttattttatttttttcttttagagatagggccttgctttgttgcccaggttggagtgcagtgacgccatcatagctccactcctgggttcaagtgatcctcccacctcagcctcctgagtggctgggactataggtgcacgctaccacatccagctaaattttgtatttttttgtggagacggagtcttgctatgttgcccaggctggtctgaaactcctggcctcaagtgaccctcccaccttggtctctcaaagcaccgcgattataggcataagccatcgtgccccacctcttccccatcttgatgtctgcattgctgtctatcacaggctttgtccttactgacatctgacgtgactagtcccctgttgtttagattatttcccatttttcactttttttgagacagagtctcgctctgtcacccaggctggagtgcagtaacacgatcttggctcactgcaccctctgcctctggattcaagcaattctcctgcctcagcgtccttagtagctgggactacaggtgtgtgccaccacgcccagctaatctaatttttgtatttttagtagagaaggggtttcaccatgttggacaggctggtcttgaactcctggcctcaagtgatcagcccgcctcggcctcccagtgtactgggattacatgtgtgagccaccgtgcccggccaatttttcactctttctacatatcactgcagtaaactttttttttttttttttaatgtatgactgtctacatttcaggtttcttttttttttttttcttttttgaggcagagtctcgctctgtcgcccaggctggagtgcagtagtgtgatcttggctcactgcaagctccgccccccaggttcacgccattctcctgcctcagcctcccaagtagctgggactacaggagcccaccaccacgcccagctaatgttttttgtatttttagtagagatggggtttcaccatgttagccaggatggtctcaatctcctgaccttgtgatccgcccgccttggcctcccaaagtgctgagattacaggcaggagccactgcacccggcccatttcagattatttttttgagcagattctagggttgaatttcaggaaagtgactccttgccccaagccttggggctgctgctatctcgtgtctggttttttctctgatgtttgtctcccgtgggagagttcccttctgggcctctgtccccatctggggtctggcttgcccctccttggatgccaggatcaataggccaagttcatggctgtgctttgatggagcacagacaagacagcaggtttgcaagataacaggtcttaggctcttgtgggttgaggcgggaggcaggtactgagggcaggtgggcctaagggtcctgcctctgcctctcttgttcctactgggtcccctccttcacacctaggcccactgtgcatgcccggcaggtgccagcagggaagttggggtgactggggttccaggccctgctccttgcctgtctcccaccacaccaccaacctggaccccataccccggagcatgctgaccctgtcctggccttccttgggggcccagtatgttgcagaagccgaggagaagctgcagcgagcccggctgctcgtggagagcgtgcggaaagagaaggtggacctgtccaaccagctggaggaggagaggaggtacgtgctggcccaccctcgccctggccctgagtccccttaaggaggatgaggaagagggcaggcttgggaatagcggacccaggttccagtcctgcccctgtcactgcctctggctgtgtcaccctggactggtgacattaactcttgggcctcagtcttcctatctgtaaagtgaggtgttggtcctgtcttctgcaggcagttgggagaactcttcatataactggagtaaagcacccagcacggtgccgggcacagagggacaccacatttttaaaaatttttttgaaacagggtctcactctgtcacccaggctggagtacagagccacaatcacagctcactgcagccttgacctccagggttcaagtgctcctcccacctcaggctcctgggtagctgggaccacaggcgtcccccaccacgcctggttaatttttgtattttttgtagagatggggttttggcacattggccaggctagtctcgaactcctgacctcaggctattcacccgcctcggcctcccaaagtgcaggcatgaaccgttgtgcctggccttggaacaccgcatttgttcattgcatagagttcactgttcctgcactctccagcagaatattgagaagaggaataggctgggggtggtggaagggaggctggttatcacaccaggtgtccctggggagccgtgcaccaggaagaaggctgaatgccccacccctccaccatgagccagttcacactcacagtgcgcccctccccaaccctggactgagacctgtgagtggagctcacagctcctgtcctgggaatccatttccccttttttccctccctccctccctccattcattccttccttccttcttccctccctccctccctcccttctttccttccttccttccttccttccttccttccctccctccctccctttttctttctttttttcagagtcttgctcttgttgcccaggctggagtacaatggtgcgatctcggctcactgcaatctccacctcccaggttcaagcaattctcctccctcagcctcccgagtagctgggattacaggcatggccaccaagccctgctaatttttgtatttttagtagagatggggttttaccatgttggccaggctgatctcaaactcctgatctcaggtgatccacctgcctcagcctcccaaagtgctgggattacaggcgtgagccaccgcgcccagcctcctttatttttcttttttgagacagggtctcactgtgtcacccaggctggagtgcagtggtttggccatggctcactgcagcctcaaccttctgggctcatgcgatcctcccacctcagccttccaggtaactgggactacaggcacacgccatcatgcccagctaattttttgtatccattctcattttacacatcaggaaactgaagttaagagaaacagcagccaagggactcctgaaatgccctgtgtccaggtgtcagccctgtgctgtgtgcttcgctggtgtcatcgctttcaaggccagatgcagtggttcatgcctgtaatctcagcactttgggaggccgaggcaggcggatcacctgaggtcaggagtttgagaccagcctggccaacgtggtgaaaccctgtctctactaaaaatacaaaaattagctgggcatggtggcaggtgcctgtaatcccagctactcgggaggctgaggcaggagaatcgcttgaacccaggaggtggaggttgcagtgaaccgagatcacaccactacagtacagctgggtaacagagcgaggctccgcctcaaaaaaaaaaaaaaaaagtcacaagtgggacccatctcccctgcagccctccaaccaaagacaccaggcggtggggactctggccgacttggtcctgggtcacctccttgtaggacacaaagctgacagtggacagaggtttgccttggcctgggatcctctctacctcctagatgatgcccagatacctacatctccctcccctgtccccaggcagcagccagcccccatccccaacacccccacttgggtctgttctgtgggctttcagctggcacctgcgctccataagctgttgttactgtcggattcagggagatgagggtgtatttatatttgcctgagacagccatagtggcctacacatctggttcccatggcgatgtgcctgacgccaacaaacacagatctttttttctttttcttttcttttttttttttttttttgtttctttagacagagtctcgctctgtcacccaggctggagtacagtggtgtgatctcggctcactgcaacctccacctccaggttcaagcaattctcctgcctcagcctcccaagtagctgggactacaggtgcgcatcaccatgcctggctaatttttatatttttagtagagacagggttacaccatgttggccaggttggtcttgaactcctggactcaagtgatccacccgcctcggcctcccaaagtgctgggattataggcaggagccactgtgctcagccacaaacacaaggcatcatggagttttgttcagaaggggcctgggtgcaagtctctgcattgtcctgtgcttgctgtgtggccttcggcaggtcgcctgccctctctgggcctcattcctcattgctatgccgagagctgttaggaggccctaggaagagcagctttgagcttttttttttttcccccaagatggagtttcgctcttgttgcccaggctggagtgcaatggcacgatctcagctcaccgcaacctctgccttttgggttcaagccattctcctgcctcagcctcctgagtagctgagattacagggatgcgccaccacgccccgctaattttgtatttttagtagagacagtttctccatgttggtcaggctggtctcaaactcccgacctcaggtgatccgcccaccttggcctcccaaagtgttgggattacgggcgtgagccactgcaactggcccagccttgagttcctatgtgtggctgtaaggtggggtgggcctgtgtctctcccctgcgctgtcttgacaggtgtgtgacagagtgtgtctccctgagggtagccctgatgcctgggcattccacatccaggggcagccctgggagtggggattgggtctctgacccccagttttgaggcctgtgatgagaacaagatcaacagcaaaggaagcccactttccttctctcctttccttcctccccacaggttgttccttgtggtagtgtctgttccccgcagtgatgaaaacagtgttgtcagctgggcgcggaggctcacgcctgtaatcccagcactttgggaggctgaggtgggcagatcacttgaggccaggagttcgagaccagcctggccaacatgttaaaaccctgtctctactaaaactacaaaaattttttattgaggttgcatgcccagtgatgtatgcctgtaatcccagctactcaggaagctgaggcaggagaattgcttgaaccgtggaggcagaggcctcagtgagccgagatcacaccaatgcactccagcctgggcaacagagcgagactctgtctcaaaaaaaaaaaaaaaagggagggaggaaggaaggaaggaaggaaagaaagaaggaaagaaaacagtgttgtcactcacatccccgggccaccctgccctttattttatttcccaccaccctggggaggaagggtgttgccttaaacactgccattctggagttattggtggttcttcctagagtgcaggtcagcaggttgggaggtctagagctttccaggactgtgggacattttgatggcctcgcctctggattctgggccattctcatggccttgcctctctctgctgttgctcattcggtgaatcccgttgctctgggcaaagccaggtcagccacctctttccctcccctgcaggaaggtggaggatctgcagttccgcgtggaggaggagtccatcaccaagggagacctggaggtaacagtcagaggccccttccctgggcacacttagcaccggtgcctggcccttgctagggcagatggttgtgaggtccagcagcacctctaggcccccccggggaaggggctgggggggaaaatggggaaggatcaaaggtctgatgtctgaggtgttagtggctcagccccaggagccccccagggaagctgtgctccccgtgtcagcagctggatggggtgggcaggacgaacccagggcagggcagatggggggctgggccccaggatagagtggctgaggtcccctgtcccttcttcttaggcaatagccctaaaggtgccccttcgttcatcttggattccaggtaaaattttggctgaaagtagcttgctgagtcacagaatttataggtaggaaaactgaggctcagagaccaagggagctgggtatggtggctcacacctataatcccagcacttcaggaagccaaggcagaggatcacttgagcccagaagttcaagaccagcctgggcaacgtagcaagatcccatctctacaaaaaatttaaaaagttagccaagcatggtcatgtgcacctgtggtcccagctactcagggaggctgaggctagaggatcgcttgaatctgggagatggaggctgcagtgagctatgattgcgcctgttttttgttgtgtgtgtgtgtgtgtgtgtgtgtgtgtgtgtgtgtgtgtgtgtgtgtgtgtgtgtgactgtctcaaaaaaaagaatggatgttggggcacaacccagcgtcagagcctcagcccagctcagcatgttctaattaagtttccctcttggccaaggggcaggccatgtggttgctcctggctgacttttccattggcagttgctctcctgcaggggttggatggacttctgggaaaagcacctgtatttgccaggaacagagacccccctgtgccagctgcagtcaccatgggggcttactgaagggctgtaggaaaggtcacagcctccaagggcaggcatttcaggggactggagccagaaacagcatcgggagctaagcccatccatgtgccccttactcagggtctccttccgatctgtgtctgaggtcaggctcctcctgtctgtttcccactgtgtttctcggctctgctcttctcccagccccgcccactacctaccagctgtcattgagagaggctctgattggtcccagggatagccaatgggctggctggctctggataggggtccaccccggatccagccggccctggctgggagaggcagggggcgggacagacagtgacagctaagtcagtccaaagggctgcagaattccccatgcaacgttttattgtagcaaactgaattgtgatcatattcatggcaaccagaaggcaaaatgaccaaagtcccactcatcccctcatccccacccttttttttcttttttggagacaggatctcactctgttgcccaggctggagtacagtggcaccatctgggctcactgaagcctccacttcctgggctcaagtgatgctttgcctcagcctcccaagtagctaggactacaggcgtgtgccaccacacccagctaatttttgtatttttttttgtagaggctgggtctcactatgttgcccaggcagggtctcgctatgttgcccaagtgggtctcaaactcctaggttcaagcaatcctgcctcagcctcccaaagggctgggattacatgcatgagccatcacatctggcccccacccatcttaaaagtcagaaataaaagccagagcccctccttgacctcctggccccctccgctttatcaccccacctctctgcctgtctttattgcaaaacccccagaaggttatcaggctcatggtcttccctcctgtccacactgccccaactacacaatgagatgcccccattccaactccccagcctcctctgctggcgtctcctccttcctaatctctgaacattgtcccatccaagggctcagtcccaggtccgttcaccccttgtccacactcaccctgagagcttccagtctgtggcctccatgccctggaatgagcccctgtaagatccacagtcttccccaagctccctgtaccatgcccatttgacatctccacccaattgaggaagaagcaagcacctgtatcaatttcctggggctgcaataatgcacagccacaaatgtgtggcttaaaacagcacaaacatatgctttcgcagttctggaagccagaagtctaaaataaaggctgggcgtggtggctcacgcctgtaatcccaacactttgggaggccaaagcggcggatcacttgaggtcaggagtttgagaccagcctggccaacgtggtgaaacaccgtctctactgaaaatacaaaattagctgggcatggtgacgggcgcctctaatcccagctactccggaggctgaggcaggagaatcacttgaaattgggaggcggcagttacagtgagccgcgattgcgccactgcgcttcagcctgggcagcagagtgagactccttctcaaaaaaaaaaaaaaaaaaaaaaaaggcctgaaatcaaggtgttggagaatctattccaatctagcttccaggaggattgccggcagcccctgatgctccttggcctgtataactgcatcaggccagtccctgcctcctgtcactttgctgccttgcctgtgtggcactttacttgaacatcttatgaagacagcagtcactggatttagggcccactctaatccagtcctaatccagtatgacctcattttaactaactacatgtgcaagaccctattccaaagaaggtcacatttgttctttattttgtttaaaaaaaatttttttttttttgagatggagtctcgctctgtcacccaggctggagtgcagtggcgcaatctctgctcactgcaagctccccttcccgggttcatgccattctcctgcctcagcctcccaagttgctgggactacaggcatccaccaccatgcccggctaattttttgtatttttagtagagacgaggtttcaccgtgttagccaggatggtctcaatctcctgacctcatgattcgcccgcctcagactcccagactgctgggataacaggcgtgagccaccatgcctggcctattttgtttaatttttatacagatgggttctcactatattgcccaggctggtctcaaacttctgagctcaagcgatcctcccaccctagcctctcaaagttctgggattataggtgggagccaccatgcctggctaaggtcacattctgaggttctgagtgggcatgaaatttaagaagtcactattcaacccaggaccacagcccaaattgaacatgtcctaaccacatctatccaggcctcccctaacaccaccccccttacggttcccatctcagatattggcccccaaatccacacagttggctgggcatggtggctcacacctgtaatcccagtgctttgggagcctgagacaggaaggttgcttgagcccaggagtttgagaccagcctgggcaacatagcaagaccgtgtttctacaaaaatattttttaaaaatgcgggcatggtggcacatgcttgtaatccaagcactttgggaagccaaggcgggaggattgattaagcccagaagttcgagaccagcttgggcaacatagggagaccttgtctctacccaaaatggaaaaattatccaggtatggtaatgcatgcctatggtcccagctacgcgggaggttgaggtgggaggatcgcttgagtccgggcagttgaggctgcagtgagctgtgatcacaccactgtactccagcctgggcaacaaagcaagagcaagaccttgtctcaaaaaataaaaaataaaggccgggcgcggtggctcacgcctgtaatcccagcactttgggaggccgaggtgggcggatcatgaggtcaggactttgagaccagcctgaccaacatagtgaaaccccgtctctagtaaaaatacaaaaacttagccgggcctggtggtgggcgcctgtaatcccagctatacaggaggctgaggtaggagaatcgcttgaacctgggaggcggaggttgcagtgagccgagatcgcgtcattgcactccagcctaggcgacagtgcgagactccatctcaaaataaataaataaataaataaataaaaataaataaaataaataaaaaataaaaaacaaaaaaagtccttttgaccttacctccaaaatcatgcacatccgcacagctgcttccctggaccaggccctagcaccatgccatggatagccctctccttcgtcttctgttcctccaaagtccattctccacactgaatctagtcttttttaaaaatatcgttttcatttttaatgttggaaatttttaagcctatacaaaaatagagaagacagtataatgaactttcatttacccatcactcagcttcaacagtcatcaactcaccgccagtcttatttcagccatgccctgacccagggccccctcccacatcccagacgtcatatggccaaatatttttaaaatgtaaatcaggccgggtgcagtggctcacacctgcaatcccaatacttgggagggagaggtgggagggtggtcacttgaggccaggagttagagaccagtctgggcagcatagtgagaccccatctctacaaaaattaaagtattctggctggatgtggtggctcacgcctataatcccagcactttgggaggccaaggcaggtggatcacttgaggtcaggagattcagaccagcctggccaacatggtgaaaccctgtctctactaaaaatacaaaaattagctgggcatggtggtgggcaccagtaatcccagctactcaggaggctgaggcaggagaagcgcttgagccagggaggcggaggttgcagtgaaacaagatcacaccactgcactccagcctgggcaacagagtgagactctgtctcaaaaataaagtagaaacaaagaaacaaaataaataaaataaaaaatccaccaggcatggtagcacgcctgtagtcccagctacttggggggctgaggcaggaggatcctttgagtccaggaggttgaggctacagtgagctatgatggcgccactgcactccagcctgggtgacagagcaagaccccatctctaaaaataaataaataaaaatttttaaaatatggctgggtgcggtggctcacacctgtaatcccagcactttgggaagccaaggccagcggatcattcgaggtcaggagctccaaaccagcctggctaacatggtgaaaccccatctctactaaaaatacaaaaattagctgggcatagtggtgcttgcctgtaattccagctactcggaaggctgaggcaggagaatcgcttgaacccaggaggcagaggttgctgagccaggctccctccactgcactccagcctgagtaacagagcgagactctgcctcaaaaaaaaaaaaaaaaaaaaaaaatccaggcacggtggctcatgcctgtaatcccagcactttgggaggccaaggtgggcggatcacgaggtcaggagctccaaaccagcctggctaacatggcgaaaccccatctctactaaaaatacaaaaattagctgggcatagtggtgcttgcctgtaattccagctactcggaaggctgaggcaggagaatcgcttgaacccaggaggcagaggttgctgagccaggctccctccactgcactccagcctgagtaacagagcgagactctgcctcaaaaaaaaaaaaaaaaaaaatccaggcacggtggctcatgcctgtaatcccagcactttgggaggccgaggtgggcggatcacgaggtcaggggatcgaaaccatcctggctaccatggtgaaaccctgtctctactaaaaatacaaaaaattagccgggcgtggtggcgggcgcctgcagtcccagctactcgggaggctgaggcaggagaatggtgtgaaccaaggaagcagaggttgcagtgagccaagatcgcgccactgcactccagcctgggcaacagagcgagactccgtctcaaaaaaaaaaaaaaaactaatttaaaaataaaaatgtaaatcagatcctgcccctttcctgctcacacatctagcactgagacactagatatcatctaggctctgtagagtgggccagagaagacccccagggcccaaccctcccccccaccaccacccccctgccttgtcccagccctgtctcacacccctgcccctaagttatcatacaccaggcttttctctttctggaacaccacaagctgtgtcctgcctctgagcttttgtacacgctagttccccggcctgaaacacttgcgcctcttcctcttgtgcctgccttgtacaaggagtccttcttatccttcagaactcactgtaaattacatgtttcctctatttcacgttcattccagttactctctccccagtgctctgttcatagtgcaaatcacagtctggaatgatcttcactattcttttatggtttgcatctgcctccccaccccccagaatataaacccgttgaggggccaggcgtggtggctcacacatgtaatcccagcactttgggaggctgaggtgggcagatcacctgaggtcagaggttcaagaccagcaaacatggtgaaaccccgtctctactcaaaaatacaaaagttagctgggcatgatggtaggcacctgtaatcccagttactcgggaggctgaggctggagaattgcttgaacctgggaggtggaggttgcagtgagccgagatcgcgccactgcgctccagcctgggtgaaagagggaaactatgcctcaaaaaaaaaaaaaaaaaaaaaaaggttgaggggaggagtcctttggagtgggaccgaatgaagttgcccttgaaattgcgaagctggaggctttttcttgcctgtgcgggctaccagttcagtgtgtaggatcatgcaccatctatgagggttccagacagggctgttgtgcccaccgacggggataggggtggctgggatggagcttgtgattttctggaagagacatgctgacttcttgttggcactggaacacactgccaggagggaggcgggggagggagggagaggagagaaagagagagggagggacacaaagaggggagacaggaagggagagaggggaaaagagaaggagagaaggagggagggagggaaacagggaggggaatggagagagagagggagggagagagggaaaaagaaaggagggagagagacgggggggagaaagaagagagagaaagtgggaaggagaggggagagagaaagggaaggacaaagagggagagggaggagaaggagagaggaggggagagagagaactttttttgttgttccttaaggaaaattcaagaaataaaataggccaaaggacataatcatctcaatgtctcttaatgaattgcaggagtatttctaatcaggtgatgtccgtttacaccttcaccaatagacaagcttccggggttttattacaggtttcacacctagaggctgttttgctaagccccgccccttcagaactgccctgcagctgctttaaccccttctctcctggagtataaagaggaccctctggcttctccctaagatgaacttgggtctccaaactgctcccaatgtcctcaccctcccagcttcccttccaagatctgttctgtgaaatgcaaaagccagtcttgacaccctgagaatgctggcctttgtcagcagatgaagcagatattgtcgagctgggacaaaagtgcccttgtgatttgtggagaccaggcgtcctctgtggggtccggtggggtgggcagcaatggggcccgggagtgggaggcacagcccggcctccaccaaggaggctggggccaagaggatcgtgaggggtcgggtatattttggaaacatcttgcgtgttatgggttcttgcacttttagcacaggccttgggggggggggggagtcgagcgggaatcccggggtcctttatttattcctcatcctgtgggtctcctgtgtggaggatgctttgcctacaaccagtgacagcctgcaggggaacgggaacaggatgggcccctccccaggagcagatccttgatgaggaccttcaaggtcaagggctgctggttgggggttgggggggacagaaaagcgaggtgcccattgctaccccaagcaggggccagcgagggaggatggcttgcaggcccccaccccccaccgccctacactgacccagccgggacacagcaaggggtgggcatgaggccccacacccctcgcctccccagacttcctctctttcgctgagcaattctggctcatgaatctactctcctcgccttgttcacggaagatgacgcctcctctctctctctctctctttctctctctctccggcttcttcttccctgtgcccccctccctgcgtccccgcccccacccccccaccgtgtccaccctgggtggaccagacccagacgcagctggagcacgcgcgcattggggagctggaacagagcctgctactggagaaggcgcaggccgagcggctgctccgagaattagcggacaacagggtaaccgcgccaccgcacccgcctggcccgccagccaccttgccctttgatgccccctctggcttctctgtttcattattgactctctttctttagctgctatcatcttttttatttttattttttatttttgcatccccttggaggagggaagtcaagatttagaaatgtgcttatgtggccgggtgcggtggctcacgcctgtaatcccagcactttgggaggctaaggagggtggatcgcctgaggtcaggagttcgagaccagcctggccaacatggtgaaaccccatctctactaaaaatataaaaattagctgggcgtggtggctcatgcctgtgatcccagctacttgggaggctgaggcaggagaatcgcttgaacctgggaggtggaggttgcagtgagctgagatcgtgccactgcactccagcctgggtgacagagtgagactccgcctcaaaaacaaaacaaaaagaaatgtgcttatgttccctggctcagtgttgcttattggggtggagttgggggtgggggtggtctttgttttttgggacttggctccccagcttattgccccagcagctgagaacgtcctgtgagaccccccagtctccccgatgcattgccatgacaaagtgttggagttcctgggaatgtcctgtctctatgtaggcagacctagaaaccactgatccatgtctcctgtctccccagctgaggaggctggggagaggaaggaggtcaggaactgcagatctcttcccggtttctctggcccagagagcctgaaacatgggtgcaggagggggctgggctgaaggacctggggctgaggaaggggtggggcttttgagggagtggaggtgtccccagggaatggtgttataatgggtcctggagccatggaacagctctgcttgtgggtgaggcttccagactcctagggcatggttctgagtccctgctccaggccccacagtcccctccaggcttaccatgcacgcctgggacccagcactctgtgcaggcactcacatgcgaacagccagccggccccccagcagtccctctgagagcaagcaaaaacaggcagcaagtgatgactggaaaagcaccccataaacagtatgtagatgtagaaggagcagtggtcagtttctgcatgttggtctccgtgcacaagtggctgtgtgcatgtgtgcaggtgtccagagacacacagggtccatttgcacacactggccattgctcagtgaccatgtgcttgtacggtacacactcatgtgcatgaagactgaacgcacaaactgacccagtcacggcggaccggccggagccctccaaatgcatcttgatctagggttcaacctgatgaaaacacaaaaacagggctgggtgtggtggctcacacctgtaatcccagcactttgggaggccaaggttggtgaatcatctgaggtcatctgaggtcaggagttcaagaccagactggccaacatggtgaaaccctgtctctattaaaaatacaaaaattaactgagcggggtggtgcacgcctgtagtcccagctacttgggaggctgagacaggagaatcatttgaaccggggaggtggaggttgcagtgagccgagatggtgccactacactccagcctgggcaagagagtgagactccatctcgaaaaaaacaaaaaccaaaaaacaaaacaataagtttattgaactaaaggataccttcagaaacaaaatgtttaaagcttgtaatagatttaaagcttgaaaatatatcattttcatatctatgaccatcaacgtgatcaaggtggttttttggagaatggagcctctaagagttttttgttgaaagatgggtctgggagcaccctcttctgctttaagcattaaactggacccttcttggccactgcctccagccagccccttgggctggatatccttcctaaggcaggataatgcaaaattcactgtggcctctgttctttaaaaagaatgttaacaaaaaaaaaatttcttaataaaaatacaaagaactttaactcagttgggcatggtggctcatgcccatagagtcccagctgcttttgaggctgaggcaggaagattgcttgagcccaggaatttgagggtacagtgagctattattgcacggctgcactccagcctgggcaacatagctagacccccgtctcttttaaaaaaaaaaaaaatgctgggcggtggctcatgcctataatcccaacactttgggacgccagggcgggtggatcacttgaggctaggagttcgagaccagcctaggcaaaagagtgacaccccatctttactaaaaaaacacaaaaattccccaggcgcatggtggtgcatgcctgtagtcccagctactcgggaggctgaggcaggagaatcgcttgaacctgggaagtagaggttgcagtgaggtgagatcacgccactgcattccagcctgcgtgacagagcgagactcaaaaaaaaaaaaaaaaaaaaaaaaaaagctgtaacctcaaataggtggtttcttttaaccaccaatttgtccaagccacctaggtagaggagtggcgacagttggctctgaatctttggggtacagccagggaagtctttctggatactgtgatgggccaggcctctacatccagccagcactcaggagggagtgagcgcctttcccttcccatgacctccacctgctggggctggtgccctcgaatggacgccccctacccggcccccaccattgtgccctccttaccttccagccagccagccagcccgctgatccctgtctccctctctccccacagctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacgtaggcgcctgcccctcctgctggggcgggagggtcgggctggggagggcttggccttttgctgacctctgttctgcagcccaggaagcatttcccttgtccccgagagcatgcctggggcagtcaaggaaggggtcacctggcttagaggaggaggagctccttggccctctgttagaggggcagtgcgccctggtgaccagggagaaccgaagctggtctgagctgacctggctgcatccccccgcacagagcagacctggagagatgggacctccgtgcagaggacgggctttgatttacccatacatgtcttagggtgcagggctcctaggacccgggacctcagaccctgtgccctggggctggcacagacctgaaggcaagctctgcctatccccctgggggcacccatctccaacttagaagctcacctggggaatcagcggcagccccctttctgccagtcctaatgagactttagcaacggtgccaacgagtacttccccagaatgtgggagttcccggagtggggtctggaaggctagagggggtggccctaaagaggtcgctgtcaccaatgtcaattttgctccaaatctagaaattccttaagcatctaccccttcttccttcagctgaacccatcctcccagcccctctgaggaggtcaacacccaggtgggctgtgcccactccaccagggccaggaagggccttttgagtggctctgggtaccacgtcttatgccaggccctatgtgactccatttcaccttaacatccttagattgatactggctccatttcacaggtgagcaaaccaagactttcccaggtccacagcctctcagtggcagagatgttcaaccccattccctgtggggctgacagagagtgcccaagacaacaggaattaattcataggagggatggctagcaacggactcttgcctgtatacaaattgtactcagagattcttgagtttccagttcccccacatacattttttttttttttgagatggagttttgctcttgttgcccaggctggagtgcagtggtgggatctcggctcactgcaacctccgcctcccaggttcaagcaattctcctgtatcagcctcccaagtagctgcaattacaggcatgcaccaccacgcccagctaattcttatatttttagtagaggtggggtttcgccaggtagtccaggctggtctcaaactcctgacttcaggtgatctgcccgcctcggcctcccaaagtgctgggattacaggcgtgaggcaccatccctggccttttttttggttttgtttttgagacagggtcttgttctgtctcccaggctggagtgcagtggcatgatcatggctcactacagtctcaacctcccaggcttgagcgagcctcccacttcagccttccaagtcgccaggaccacaggtgtgccccaccacacctggctaatttttatagtttttgtagagatggggtttcctcatgttgcccaggctggtctcaaactcctgggctcaagctgtctgcccgcctttgcctcccaaagtgctgggattacagggagtaggtactgcacctgaccaccctcatgtatattcaaaccagaatttaggggtgggtgtggtggctcacacctataattccagcatttcgagaggctgaggcaggaggattgcttcaggccaggagtttgagaccagcctggacaacatagttagaccccatctctacaaaaataaaaaattagccgagtacagtggtagtgtacctgtagtccccagctacgctggaggctgaggcaagaggatcacttgagcccaggtgtttgaggctgcagtgagctatgattgcaccactgcactccagcctgagtgacagtgtgaggctgtgactcaagaaaatacacaaaccaaaaaaacccgagaatttagcatgtgggcagtaagttctcaggactaatgaatccagggggctttttttgtctaaaaggaaatctttttgcatcatgccttgaggtcccttgtaatggccttcctgccccttctcccaggaagggattttgttttttagcaagtgctcttccaggatcctgggctgaaagaaaaggaagaaacccaaattagcttacgtgcacatggcctgattagctgttcagggcaggcagaaacagcctgcaactcaggaactgaattccctgagcggggaggtttgaggttgctgtggttccacagagcatgggggacagaggcctgaggatgcctcccccagtccctgcccctcattcacaggtgcccttggaccaagaagtagtagtggccccagaaagcccatctcctggccgggcgcggtggctcacacctgtaatcccagctactcaggaggctgaggcacaaggattacttgaacccgggacgtggaggttgcagtgagccaagatcgtgccactgcactccggcctgggcaacagagggagactccgtctggaaaaaaaaaaaaaagcccatctcttgattttctgtatacactggggcttagtctaaacgcatatgtccccatgttcagaggtttaggcctaagcacaactggacttttggtctcaggtagtaaatatgggaattttaaaaattattttagtggccaggtgctgtggctcacacctgtaatcccagcactttgggatgccaaggcaggtggatcacctgaggtcaggagtttgagaccagcctggccaacatggtgaaaacccgtctctactaaaaatacaaaaaattagccgggcatggtggcgggcgcctgtagtcccagctactcgggaggctgaggcaggagaatcgcttcagagtcctggaggcagaggttgcagtgagccgagatcacgccactgcactccagcctgggcgacggagtgagactccatctcaaaaaataataataaaaaaaccccaaaattagctgggcgtggtggtgggcacctgtaatcccagctactcgctcgggaggccgaggcaggagaatcgcttgaacccgggaggtggaggttgcagtgagctgagattgagccattgcactctagcctggatatcagggcgagactccttctcaaaaaaaaagaaaaagaaaaatttagtgtgagcctcattactgcatcgtatataaattatgatccaaggggcttagttcattacaactaattgagactcaaatgggacttgggatgtatgaacagaagtatgaggggcaggatgatagaggtgactgcctactcagctctgtgcttccctgatctgcagtgccagactctggctggctcggaggacagccagcctgggcaggagactggaaactcctgccaagagtggcagggagcctattggttgtgttttgacttttgtcatagtgatgtgtgccaggctgatttttttttttaataggtcttttcttctttggcctctgggtttattattaaaaagaaatgttggagagaaagaagctagcatttaatgaagtccctccaggaggtggccccaagcacgctgtgcacacactaacccaaagcagccaatatttgtttgatggatgggaaactgaggccagaagtcttgtctctgggagacagagaaacaaattcccaggacaaatttctgtaggcattgcagggaaggagccatctgtttaatataataaacattttcaacaaaggaagggtaggaggtattcatgtataagctgcacaggcggccttcagcagagctgggtgcagaatgggggtcctctgttgtcagggaggtccgactgaggacgtctgcactccctgccaccgcagcaagtccctgagtccgtcactgaggtccccctttgtaggagtagggtgtgcaaactgcaggtgtgcttgctgggctggctggggctggggccaaggggcagaggtgagcatcccccttacaggggctctttttgcagatgattgagtcgaatgacatttcagaggagacgatcaggacgaaggaaactgtggagggtgagtggccaccaggccgggcgggactctgggctctgggaagaggctggctggctctgccttcctgctgggtcacattttggtttgcatcatctgccatttggtaagagtcacctcctgtgtgctgtgagctatgtactcctgcaagggaggaggccagtttacggagggataggcattgcaccagccttccaagttgctgtcttttttttctttttcttttgaaacagatttaacggaatagtaaacttaatggaatatcaaaccttattatttgtttggtttatattttatttttatttatttatttagtttatactttacttttatttatttatttattttagacggagtttcgctctgtcgccaggctggagtacagtggtgtgatctcagctcactgcaacctccaactccctggttcaagcgattctcctgcctcagcctcccgagtagctgggattacaggcatgcaccaccatgcccagctaatttttgtatttttagtagagacggggtttcaccatgttgaccagggtggtctcgatctcctgactgcgtgatccgcccgccttggcctcccgaagtgttgggattacaggcatgagccaccgtgcctagctggtttaaactttaaaaacaggtctaaacttcaaatggttcaaagggcatatggcaaactaactcttcactgttctctattcttccctccctgaaggcgcagtgttagcttctttatatcccctttccagaaatattttgtgcaggtacgagcaagcaagtgacacaaatggtaccatatcttccattctttcagctccttcatttattccatttaacaatgtatcttggagagggttccttatcagtagtacattcttttacagggtacagaatattccattgtgtggaggtaccattgtgtatttagctggtttccgataacaatcacagattgtttccagtcttggtcagttacaaagatggtagactgtttccagtcttggtcaattacaaacaccactgtagaaaattaccttgacttccattgggctcaaccaattttaattcccaccagctgtggttgaaaacctgtttcccctcaaactcccatcaacaaaacgtttgatcagactttgtgatctttgccaatctgaaaggtaaaaggtgtaacttcaactcacctttctcttatgtggatgaagttaagaggtatttctatttgcattttttttttgagacggagtttcacccttgttgcccaggctggagtgcaatgatgcgatctcagttcactgcaacctccgcctcccaggttcaagcaattctcctgcctcagcctcctgagtagctgggattacaggcatgcaccaccacgcctggctaatttttgtatttttttttttagtagagacggggtttctccatgttggggctggtcttttttttttttttttttaagacagagtctcactctgttgcccaggctggagtgcagtggcacgatctcagctcaccacaacctccacctcccaggttcaagcaattctcctgcctcagcctcctgagtagctgggactacacgtgcatgccaccatgccctgctaattttttttttttttttttttttagtagagatggagtttcactatgttggccaggctggtctcaaactcctgacctcatgatcctcccgccttggtctcccaaagtgctgggattacaggcatgagccaccatgcccggcttctatttgcatttctatttgtgtcttttgaccatttttttctgattgggttattgatctttttgctgatttttagaagctctttatgtatgacattgcagacattttccccactttgtcatttgcctttttacttttttcttatggtggtgttggccatgcagatatttaaaaaatcaggccaggtatggtggctcacacttgtaatcccagcactttgggaggctgagttaggagtattgcttgagcccaggagttcaagaccagcctgggcaacatagtgagaccctgtctctacaaaaaatacccccctccaaaaattagccaggtatggtggcatgcagctatagtcccagatacttgggaaggtgaggcgggaggatctcttgagcccaggaagtggaggctgcagtgagctacgatcatgccactgcactccagcctgagcaatagagtgagaccctgtcaccaaaaaaaaaaaaaaaaaaaaatcaattcttttttagtttaaaaaatgtatccagtggtttcttctggtacttttctgtcctattttctatgctgaaatctctgatccatctagaattcatccttatataagtgtgagataaggatccatttttattttttcccaaaggaatacccacttatcccaacactatttttgaaaatggtcattttctccccccaaccctcattgattggaattactaaccttattgtccttaaattcacttatgtaattgactctatttctggacttttgttctattccaatgacttgttattctcttcatgtgccaattctataatgttttaattagtcaagctttgtctatgttgtaatttctggcatggcttgttcttctctgctttatcaaaattctcttggctattgtttaaaaactaagctgaaattaacataaaatagacatgtgcaggtttgttataaaattaacaaatgaaaaaaattaacataacatacaatcagccattttaaagcaaacacttcaatggcatttagcgcagtcaacaatgtagtacacccagcacttctatctggtttccaaaacattctcatgggctggatttggtggcttacacctgtaattccagcactttgggaggcccgggcaggagaattgcttgaagtcaggagttcaagaccagcctggacaacatggcgaaaacccatctctacaaaagaaaagaaaaagaaataaagagaaaacaaacattctcatcatcccaaaaggagaacccatacccactagcagtgcttctccatcctcctctccccccagcccatcacaaccactaatttactttctatctctgtggatttatctatttggaacatttcatgtcaggagttcgagaccagcctggtcaaaatggtgaaacccagtctctactaaaaatacaaaaattagctgggcgtggtggtgtgcgcctggaatcccagctacgcaggaagatgaggcagagagaatcacttgaacctgggaggcagaggttgcagtgagccaagatcgcgccactgcactcctgcctgggtgacagagtgagactccatctcaaacaacaacaacgacaacaaaacaaaacaaaaaagaacctcattcttttttgtggccaaatgatattccattgtatggacataccgcattttgttgatccattcctcagctgatgggcatttgggttgtttctaccttttggctattgtgaatgatgctgctaagaacatagatatgcatgtacttgttaagtacctgttttcagtgctttggggtatatacctagaagagtagaatgctaggtcatatgattttttttttttttttttttttgagatggagtctcactctgtcacccaggctggagtgcagtggtgcaatcttggctcactgcaacctccgcctcccaggttcaagcgattctcctgcctcagtctcctgagtagttgggattaaaggtgtgcgccatcacgcctggctaatttttgtatttttagtagagacagggtttcgcaatgttggccagactggtcttgaactcctggcctcaatcgatgcacctgcctcggcctcctgaagtgctgggataacaggcgtgagccaccgcgcctggcctcatatggtaattctgtttaaatttttgaggaactgccaaactcttgggtattcttgctcatttttataagtgacttagaatcggcacatctagttccaccaaaattttaaatcaggctgggcgcagtggctcacactgtaatcccaggactttaagaggctgaggcaggaggatcacttgagcctaggagttcaacaccagcctgggaaacatagtgagaccttgtctcttcaaaaaataaacaattaggctaggcgcggtggctcatgcctataatcccaacactttgggaggccgaggtgggtggatcacttgaggtcaaaagttcatgtccagcctggcggacatggtgaaaccctgtctctattaaaaatacaaaaaaaaaaaaaaaaaaaaaagttagccgggtgtggtgatgcatgcctgtaatcgcagctactcaggaggctgaggcaagagaatttcttgaacctgggaggtggaggttgcagtgagctgagatggcgccactgcactccagcctgggtgacagagcgagactctgtctccaaaaatataaaaaataaaaaattagccagatgtggtggcacatgcctgtggtctcagctactcgggaggctgaggaaggaggatgacttgaacccagggggtcgaggctgcagtgagctatgattgcacactccactccagcctgagcaacacaatgataacctgtctcaaaaaaaaaaaaaaaaaaggttaaaatcgtgttggtatttttagtggtattacattccctttataaattaacttgcagaaggtggagatgtttctgggtacttggcatccattctgtcctttatggctgtgaggagcacccaggcttgaatacacaagaccggtgacctaggcactgttagcactgttagcactgttattgttctccctgtttttcacttgaggggactaaggctgtgacaggttacctaagaccacatagtgtcgggtcttcttttttttttttttttttttttgagacagagtttcgctcttgttgcccaggctggagtgcgatggtgcgatctctgctcaccgcaacctctgcctcccaagttcaagcgattctcctgcctcaacctcccaagtagctggaattacaggcatgcaccaccacgcccagctaattttgtatttttagtagagatggggtttctccatgttggtcaggctggtctcgaactcccgacctcaggtgatccacctgccttggcctcccaaaatgctgggattataggcatgagccacctcgcccagcctcttttttttttttttttctttttgagaccgagtctcgctgtgtcgcccaggctggagtgcaatggcgctatcttggcttactgctgcctctgcctcccgggttcaaacgattctcctgcctcagcctcccgagtagctgggattacaggcacctgccactatgcccagctaatttttgtatttttagtagagactcggtttcaccatgtttgtcttgaaccccctgacctcaggtgatccgccggcctcggcctcccaaagtgctgggattacaggcatgagccaccacgcccggccagtgtcaggtcctcttcttcaggaggggttacccagcgagacggctggagtgaggaagaacttggaccctggaggccaagtgtgaccccgtcacagagctcctgtgggagggccatggccctacccactgctgctttggtccaggagcattgatgcttctcgtctctcctctctcccctaggcctgcaggacaagctgaacaagagggacaaagaggtgacagccttgacctcccagaccgagatgctcagggcccaagtaagtggtaagtctccctcccgcagggcagatgcggggggctttcactggggccgtgccattcagctgccaattaagcatggagtgggtcagggcctggcttagggtcccctccccgactctgctttgagaagaaaagggctggctggtcgcggtggctcgcgcctgtaatcccagcactttgggagtccgaggcaggcggatcacctgaggtcaggagttcgagaccagcctggccaacatggtgaaacctcgtctctactaaaaatacaaaaattagccgggcatggtggcatgcacctgtaatcccagctactcgggaggctgaggcaggagaatcgcttgaacctggaaggcagagctgccagtgagccgagatggcgccactgcactccagcctgggtgacagagcgagactccatctcaaaaaaaaaaaaaaaaaaaagggccagggccaggtcacctgcaccagacagacatgtacctggggagcagtgagtggcccacatgtggtccatcctataatgcctccccgccagcttctgtccccagagccagctctgtgttctctgtgtcctgaaattctatccattctatcccaggttccctctttctggtcctgaagactttctggtttctctctctctctctctttttgcttttgtttttgagacagggttgcactctgtcacctaggctggagtgcagtggtgcaatctcagctcactgaaacctccacttcccgggttcaagcgattctcctgcctcagcttcctgagtagctgggattacaggcgcacaccaccacacccggctaatttttgtatttttttagtagagatggggtttcgccatgttggccaggctggtctccaactcctgagctcaggtgatccacctgccttggcctcccaaagtgctgtgattacaggtgtgagccaccacgcccggcccctggccctgcttcttgttcaccagaacaccagtggtggtgggcatgagacagcccccctcctcggaaatggttgccaacctgtcttctgtccatcccccagtacaaggcagaattggccccaaaaaaggtcagtggacctcagactcctccaaggccaaggtgaaggtgaagcttttcctaatccaggcgacagtgtaaacacacgtgtgatatcgctccccacaccaggagcccaagcagctgctgtgcttggcgaggattgatctgtttattgtacctgttctctcaggccccttgccacctggcttgtagggacaactgagaccaatggtgcttttaaaattatgcagtggaggccgtgagcgatgctcatgcctataatctcagcactttgggaggccgaggagggaggtttgcttgaggccaggggttcgagaccagcctatgaaacattgtgaggcctcatttctatgaaacatacaaaaatttggccggggctgggcatggtggctcatgcctgtaatcccagcagtttgggaggccgaagcgggtagatcacctgaggtcaggagtttcagaccagcctggccaacatgatgaaatcccgtctctactaaaaatacaaaaaaattagctgagcgtggtagcgtgcacctgtagtcccagctactcaggaggttgaggcaggagagtcacttgaacccgggaggtagaggttgcaataagtcgagattgtgccatggcactccagcctggcagcggagtgagactctatcacacacacacacacaaaaacaattagccaggcatggtggtgggcacctgtaatctcagctacttgggaggttgaggcaggagaattgctgcaacctgggaggcggaggttgcagtgagctgagaacatgccattgcactcctgggccgacaatagcaagactccgtctcaaaaaaaaaaaaaaatttggccgggcaccgcggctcacatctgtatcccagcacttttgaagccaagttgggtggattgtttgaggtcaggagttcgagatcagtctggccaacatggtgaaccccatctctactaaatatacagaaattagccaggtgtggtggcacatgcctgtagtcccagctacttgggaggttgaggcagaagaattgcttgaacccaggaagcggaggttgtagtgagccaagatcgtaccactgcactctagcctgggtgacagagtgagactttgtctccaaaaaaaaaaaaccgccaggtatgatggtgcactcctgtagtcccagctactcaggaggctgaggcaggaggattgcttgagctcaggagttggaggctgcaatgagctataattgtgccactgtactccagtctgggtgacagagccagacccaatctctaaaaaaaccgtcaaaactatgcagtggggtatgtcaccttcatcccctgggagaatcagcgccctgcccaggtctttgcccttgggtgggacagaagctcacgtgttcccaatcctcttcctcccttccctgccggctgaccccagcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggtgaggcggccgtggggccggctgggtcctccctgtggccctggcccttgctcctcttcttgacattagctcatgttatcttggggcagagagggggatagagctggtgggccaggtggccgatctcgagcgatcaccctgctctcctctaagctccgataaagtctccaaagcctctacactgttttccaagcagagcttatagaaaagagtagggccaggcacagtggctcatgcctgtaatcccagcactttgggaggctgaggcaggaggattgagcccaggagttcaagaccagcctgggcaacatagtgagacccctatctctaaaaaaaaaaaaaaaaaaaaaaaaattaggctgggtgcagtggctcacacctgtaatcccagcaccttgggaggccgaggcagccggatcacctgaggtcaggggttcaagactatcctggccaaaatggtgaaaccctgtttctactaaaaatacagaaattagctgggtgtagtggtgtgtgcctgtagtcccagctactcaggaggctggggcatgagaattccttgaacccgagaggaggaggctgcagtgagctgagatcatgccactgcactccaacctgggtgaccagagcaagactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaagaaaggattaatgcctccccaaaatgtttggtctcagggacccctttaaactcctaaaaattattgaggatccccaaagagcttttgtttgtttattctatatttaccatattagaattaagactgaaaaagtgtaagatacgaatccatcttaaaataagaagccaggccaggcgtggtggctcacacttgtaatcccagcactttagaaggctgaggcaggaggatcacttgagccaaggactttgagaccagcctgggcaacatggcaaaacccctctctaccaaaaacacaaaatttagctgggcatagtagcatacatctgtaatcccagctactcaggaggctgaggtgggaggatcaccttaggtggcaagtcgaggctgcagtgagccaaggtcttgctactgcactgcagcctgggcggtggcagtaagaccctgtctcaaaaaataaaattaataagccaattgcatgtaacataagtagcatgcttttgataaaaagtaactattttctggcggggtggggggggtgggtgggggactgggcggggtggcttctgcctgtaatcccagcactttgggaggtcgaggtgggcagatcacctgaggtcgtgagttcaagaccagcctgtccaacatggcgaaaccctgtctctactaaaaatacaaaacattagccaggcgtgttggcaggcacctgtaatcccagctactcgggaggctgaggcaggagaatctcttgaacccggaaggcggaggttgcagtgagccgagattgcgccactacacaccagcctgggcaacaagagcgaaactccatcaaaaaaaaaagtaactattttccaaaacaaaaaatatttactgggaagagtggcattatttcaaatttttgcaaaatccttgaatattggggcttaataggagaaactagattctggcatctttttccatgttccatctttgcaatttgctcttttggttgaactatgttctaaaaatctgatcttacatagatatgtagttagaaaacaaaggagtatttgaatgtccttttcaaatcatggttagtatttctactagccccagaaaaaacctattgtattctgaagagaagtaatgaaaatagttttgttattattacaaaaatagttttgagccatagatcccttgaaaaggttttaagggacccactgggatttcctcagaacacactttagcatccaatgagctagattcagtcgatagacatggtttgtgtggtccctctgagcctttaagaaattagactaacaattaaaaatcagaagatggggccaggcgcagtgcttcacccctgtaataccagcactctgggaggccaaggcaggcagatcacttgagctcaggagcttgagaccagcctggtcaacatggcgaaaccccgtctctactaaaaatacaaaaattagccaggcatggtggcacacacctgtagtcccagctactcaggaggctgaggcaggagagtcacttgaacccgggaggcagaggttgcagtgagtcgagattgtgccactgcactccagcctgggcaatagagtgagactctgtctcaaagaagaagaagaaaaaaaaaggttaattaattaaagaaaataaaaatcaaatgttacagaaaagccagatttctccacattcccttaaaaaatgggaagatctggcatggcatggtggctcacacctgaaatcccagcactttgggaggcggagactggaggatcacttgagctcaggagttcaagaccagcctgggcaacacagcaagaccccatctctacaaaaaaatagaaaaatagctgggcgtggctgggcgcagtggctcacgcctgtaatcccagcactttgggaggccgaggcaggcagatcacgaggtcaggagatcgagaccatcctgcctaacacgatgaaaccctgtctctactaaaaatacaaaaaattagccaggcttggtggtgggcacctgtagtcccagctactggggaggctgaggcaggagaatggcgtgaacctaggaggcggagcttggagtgagccaagatcacgccgctgcactccagcctgggcgacagagtgagactccatctcaaaaaaaaaaaaaagaaaaggaaagaaaagaaaatagctgggcgtggagcacacgcctgtgggtcccagctactcaggaggctgcggtagtaggattacttgggcccaggaagtggagactcagtaagccatgatcataccacagcctgggcgacagagcaagaccctgtctcaaaaaacaataagtaaaaggctgagtgtggtggctgctcacgcctgtaatcccagcactttgggaggccgaggcaggtagatcacctgaggtcaggagttcgagaccagcctggccaagatgatgaaaccccatatctactaaaaatacaaaaattatccaggtatggtgaagcacgcctgtaatcccagctacttcaggcaggagaatcacttgaactaggaggtggaggttgcagtgagccaagatcgtgccattgcactccagcctgggcaacaagagtgaaactctgtctcaaaaataataatagtaataaacacaattttaaaaaataacaaatggcaagacctaacaacacaggacagacttccagcatggcgatcaccccatcatagctggggagcccctgcccccttctgatgggcgtgggccccctgagtctcctggggaggccccactttcccttcattatttttcttactcccaattccccagcccctgtaagcatttgctttttttttttttttttttgagacggagtcttactctgttgcccaggctgcagtacagtggcgcgatctcaggtcactgcaacctccaccttctgggttcaagcgattctcctgcctcagcctcccgagtagctgggattacaggcgcccatcaccatgcccagctaatttttagtagggacagggtttcactgtgttggccaggctggtctccaactcctaacctcaagtgatctgcctgcctctgcctcccaaagtgctgggagtacaggcatgagccaccgcactgggcccagcatttgcatttctttttttttttgagatggagttttgctcttgttgtccaggctggagtgcagtggcacaatctctgctcactgcaacctccacctcctaggttcaagtgattctcctgcctcagccttatgagtagctgggattacaggcatgtgccaccatgcccggctaattttgtatttttagtagagatggggtttctccatgttggtcatgctggtctcgaactcccgacctcaggtgatccacccgcctcagcctcccaaagtgctgggaatacaggtgtgagccactctgccgggcccagcatttgcatttcaacccaagttaaaggaatctctttgaagcacagacatccttttgtaaaagaagaaatgctacctcctttccttctatacagattaagagttgctctagctacatttgctacaaatctaacacctttctagaaactgtagccctgcccaggaaggaaacagatgcgatgaggcaatctaggaattttccagaacaacactgccctctgcagatgcagcctgtgtttttccagtaggaacaaaccagccaggaccctggccagggttccagggctgccctccctcccctgtctcccatcctaagtggaaaagttattattggtgccctgcctggtctcactttctccgaggaagctttccgccctatctcagccgcaggatgcccctccgctgagtctcgatagaacttcctggagttttgggtctttatccattgtctctgaattttccctgtcatctgaagccacatttcctctttcccagagggcctcatccccgtctccctgctgtcaacagctgtcaacagcctccttccatccttcagctctcatcagttatgagattcctcccttctgggataccttctttttcttcttattttttttttttttttttttttgagatggagttttgctcttgttgcccaggctggagtgcagtggcacaatctctgctcaccgcaacctctgcctcctgggttcaagcaattctcctgccccagcttcccaagtagctgggattacaggcatgcgccaccatgccgggctaattttgtatttttagtatagatagggtttctccatgttggtcaggctggtctcaaactcccgacctcaggtgatccacctgcctcggcctcccaaagtgctgggagcacaggcgtgggccaccgccccgggcccagcatttgcatttcaacccgagttaaaggaatctctttgaagcacagacatccttttgtaaaagaagaaatgccatctcctttccttctatacagattaggagttgctctagctacatttgctacaaatctaacacctttctagaaactgtagccctgcccaggagggaaacagatgcgatgaggcaatctaggaattttccagaacaacactgccctctgcagatgcagcctgtgccttttccagtaggaacaaaccagccaggcccctggccagggttccagggctgccctccctcccctgtctcccatcctaagtggaaaagttattcttggtgccctgcctggtctcaccttctccgaggaagctttctgccctgtctcagccacaggatgcccctctgctgagtctcgatagaactttctggagttttgggtctttatccattgtctctgaattttccctgtcatctgaagccacatttcctctttcccagagcctggcctcatccccgtctccctgctgtcaacagctgtcaacagcctccttccatccttcagttctcatcagttatgagattcctcccttctaggataccttctttttcttcttcttttttttttttctgagacggagttttgctctgtgacccaggctggagtgcagtggcgcaatcttggctcaccgcaacctctgcctcctgggttcaagcaattctcctgccccagcctctcaagtagctgggattacaggcatgcactaccacgcccagctaattttgtatttttagtagagatggggtttcaccatgttgacaggctggtcttgactcatgacctcaagtaatctgcccgccttggcctcccaaagtgctgggattacaggcatgtgctaccacacccagctaatttttgtattttgagtagagatagggttttgctatgttggccaggctggtctcaaactcctgacctcaggtgatctgtcctcctcagcctcccaaagtgctgggattacaggcataagccaccatgcctggccagagataccttctttttggccagtttgctaagtccagttcattcttcagggcttagcacattgtcacctcttccttgaagcctttcttgattgatacaggccaccgtgggctcctccacactcctgcagtgcttaggatggaggtgggagatcagctaggaatgctttggtgacagtgatgtcacatccatcaaacagcagattaaagtagcagagatttccttttcttacataacaagaaatctggaggtagctgtgactggcagttggttcaggagcttaagatctcagtgccaacacctttgcagtgctccccgcctcatgattgcaaggtggctgctgaaagtccagccatcacatcatacatcatagcagaaaggaggaggaaagggaagggagctgtgccagcagatttccactgttctctacccgtggccacctagtaagggagttttcccctctgtagtagttgcaggcaagggaaaacgctagggcataggggtgcatgtgctcctgcctatgcccatggcaggcattaccaatcgatcactgcactgtttcctgcagaccccaaatgtggcctcagaaccattatcatcatagtactccaggtagatcctgtcagttgattaagaggtgacatgggagataaaacccatttgacatcaggtatttaaaatgtcttgctggccaggggtggtggctcaaacttgtaatcccagcgttttgggaagccaaggcgggaggatcacttgaggccaggagttcaagatgaccctgggcgacatagcaagaccctgtctctattttttaaaaatagataaaatgtcttgcctcatgagatttcttgggtaaatgttttggggttatgtgtgtgtgtgtgtgtgtgttttaattaaacaaatatattgtcttttctttaaaaattttatttattattattttctttgagacagccttgctctgttgcccaggctggagtgcaatggcacgatcttggctcactgcaacctccaccttccaggtccaagtgattctcctgcctcagctgcccgagtacctgggattacaggcacttaccaccacgactggctaatttttgtatttttagtagagatggggtttcaccatgttggccaggctggtctcaaactcctgacctcaaatgatccgcccacctcggccttctgaagtgctgggattacaggcgtgagccactgtgctctgcactccccccacaacaactttaaaaagtactctaggaaaggtcaagtcctcaggaccatcccagccccaaatcctggcccctcttgggctttggttgaattgtgtctactgtggcccctcgtggcacagatgccatctagtagcccatgtcccccaccagttggtcagcccctggacacttggcaaattgctagagtgtgggagctggaggagccagggctgagtgcagtggttctgtgcccgcctcacccccaggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggtatgtggggtaggggtggcctaggggcaggggcactagtccgggtggggctgggctagccttgctgtcaggccatggagactggagacctcctggaatgaccccagggacagctgagtcatggtgaggatttgaaatcttctaggaccacaggcaggtggagggaccctggctagccgcttttgcagacatcatggctgcctatgtggcagtctgtgtgatacggtgcaaaggaaaacttcctatctgacctgtccagaggcaggatgagccaatacaggtaaagagctccctgttcagaggagtaatcaaccacaagccagttccttgctcagggtcctgcagtggggcttcacacatcagtctcaggaaggagacaagaacttgaaagtctacagcaagcctgggattctgggtggctgagttttttttgttttttttttttttttttgagacagagtctcgctctgttgcccaggctggagtgcagtggcgcgatctcagctcactgtaagctctgcctccctggttcacaccattctcctgcctcagcctcccaagtagctgggactacaggcacccgccaccacgcctggctaatttttttgtatttttagtagagacagggtttcaccgtgttaggcaggatggtctcgaactcctgaccttgtgatcctcctgcctcggcctcccaaagtggtgggattacaggtgtcagccactgcgcccggtcgagatttcttttctattatgaataggaacctgacttcactgagtctgcagagacgggttggggtaggcaggtgatgctggtagcatagcacaggaccatccccatcccttggccaggcgcaatggctcacacctgtaatcccagcactttgggaggctgaggcaggcggatcacttgaggtcaagagtacgagaccagcctggccaacatggcgaaaccccatctctgctaaaaatacaaaaattagccgggcatggtggagtgtgcctgtaatcccagctacttgggaggttgaggcaggagaatcacttgaacccaggaggcggaggttggagtgagctgagattgcgccactgcactgcagcctgggcgacagagtgagactttgtctcaaaaaaaaaagaataaagaaaccaccccatccccatcccatcctcctgtgatgagcactcaggacaagcctgagcctggtgaacgtcacgatatggagggcgtggggtccaggaggacaggcccttgcctgggaaagctgtcctgaagccccccaccaccctcctgcccagacattgggctcagccactgtagaggtgatggaaggagagcagggcccagccctgggcaagggggtggttcacaggctggagggagggcctcagcgccaccgaccccctatatccgggagtaggcccttggccctcagggttccgggataaagagcatcactctggccacacacccagactgtggctgtgggggtcactgagtcctgccggccttcaagtcctggcctatctggctagcaggggttggtggctgcaccctctgtggtccctgtggctcaacagaagataagcccctggggttggcacggactggggagtcttgaatacccccaggggcttccctagagccttgtaggagtgcgcagtgctgagctcagactggtgcccatggggcacagattggtcaagtttacttgggaagtggcggcctctgccccagggtagcctcttgtctcatcatctccctgcactgtgtccacgggagaacttgggaagccttggtgtgtgggtagaagcctcttgatttcaggatggaggttctgttgggaggtggtttggagggtcagagcaggcaggactgggcagtgctgaaggatggagtttgtgcaggagcgaggaggctggcgggccttggggcaggtacagctctgggtgccatggtgggggtgactatggagaggaggaacctcataagacagttgggtgggggcagtgtaagaagaagggtgctgggtgcggtggctcatgcctataatcccactgctttgggaggccaagttgggaggatggcttgaggtcaggagttcgagaccagcctggacctcataacaagaccgcatctctacaaaaaaagttaaaaattagccaagtgtggttgcatgccctgcagtatcagctactcgggaggctgaggtgggaggatcacttgagcccaggaattggaggctgtaatgagctgtgattgcaccactgcactccagcctgcacaatagagtgagactcagtctttttttgggggggggggggtggggaccaagtctcactctgtcgcccaggctggagtgcagtggcatgatcttggctcactgcaacctccacctcccgggttcaagcgattctcctgcctaggcctccagagtagctgggactacagatgtgagccaccacaccctgctaatttttgtacttttagtagaaatggggttttaccatgttgaccaggctggtctcgaactcctgacctcaggtgatctgcctgcctcggcctcccaaagtgctgggattacaggcgtgagccaccaggctcggtctctgtctctttttttaattatttttaaaggcaaggctgggcgcagtggctcatgcctgtaatcccagcactttgggaagccgaggcgggtggatcacgaggtcaggagattgagaccatcctggctaacacggtgaaaccacgtctctactaaaaataggaaaaaattagcggggcgtggtggtgggcccctcccagctactcaggaggctgaggcaggagaatggcatgaacccgggaggcggagcttgcagagacccaagatcgcgccactgcactccagcctaggtgatagagcgagactctgtctcaaaaaaaaaaaaaaaaaaaaagtcaagagggatggggtcctgggttccccacttggagaccatggagcacctcacagaggcctgagggacctctgggtgatgcccaggcttggaacccagagacaaagtgaggctggaagactttcctgcctagagttgagacgcccaccaacacacacacgcacactcatgtactcttccactctcctgccacttccaggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccaggtgagccgcggctgacagggcccaccaggaggcaagccacggggcagtgtcctcggagcccccgtctgatgcgggaggcagccttgtctttaaaaccccagtctgaggaggtagggagctcgtcccaggaacctggtctgaagggggaggtagccctgtcccagaaaccctggtttgaagaaggaggcagctctgtcctgggaaccccagtctgaagggggaggcagccctgtctcaggaacccgggtctgaatggggaggtagctctgtcccgggaacccctggtctgaagggggaggcagctctgtcccaggaaccctgatgtgaagggggaggcagctctgtcccagaagcccccggtctgaagggggaggtagctctgtcccgggaaccctagtctgaagggggaggcatttctgtcctaggaaccttgatctgaagggagaggcagctctgtcctgggaaccctagtctgaaagggaaggcatctctgtcccgggaaccttgatctgaagagggaggcagctctgtcccggaaccctggtctgaagggggaggcagctctgtcccgggaaccctggtctgaagggggaggtggcgctgtcccaggaacctccatcagaaatgggaggcagccctggcccaggaaccctgatctaaagcgggaggcagctctgtcctgggaacccagctgaaaggggagggagccctgccctctggaacccccagttcaaggggcacatggctttgccctgaggagcttagactaagaaggaagatgcagccttacccctagaggcttggtctttgggggtgctgggagccccaggctgaaggggttggaatttggagcctgagacggtcccatgggaagacctcgccatctagtgggaaaatcgggaactgctgcctggtgcacctggctcagtgtctcccctaactcttccagaccatcggcaattccggttctgcaaacggcatccaccagcaggacaaagctcagaaacaagaggtgaggggcgcctcgggcctcccaggtccctcccgtgcaggcagacctctctggagaaaatccttgaaacgtcactaagaatacacacaaagatgcattctgcaagaagctttacagtagggtccctcagggagggtgctgttgcaggcaaacttgattccagattcaccctgctctttttgatttgtgttttcttcccttcttaaaaaagttataggttgggcgcagtggcccacgcctgtaaccccagcactttgggaggccaaggcaggaggatcatttgagcccaggagtttgagaccagcctggccaatatggtaaaactccgtctctactgaaaatacaaaattagccgggtagggtggacaatatagcgagaccctctctctattaaaaaaaaaaaattttaaaaaggctgggcacagtggctcatgtctgtaatcccaacactttgggaggccgaggccggtgggtcacttgaggtcaggaatttgagaccagcctggccaatatggtgaaactccatctggcgggcggatcacaaggtcaggagatcaagaccatcctggctaccacggtgaaaccccatctctactaaaaatacaaaaaaaaattagctgggcgtggtggcgggcacctgtagttccagctactctggaggctgaggcaggataatggcatgaacccggaaggcggagcttgcaatgagccgagatcgcgccactggactccagcctgggcgacagagcgagactccatctcaaaaaaaaaaaaaaccaaaaaaaaaaaaaaatacaaaattagctgggtagggtggcgcacacctgtaatcccagctacacgggaagctgaggcaggagaatcgcttgaacctggcaggtggaggttgcagtgagccgagatcgcaccattgcactccagcctgggcaacaagcacaaaactgtctcaaaaaatagtaataaaaattttaaaaattagctaggtgtggtggcgcatgcctgtagcctcagctactcaggaggctaaggcaagaggatcactcaagcccaggagtttgaggctgcagtgagctaggattgcgccactgcactccagccttggtgataaagtgagaccctgtctctaagaagaacacagaaagagagagaacctagttctgactgcagaatccctggagcacagatgctcgctagaaacaggagcagcacagccacagaatctgccaagctccagacacaggcagggttatgtgggcagagccagcctcagaggagttagtgtgattttgtcctcctggccttgttctcctggccaccctgcgagacacatggggtcatcccagttcacagatgtgaaaactgtccaggtgcagtggctcacacctataatcccagcactttaggaggccaaggcaggtggatcacttgaggtcaggagtttgagaccagcctggccaacatagcgaaaccccatctctactaaaaatacaaaaaaaaaaaaatcatctgggtgtggtggcacatgcctgtagtcccagctactcgggaggctgaggcaggagaatcgcttgaacccgggaggcagaggttgcagtgagccaagatcgtgccactgcactctagcctgagcaacagtgagactgtctcaaaaaaaaaaaaaaaaaagagagagagatccagccccgtacaggcactgagggctctttgtaaaacctgcttctggctgggcgcagtggctcatgcctgtaatcccagaactttgggaggccgaggtgggtggatcatgaggtcaggagatcaagaccatcctggtcaacatggtgaaaccccatctctactaaaaatacaaaaattagctgggcatggtggcgcatgcctgttatcccagctactcaggaggctgaagcaggagaatcgcttgaaccagggagtcgaaggttgcagtgagctgagatcagaccactgcactccagcctggcgacagagcaagactccgtcttaaaacaaacaaacacacaaacaaacaaaaaacctgcttcttcccctcggctccgcttcccatcagcacctcccaccccacctgctgtctcacacagccacaaacacacagcagggagacacttcctgcctcagggccttggcacatgcagttcgctctatgctcctcccccacccggccccaactcctttcctccctgactcccctctggccgcctggccctccaggctctctgagacccttgctgatgatgccctttactctctctaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccccggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtgggggccccttttccgaagccacttccaggccaaggcagtcgccagggcttcttgtccccaccttctgaaccttcttcaaacagtagtacaagctcccctcagccagcctgcctgcccagcgaggcccccaggttcaaggtgttggcgggggcggagggcaggggaacgggatccttctcccgctgcccaccaacaccaacacacacacacctctaagctgctggccgaagatgtcaccaaggccaaagacacagtattatgaaggtttggaaacccctctcctcacctcccaccgtgaccttgggcaaaccctggctcggagcccagggcagaggcagctcagagtggaggctctaggcaggtttgacaaaggtcagtaatacggtttcccctggggttgaccagatgttccaaaatatctgcatccacctggagatgcagctaagtgggtccttatgtacacaccacgttcacacacacacagagggaccacgtgtgcacgcatgaccgtgtgggtggcggcgtttgctgtgaaccacgctcaggccacacagagacacatacttggtttctgggactgagacccaggcctggcaggaccgtgcctacagatactgcaaacgttcctacagcctagaggtgcgtatacacacccaagtacacgcagccaggcattcaggggtgtgtttgccacatggagcatcccttcctggtcttgccaggcacctgcacagagcgtctccagccccatctcctaacgggggctgggggtaagagaaatctaactgcgctcccccaacccctcgccctgccatcttcccctcaagcctgctaagttatcccaggcctgtgcgtggtggaaaaagccagccttggccctgcagcctccacctcgccgctgggggaccaacaggttgcttacagctttgcaccccggcatcagcacaggggtccctgccccaccctccggcagctcagggagtgttttcctgtgaggcctcccccatcagtggaccagagggagaagcccgatgccccatcccggctttcccgtaacgcacaggacacgtgtgcaattcataggaacggcccagatcgccctcatgagtgccacctggtacaggtaggtggcgctcacgttcctgcccaaatgcagcccatcggggagtcacagtcagtccccccggcccccctcccagtccctgttggctttcggtagctctcgcatgcagttctattaacagccgtctagaagcgatgctttagtggcctaacccagggtcaaatacagctctttctagcaaaatcaggcagctctgccccatcggtaggggcaccgattagtctactaacagccagaggtccatctagcagggtgccgggaggagctgagcccccggaggtgggctcctggtgacgggtgtccaagaagcggtttccttgggagcttctgcctccgtgggcctctcagcccgccccgtgtggccgcccgggtgtggctcagccatgtcccctccccaggtccttcattcacccctcccctccccacagtggaattgttgaagtgtggcgagtctgtgctcgggacaataaagcttgtgacaggtccagg

SEQ ID NO: 37479 - DNA, 44042 bp, Homo sapiens; identical to SEQ ID NO: 35601

SEQ ID NO: 37480 - DNA, 24085 bp, Homo sapiens; identical to SEQ ID NO: 36845

SEQ ID NO: 37481 - DNA, 12668 bp, Homo sapiens; identical to SEQ ID NO: 36082

SEQ ID NO: 37482 - DNA, 25587 bp, Homo sapiens; identical to SEQ ID NO: 37022

SEQ ID NO: 37483 - DNA, 204754 bp, Homo sapiens
ggggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcggtgcgtgggcggcgccgcgtgcccgcttcctcccccggcccgggttcggcgcgctgagtgcactttaccgggcggggaccgcagcccggcggcgccggccgctctgcgagggctgccggtgcgcggtcccgcgggccgtggtggggcgcggccttcctaggcgggagagggccaccccggcgcggcgttaggtgcacggggcagacgcgcgcctcccttggggggaccgtggcccgcggagcgcctgctctcgcacggggtgaagcctctgcggcctccccgggaggcggggtgcagaagccctccgtcccccgtctccgtcactggaggaggtccctgggctggggagactcgggccagacccctccggacagctggtcagccctgcagtgtggactcccaggcttgcctccaccgagcgcggtttctgtgaatgttgtgtggacagggagatagggaatgagagagggggacgcagggaacaaacctgctgcaaacaaagcgcgcctcgggtggggagggcagcagcctgtccgttccgtggacgccgtggacagagcgggctggccgggtccgtgcctctgcaggcggggtggggtgtaggtacccctgtggaggccattcgatgagtctaaattctccgagttcagacccacctttaccgctgtctataatgggttatttccaaacaagtccttaggagctcatagctaagtagttacatggggttttgtaattcagtaaaatcatctttgtagaccctttgagtaagaagaacttttgcattatttggccttcctcattttagaatgacagcgctttgattttaggagtcaggcagggtggggggccttgtgggaggagtgcgggttcggcgtcagatcctcctgcctgtgaattctggccctgtcgcttggacctgatacttgattgcctgtttcttcgggtgtaagctggggcggataacgatgcctctcgtgcagaactgttctgagggtgagggaccctcatccagggaccagtgaagccagattttttgttcctggtgtaacagcccaatggcttcttccttttttttttttttttttttttgatacgaagtcttgctctgttgcccaggctggagtgcagtgcagtggtgcgatcttggctcactgcaacctcaacctctcaggttcaagctattctcctgtcttagcctcccgagtagctggggctacaggcgcgcgccaccacgcccggctaattttgtatttttagtagagggggtttcaccatgttggtcaggctggtctcaaactcctgacctcaagtggtcgcccgactcagcctcccaaagtgttgagattacaggtgtgagccactgcgctcggccccagtgggttctttctgcgggctgcccagatagagttgatttgtcagggcaggggagttgccatggagaagatttagttcacgcagagccggttgaaagggagactagactagaggtttttttttttttttttgaggcggagtctcactttgtcccccagggtggagtgcagtgatgagatctcagctcactgcaacctccacaacctccacctcccaggttcaagtgattctcctgcctcagcctcccgagtagctgggactacaggtgcgcgccaccacgcccacctaatttttcgtattattagtagtgacgggtttcatcgtgttagccaggatggtctcgatctcctgacctcgtgatccacccgcctcagcctcccaaagtgagccaccacgcccggctggagttttattattactcagatcagtctccctgagaatttgagggccagggttttttagaggtaatctgggggaaagggtgggggtggctgattggttaggggtatacaatcataggggagtcggaaatgatcctccgtgatgtgctgaatcgcgtctgcgtggggccccaggagcagtgggcgggtccaggtggagctatcatgggtccgtggatcctagtgtaggtgtcagacatggaaacaatctgaaaagatatctttaaaggccagtctcaggttctgcaatagtgacatggtctgcaggagtaactggggaactcgcatgtcttgtgatctcaagaataatggctggcaattaggttacgccttagcggaattcaggctcctctcctcctcctagcctggtggcctctcattaactttacaaaggcagttgagttttggggaagggctcttagcatttaaactataaattaaatgtctcccagaggtagcttggcagcttgaagactaaaggcatgagggggttgcctggatcagatctgccccattgccataatttcctcacagatcacttttgcaaaggcagttttgctgggaagcagtgggtgtgttcagatgtggaggtgggagctgccggattggacagaagcagtttcagctgctgagaggaggagaaagcggtggttcagggtctgggaggttgtgaagagctggcagctgtgtggaagggagcagtgcctggatatgtcaaccaaaaagtatctgagacgagtctcaatcagtttagaaggttaagggtgtgcccgtgaggcagcctcaggaggtcacatgtccccaaggaagtcgggctacagcttagttttacacgttttagggagacgtgagacatcaatcaatacctgtaagatgtacattggtctcgtcagggaaggcgggacatcttgggtgggagggcgtccagggcattggtggattcaaatatttcacgattggtgattggttgaaagagtttatctgaagacctggaatccatagaagggattgtctaggttaagataaattgtggagaccaaggtttttcttatgcagatgaaggttccagttagctggtttcagagagaatagattgtaaatgcttttcatcagactaaaaaggtaccagacttagttaattttctcttggatcagggaaaagacctagaaaaggaagggattctctacagaatgtagcttttcccagcaagagacaacttagcagaaccatttcaaaatatgtcaaatatattttagggaaaaatattttgatttctttcagggcctgctgtctgtcatgtgatgctgtactagagtcaggctggaatttggtgtcttattgctacttaagatcggttttaatgctaatactgatcagctgtgcctgaattccaacgagaggagggtataatgaggcctatgtggaccactccccacaatcccttaatatcatgaggcctgaactagtttttcaggttaagtttggaatgcccttggccaagaggaggggtctgttagatggctagggggcttagaattttgtttttagtttacaggcatgtttggcaggggagtgtgagaggagtgccagggatgtgtgtctcacaaggacagagttgagcttggcccttaacggctggcagaggcaggagagagtgaaggaaggaagaggcgaggaggagactctgttaggaagagtatcgaggcagtgggaaaagaggaacagtgtgccaagcaagtaaactgcacgaggctgggccacagtggccctcaaaaggctagagggaggtggggcattccctccaggtggcctgtgtggcctcctttagtgagaggggaggtgtgctcttgagagctggggaagaggtggagctgccctgtggaagctagcaagggaaaatggggtttctgaggctcatgggtatgtttggcctagtgataattaattttcatgttatatttgtttttagtaataatggacaaataccaggagcagcctcatctgttggacccgcaccttggtaagaatagaagctgctgattttgatcattcagttacagatgaccacggaggccttggtgtgtggtgctggcacatgcatgtgctttgccaggatcaaatgccaagaagtgtccctgtcttgcttgcctggctggttggttttagccgacctgtgatagtggcttgagttccagatgtcactctaggctggggggagatgtgtctgagctacttaattcctttctgctaaggaaacaacatctgctcctcatgtgttttttttgtttttttttcttttttttgagacggagtctcgctctgtctccaggctagagtgctgtggcgcgatctcagctcactgcatcctccagctccctggttcaagggattctcctgcctctgcctcccgagtagctgggattacaggcatgcgccaccatgcccagctaatttttgtatttttagtagagacggggtttcactatgttggccaggatggtcttgatctcctgacctcgtgatccgcctgcctcggcctcccaaagtgctgggattacaggcgtgagccaccgcgcctggcctcctcaagtgtttttagtttacattagtttattattttagtttacatttgggcacatgatgtttttctggtaatagtcatacagggtcaggtgttttacatgggtcatcatttaatcctcacagcagctaaggagggcatctgttgtcatctccagtttacagatggggacactgaggctcggttttcttactttagtgtaaggggtgtggtttcttattgttttctttatttttgatgtatttcacactgattaaaatttttctttttctacctacaaatgtgacacatgcttctggcagttcacctgggaaagaggaaggtggcaatagtcaccacgttgagagggagcaccctgggtgggggcaccctggcttcatagcccagtttcaccattcagtttttgagctgctctttgccggggtttcctcgccccccgtggtgttgagatctgtgtgagagacactaagggtcagcctttcatgtgcgcacacgtgcctcttaaagagtagtttgtgctgtgcatcttgttctgtttttttttcttcaaataacagattttggctgggggtggtggctcatgcctgtaatcccagcactttgggaggtggaggcgggtggatcacttgaggtcgggagttcgagaccagcatggctaacacgatgaaaccctgtctctactaataatacaaaacgttagctgggcatgctggcagttgcctgtagtcccagttacttgggaggctgaggcaggagaatggcgtgaacccgggaggcggagcttgcagtgagctgagatcacgtcactgcactccagcctgggtgacagagtgagacttcatctcaaaaaaaaaaaaaaaccaaaaaaaaccctctaaattcgggattcaagaattcattgggatcagacttgtccttctgtcctagaaaaatttataggccttgtgaaggagaccaaagatagaggtccttgggagagggtcagctgcagggaacatgactctgacatctggtggaggggctagccatgctggatggcgtggcaggcagtgggctccccaggccatatcttataggaggtcttgggttcctggagttcctgtgtgtgagcgctggttcccaggaaacagatgtggtcactgctcacaaggtagcgggtggtgtttttatatctcttcaagtaacaacgttggacctgtagttaaatgcctttattcttgccagacctctttccagagtggatcatggaatattaacacttgttgtgagctgcttagagtactgcgaatgatttttagagttattttctttctttgcaaaaactgtttttcgccgggtgtggtggcttatgcctgtaatcccagcactttgggaggccggggcgggtggatcacctgaggtcaggagtttgagaccagcctgaccaacatagtgaaaccccgtatctactaaaaatgcaaaaattagccgcgtgtggtgcacgcctgtaatcccagctacttggggctgaagcaggagaattgcccgaacccaggaggcagaggttgcagtgagccaagatcgtgccattgtactccagcctgggcaacaagaacgaaaacgtctcggaaaaaaaaaaaaaaaaaaataaataaataaataaatttttttttttgtagagaaggggtcttgccgtgttgcccaggctggtctcatacctctgggttcaagcggttcacccaccttggcctcctaaagtgctgggatttcaggtgtgagccagcgtgcccagctgagttcattattttctggaattcctttttagaaaaaggaaaatgtagtcgtgggatgctggtcctttgtcatttgttgcacatttttccacccttttgcttttttttttttcttttttttttttttttttgagatgtagtctctctgttgcccaggctggagtatagtggcccaatcttggctcactgcaacttctgcctccagggttcaagcgattctcctgcctcagcctccagcgtagctgggattacaggcgtgtgctaccacgcctggctaattttttgcatttttagtagagacagggtttcaccatgttggccaggctggtctcaaactcctgacccccacgtgatctgcccaccttggtctcccaaagtgctgggattacaggtgtgagccattgtgcccggcctgcttttgccttttaatattgtgtctggtgtattttatctactgaagttttttcgtgtttgtttttttaaagagatgggatctcgctctgtcacccaggctggagtgtagtggcgcagtcatagctcactgcagccttgagctcctgggattaagtgatcttctcacttcagcctcctgcagagctgggacaacaggcacaagctgccatgcctagttaattaaaaaacttttttttttggccaggcgcagtagctcatgcctctgatcctagcactttgggaggccgaggcgggtggattacaaggtcaggagttcaagaccagcctgaccaacatggtgaaaccctgtctctactaaaaatacaaaaattagctgggcatggtgaagcatgcctgtaatcccagctacttgagaggccgaggcaggagaattgcttgaactgggacccaggacgcggaggtagcagtgaacgagatcgtgccactgcactccagcgtgggctacagagccagactgtctcaaaaaaaaaaaaattttgtttttgcagggtcagggtcacgctgtgttcctcaggctggtctcgaacttctggccccaagcaatcctgccttggcctcccacagtgctgggatgacaggtgtgagccactgcacccagtctctactgaagttttagaaatatttagcttgtcaaactatcagtttctttgtgtttggcctttggtagtacggttagaaagtttatttttcctaatcagttatgtaagcctcatttattggatgatttagtggcctctcccctacttgaaatgccattttaaatctatattaaatattcaaatatattagcctttgcttttagattttttatcctgttccattgacctatctgtatgctcttttttctgggtcatttcgtttgtttgttttttttttttttttgagatggagtctcgctctgtcacccaggctggagtgcagtggcgtgttcttggcttactgcaacctccgcctcccaggttcaagagattctcctgcctcagcctcccgagtagcatgtgccaccacgcctggctaatttttgtatttttagtagagaacggttttcatcatgttggccaggatagtctcgaactcctgacctcaagcagtctgcccgccttggcctcccaaagtgctggaattagaggcgtgagccaccacgcctggcctgggtcattttgtttgatgttagtttatattttgcctggcatcctttcctcttattttcttgatggttttgtagcccgttcattaatgcggatgaactccggaattattttatcactctccaccctttggaattctattaaattcacaaattcatgtaggggagaagtctttctaagatttaattttcatgtctaagatcatggtattatgtctctaattattcacatcttttgtgttcctcagtgaaggttggtgattttctttagatgattcctggagacttttttttaggtttatttctaggtatgttttgtcttttattgctcttgtgaaactatttgttatgtgttctaactagttattgctgatgtctagtgaagatatgttttgtatactgtttttgtaaatggcaacactgtaatggaatatgtatgtgtaaacatacatttcttaacatctttatagggatataattacatactatagagttcactcttctaaatatacattttagtgttagtgtattagtgtattacagagttgtgtaactatcactaccacaatctaggcattttcatcatctgaagcaacccaactcccatcaacaattccttcccattctctgcttccgcagtaaccactcatctggctctgggtttgtgtgtattcagcattttgtgtgatggaatcatgcagtaggaggtcttttggcactggcttttttcacttagcatcatgtctatgaggttcactgtgtgatgaaatgtttacttcaatagtttttcagtctttttttttttttggagacaaagtcttgctctgtcacccaggctggagtgtaatggcgtgatcttggctcactgcaacctccttctcctgggttcaagcgattctcctgcctcagcctcctgagtagctgggattacaggcgccacctgtaaaattagcctggccaatttttgtattctgagtagagacagggtttcaccatgatggccaggcttgtcttgaactcctgacctcaggtgatccacctgcctcggcctcccaaagtgctgggattacaggcgtgagccaccgtgcccggccagttgtttcttctgggttttcttagcaggtaaatattatatggtttgtaaataatgctactctttatccacgattataaatttttattcttagaacattttattgagttttaattttattgagtttaaaatttacctactataaaatgcacccattttagtaagatgtttgagtttcggtaaatgtatacaccccgcgctatcaagatatggaacatttctgtcatcccaaggagttacttgatgtccttttgctgtcagtcccctcaccccagccctagggaaccactgttggttaatggtactgttcattagttttgcctgttctagaatcattcagtatgtgctctttttgtcttccgttgttaaaataacatctccgggacttaccattgttggtgtgtgtatcagtagtttgtacgttttctctcgtgctgataaatcacaatttgtttcttcttttttttttttgagatggagtcttggtctgttgcccaggctggagtgcggtggagtgcagtggtgcgatctcggctcactgcaagctctgccacccgggttcacgccattctcctgcctcagcctcccgagtagctgggactacgggtgcccgccaacacacccagctaattttttttttatttttagtagagacggggtttcaccttgttaaccaggatggtctcgatctcctgacctcgtgatccgcccgcctcagccttccaaagtgctggggttgtttcttcttttatctgttgatggacatttgagttgtttccggtttttggctgttattaataatgctactttttgggaggctgaggtgggcagatcatgaggtcaggagattgagactatcctggctaacacggtgaaaccccatctctactaaaaatacaaaaaattagcccagtgtggcggtgtgcgcatgtagtcccagctacttgggaggctgaggcaggaaaattgcttgaacccgggaggtggaggttgcagtgagccgagatcttgccactgcactccagcctgggtgatagagcgagactccgtctcaaaaaaaaaaaaaaaaaaagtaatgctactgtgaaaatgtttatgtacaagtttttaggtagacagaggttttattttctcttgggaaaatacgcatgtgtggaattgctgagtagcagaaagtgtcttacttgtagaaagtgtatgacttggccaggcgcggtggctcctacctgtaattctagcactttgggagactgaggcaggtggattgcctgagctcaggagctcaagaccagcctgggcaacatggtaaaaccccatctctactaaaatacaaaaaattagccgggtgtggtggcaggtgcctgtagtcccagctactcaggaggctgaggcacgagaattacttgaatgtgggaggcagaggttgcagtaagctgagatgacaccactgcactccagcctgggtcacagagtgagactctgtctccaaaaaaaaaaaaagtgtgtgactcatcacctgccatactgatgccatgaagattgtactgttgaccatttctaccaacaaggtatgaggattccagctgctctgggttctcttcagcactcagcgttgccagtctctctgatttcagggagtgtatctcgttgtgtccttctctgcgtttcccggatgccagttgcagttgttttccatgtatgaagacttgcagcccagcgtatggtctgttttgttgaacattccgcgtgcacttgagaaaaatgtctgttctgttgttgggtagattgttctctaaatgtcacgtaagtaaggtgggtgatagtgctgtttaggtttcagcgattttctcttacttgttctatcagttcctgaaacaggagtgtcgaagttttcaaccgtgtctcctttcatttctctcagcttcttctgtgcttattttgaagctctgtaggttggtgtgtatacttacagaattgttaagtcttcatgatgaattgatccttttattatcatgaaacattctgtttatctctgatggtaatgcttgttctgacatttactttgtctgatattaacagagccactccagctcttttatgatttgtgattggttggaatatctttttccttttgcttacgtttaacctagctatgtctttttgtttgtttttgttttttaagagacagggttttgggccaggtgcggtgggctcacacctgtaatcccatcactttgggaggccgaggtgggtggatcacctgaggtcaggagttcgagaccagcctggccaacatggtgaaaccccgtctctactaaaaatacaaaaattagccaggcgtggtgacgcgtgcctgtaattccagctacttgggaatctgagggaggagaatagcctgaacccgggaggtggaggttgcagtgagctgagatcacgccactgcactccagcctgggggacagagcaagactctgtctcaaaaaaaaagaaaaaaaagagacgggttttgctctgttgcccaggctggagtgcaatagtaggatcatagctcattgccgccttgaaattctggcttcaaatgatcctcccaccttggtctcccaaagtgctgggaaaacaggcatgagccaccacacctggccggcctcaatgtcatgttgatgttcacttttacagtaaatgtttcctatgtttttccctagaatggatgatgaacttgttgttggacatagtgcaagatcagacatctccagcttcccttgtacatctggcttttaaatttctttacatcatcaccaaggtaacatttccatagcacttcagagttgacagatacttttgtaatatacttggtccagaggttaccctccaaaatgttatttctcaagaaagatagttcttagacacaagttgtgggtttaattctgtccctttttactgtatgttggggatcagaatttagtgatgtgggctctttggctgaaacagtgtcaggatattcagcatcttgcatttgaatagattgaagcactgtgtagctaggaagggaatggggtggagatgagactaaatcagaaaaacttcttacaaggagaaagcaggccgggtgcggtggctcatgcctgtaatcccagcactttgggaggctgaggcaggtggatcacctgtggtcaggagttcgagatgagcctggccaacatggtgaaaccccgtctctactaaaaatacaaaaattagctgggcttggtggcacatgactgtaatcccagctgcttgggaggctgaggcgggagaatggcttgaacctgagaggcagaggttgcagtgagccgagatcatgctgttgcactccagcctgagtgacagagcgagactctgtggaaatggaagtgcttctcacactttaatgtgcagatgaatttcctgggaattttgctgtgctatagattttgagcaagtaggtctaggcgggggtctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgctcatagtctgcttttcttacaagcttgcgggtgtctgctcatagtctgcttttcttacaagcttgcgggtgtctgtgctcatagtctgcttttcttacaagcttgcgggtgtctgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgtgctcatagtctgcttttcttacaagcttgcgggtgtctgctcatagtctgcttttcttacaagcttgcgggtgtctgtgctcatagtctgcttttcttacaagcttgcgggtgtctgtgtgctggcccagaggctcactgttggcagttttgactatggaagtactcacagccgtctcagggtggggcttggggttcgtagtggcgaggcgcatttctgttgtctggcgggaaagtccttggccagcgagaggacactgcgggtgagctgccaaggacacgcaggcctctgtagctcctctgtttgaggttaggatttctccggaaggcgtggtatcactgagcttcagggaagtgttaatgaatttgggcccttgcggtttgtaggcacttattcctcataaatgtcagaggacagtcatataaatgaacatatttaatgactgattccgtaaatatggtaatgaataacactaccaatttaggaaggaaatctttttttttgagagatggggtcttgctctgtcactcaggctagagtgcagtgatgcagtcagctcactgcagcctcgaactcttggtctcaaatgattctccctcctgcctcatcctctcagactacaggcatgtgccaccatcctgtctaatttttaattttttatgttgcccaggctagtctccaactcttggtctcaagctattcttttgcctcggcctcccaaagtgctgggattacgggtgtgagccatcgctcttggccatgggtagctttcttggggtgactacggtcttactaaattgtgtcactgtaatgtcacagaattctctttgatcagtgggtcgcgtagctggtgatttttgatgaaagggtagaaaggcaattttgctgctctctgtatttttaaatgttataattcagcatctctttatttgataggttcgaggctataaaacatttcttcgtttatttcctcatgaagttgccgatgtagagcctgttttagatttggtcacaattcagaatcccaaggaccatgaagtgagtgtctctgcctcccccctcgtctccagccctccgtgcctgtccttcctccctgcttgccccaccctgctgcaccttccccttcctgtttctttcattttatctccctttgttttgtgtcactcctcttttctttcttttcttttcacttttcctttacttcttgtacaagttgctttaaattattttcgtttaaaatagcccctttataaaaaaaattatgcctaggtgtagtttaacaataaatccgtcattgtttctatgtttttttaactgtgtaagtataactgtgttgggttcccaagaccacccccaggtttgatacttcctgagcgggactcacagcactcagcatagagtcctccttttggctgtcacttgttatggcaaaataatacacagcaaaatcagcaaagggaaaaggcacatgggtggggtctggggagaaccaggcgggagctcccggggtcctccagttgggtcccacagggcctgtgtcattcccccagcagtgagatgtgaccacacctgtgaggtgtctatcagagaagcacgtttgagacttggtgcccagagctttcactggggtctggccacatggacacctctgcctggcacgaaacgaaattccagacccccagcaggaaagcaggtgccagcgtaaagcacacggtttgtgcagattgagccagcgagggacctcatcaggcagggcttggtgggaaccctgctggtgtccaggtccctggataccagcccagggccggcctcgtcaggggccttgcctcagacggcagcggggcctgctatgctcgctgtcttctgcgtggtatgtatttggaggagcacacggtttataaccgtgcagtgcggtggcttgtctcggcgtggatgtgactgatgagcgctgtggggcatttccctgctgccctgcactccgtgcccttctttccctagtacttctagcgccccccagtggaatgattgcagggacaaattgggatgttttttactaattactgaaaataagggtactccttttttattagaagttgataattgttttctttattcttttttttttaaaaagacagagtttcactcttcttgcccaggttggagagcaatggcacaatcttggctcactgcaacctctgtctcccaggttcaagcgattctcctgtgtcagcctcctgagtagctgggattacaggcatgtgtcatcacgccagggtaattttgtatttttagtagaaacagggtttctccatgttggtcaggctggtttaggactcttgacctcggccaggcacggtggctcgtgcctgtaatcccagcagtttgggaggccaaggtgggcggatcacgaggtcaggagatcgagaccatcctggctaacacggtgcaaccctgtgtctacaaaaaatacaaaaattagcctagcatggtggcaaacgcctgtagtcccagctactcagaaggctgaggcaggagaatggcgtgaacccggaaggtggagcttgcagtgagcgaggttgcgccactgcactccagcctgggcaacagagcgagactccatctcaaaaaaaaaaaaaggaactcctgacctcaggtgatccgctcgtctcggcctcccaaagtgttgggattacaggtgtgaaccaccacacctggccttttttctttattcttaggtgtttttactttttatctgtttttcactttttcaaaaggccagtttgtatgtggagaggtgccagcgaagagaagctgctatactgatgtattatgatttttctttgttcattttgatgtctctcttgtctgctgagctaagttacggcggtaggtgtgtgtggtggggattccgggggggatgtggcgaggagttggtgaacggcttgcatttctggccctgagggtgatggcatttgaatggctttcataggcattgggtgggcatggagggcagtgactttgagtagattgtggccagtggcctgtgattttcaagcaagactcattcttcccgtggtttaattttttaggcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagaggtaaatatcatgcagataattagctgctaattagtactcactttcatgttcatgctgtcttgatgttagtggtttactcggtaagcttctgatatgtattcaactgctgtttttttcagtggggtaaaatcccataggataacttattttgaaattgtgataattcatgtaggggtcaggttgagttagcaaatctcatttctttgtagatgatgcaaatactctgttgagggtaatcatggcagataaggaagggtttagtggcatggtgagagagaataaggacccattttacatttagttcttaacgttatataaataatagatgctcatttgtaggagaactagaaaataaagataagcaagaaaaatactaaatttaaatttatgaaattctagtgccaagagataagttgtttattttctccgaacttttcctgatgtaaatattatgcatataaacacagcttattgtattagttatctattggatcataactaattaccccaaacttgagtgtttgacacacatttatcctcttgtagtttctgtgggtcgggagtctggcatggctgagctgggtcctttgtgtcaagcttgcccacagctgcagttaaaactcgacatgggcaggctttgccccaaggccgttggattgaggccaccctcagttctttgccacctgggcccctccaacttagtgacttattccatcaaagcctgcaagggagaaactctgctaatgagatggaagtcatgataatatgttacctgatcatggaagtgacgtcccattcctctgccagatcctgtggttagcagcaagtcaccgagtccagcctacgcaagcgagcactaggaggctgtcaggctctgagccatctcagttgtctcggtcttcctgccacgctgactgcgacagccctggtcagcattcactgagtgcctgctgtgtgcctggcaccgttcaaacactcatagattaatctttaatcacttatggattaataatttaacctatacattgggctgggcatggtgggtcactcctgtaatcccagcactttgggaggccggggcgggcagatcacgtgaggttaggacttcgagaccagcctggccaacatggtgaaaccctgtgtctactaaaaatacaaaaattagctgggcctggtgacacatacctgtaatcccagctactcaagaggctgaggcagaagaatcccttgaacctgggaggtggagattgtagtgaactgagattacgccactgcactccagcctgggtgacagagcgagagtccatctcaaaaaaaaaaaaaaaaaaatttaacctatacgttgatgattgatagatcatcagtgattaattaactgtgattaataatcattgaattctccttcatgaggctgttgacaattcttaccctcgtttaaccgagaaggcaacaggcataaaaattaataacttagtttactttgctcataaatggtggatccatgtttgaatccaggcggtttatctggagtctgtgctcttcatcagggctcagcattgccccatgacctgctgttctgagtcctttttaccctcagcaacacgttcttagtgtcttacgatgtcagaaagtgtccccctcataatcgttaagggaaaaggtactccattgtaatctaatttaaaattctctctgatagatggatgttttgtttgttcttgttttgttacgttagaggtagtgtggtgatgggctgggtgcggtggctcacgcctgtaatcccagcactctgggaggccaaggtgggcatatcacctgaggtcaggaattcgagaccagcctgaccaacatggagaaaccttgtctctactaaaaatacaacattagctgggcgtggtggcacgtgcctgtagtcccagctactcaggaggctgaggcagaagaatcgcttgaacctgggaggcggaggttgtggtgagccgatatcacgccattgcactccaccctgggcaacaagagtgaaactccgtctcaaaaaaaaaaaaaaaaagtagtatggtttacccacccttgtttacttgtctgtggagagggactgccaggtcaagggagcatggtttgtcaagacttggcactctgtgattgccgttagaaagcctgccccggaggccgggcacggtggctcacacctgtaatcccagcactttgggaggccgaggcaggtggatcacgaggtcaggagtttaagaccagcctggacaagatggtgaaaccccatctctactaaaaatacaaaaattagccgggaatggtggctagtgcctgtgatcctttcatatttattcaactgttctcttacaaatgaacagctacttgggaggctgaggcagagaattgcttgaacccgggaagcagaggttgcagtgagccaagattgcaccactgcactctagcctgggcagcagagcaagactccgtctcaaaaaaaaaaaaaaaaaaaaaagcctgccccagaaaaaaagatcttctaagtgtatcgttatgggaaaaaacaaacaaacaaacaaaaaaaaccgagacaagcattggaaacattttaaggcagccctccgaaaaataaatctagctgggcgtggaggtttcatgcctgtaattccagcactttgggaggccagggtgggaggatagcttgagcccaggagtttgagagcagcctagacaatataatgtgactcagtctctaccaaaaaataaaagaaaattagccaggtgtggtggtacacacctttggtcccagctattctggaggctgaggtgggagggtcatctgagctggggaggttggtgctgcagtgagtttttttttttttgagatggagtcttgccctgtcacccattctggagtatagtggtctaatctcaactcactgcagcctctgcctttgaggctcaagcaatcctcccacctcagcctcctgagtagctgggattacaggcatgtgccatcatgcctggccaatttttgtgtcattagtagagacggggttttaccatattgaccaggctggtctcaaactcctgacctcaggtgatccgcctgccccagcctctcaaagtgctgggattacaggcgtgagccgcagtgcccagcctacagtgagctttgctcacaccactgtactccagcctgggtgacagagcgagacccggtctcaaaacaacagcaaaaaaaccctaagaccagctactggggaggctgaggcaggagaatggcgtgaacctgggaggcggagcttgcagtgagccgagatcgcgccacggccctccagcctgggcgacagagcaagactccgtctcaaaaaaaaaaaacaaaaacaaaaacaaaaaatatatacacctactatgtaccccaaaaattaaacactaaaaattaaaaataactaggtatttgtagtaaatctaggtgctcttcagtttgaacagggcctcttatctagtctgaatactccaatactgatggttcccttgtgctggaaggcatattaggtgctcaatgaatactcttgattctttgttacaattgggtaactcctttgtttacattctcctgctctgttcttgcaaatgtgtgtttcaagggggtgtgaccaaatgctctgtgtagctcaggcacttcctgggtgagtgtagcagttggcagctgtagcccttggctcagattgaagagaggtttttttttgcagctttggacttaggcctgtgctggtaaggtttgtgaacctgggccctcggggagctggtgagggtgggactggtgactgtgtggtgtccccaaggctggcgtgtgcaggagtgaccgtgtctgtgcttcaccctttcttgcagtcctacttgattgtcagtgacaaggcccgagatgcagctgctgtccttgtgtccaggtaagtttccatggcacatttcttggtgtgtggctggtgggttctgagaggggtttgtttgggtacgtgtttcatgtgcgtcttcagtcctcagacgaaggaccccgggaagtctttggactctgtggctttctctgagggagtgtgcagcagtgtttgggcacagaagacctctgaccctgaaatgaccaccctcagtggtggtttggggtgctggtgggggtcacctgacaggcccatcgacaggagtgcaggtctggaagaggcgtggctgtcatccctggggtgcagcccctgcacagggatggggtggcagttatgagaaacatctcgggccgtctcccatggagatgatgggtggtgttgggcctctgtgactggggatgaaaatcccccaacgtcctgtattaactgcaccccccgtgtgccccagacaggggaaggtggttttctctgctgagcgcagcaggcctgcggtgttggaaagataccaaggatgtgtgtatagactgagcgaacctgtttcatgagatgcaagaaggaagaaagcaatatttctaatcagtattttacatgacatgtgattttaagtatgtatgtagtttactaagtcagaacagttgacattttccccctctgcaatagtgaaagtcgaaagctggtcctaaaacctttcggtggttgtggttgggaatacggtcagtgcctcatgcagcgtcaccttcactcgggtgtgtagctgcaacttgcacagcttctttcccagagaagtgggaggagagaagcttcctttgtggggcagttggaggcattggatgaggggtttgtgacagcctggagctgaggaaggaacgcctgagtcccctggagcaggtgaggcccctcccgagagggcagaggctgcttcctgtcttgtcaaggacataaaaagatgatcgtctaattattaaagtaatctgtatatatttagataatagagcatgaagtacaaaataaaacctttgaatgctttcatcccatgggggtgtgatggcccctgtctccctaccgggtggcgccaactctgtccatggtctccccgcggggcggcaccaactctgtccatggctcagttgctgcactcaattctttgcaccacggaccaggagatgggcctggtgcgccattgtcttcttccaaaacgagatgacctggtgcgagagtgtcttttctttttctttcttttttttttttaattgagatggagtctcactttgtctcccaggctggagtgcagtggcacgatctcggctcactgcaagctctgcctcccggtttcacaccattctcctgcctcagcctcccgagtagctgggactacaggtgcccgccaccatgctcagctaatttttttttgtattttcagtagagatggggtttcactgtgttagccaggatggtctccatctcctgacctcatgatccgcccacctcggcctcccaaagtgctgagattacaggtgtgagccaccgcgcctggcccgagtgtgtcttttttttttttttttaatttttttagtatttattgatcattcttgggtgtttctcagagagggggatttggcagggtcataggacaatagtggagggaaggtcgcagataaacatgtgaacaaaggtctctggttttcctaggcagaggaccctgcggccttccgcagtgtttttgtccctgggtacttgagatcagggagtggtgatgactcttaaggagcatgctgccttcaagcatctgtttaacaaagcacatcttgcaccgcccttaatccatttacccctgagtggacacagcacatgtttcagagagcacggagttgggggtaaggttatagattaacagcatcccaaggcagaagaatttttcttagtacagaacaaaatcgagtctcctatgtctacttctttctacacagacacagtaacaaactgatgtctctttcttttccccacatttcccccttttctattcgacaaaaccgccatcgtcatcatggcccgttctcaatgagctgttgggtacacctcccagacggggtggcagccgggcagaggggctcctcacttcccagacttggcggccgggcagaggcaccccccacctcccagacggagcggcggccgggcgggggctgccccccacccgagtgtgtctacctgtcgtttgtggtgggacatttagactgctgccctcccaatttggtattaaaactcaatattgcaaacagtccacgtaaaattgtgtaccgttctgactgatttctagggatgagtttctacaagtggaacgcacgttttcagggtctgaatgcaattactggagaggctgaacaagttggaagttctttccccgtcttttccagttgggtcaaaccttaagaatgtttgccaacttcgttcaatgggaaatagtatctgcttttattcttacttttcttagcagcagtactgagggttgcgtagatttttgccgagcttggctctgtggagtgcggtgcctgtgggccaggaggcaccatctgagtacttctccctccgtggggtcctccgggaaaagagcgcgctggctcgggatcccgggcggactcccggcgagacaccgcagcgccacctagtgccgggatgagcaggtgcttttcggccgagccagtttccgtgcagaacacctgagcctgggatccaggagaggtggtgcctgggggcgtcggtgccgtggagcctttctcccccttggtctcgcacactctcgcacactgattctcaagagtgtttgagaatggcggatgccgtcagtggaagagctcttacaggtgcttggccggttccctcgacacctcccagactcaccgcaggttctgagtttcctgtacttctcagacccctttttggtgaggattgttcaggtaaggccagggctgcgaggggtcctgtgccagcatttgtctgcagtacaggttcgttttctgctctccagggaggagcagcctgctctagcccactttgctctcaggattgaatgcttctccctgtatcactggcggctctacagctgcacccgtctcccttgattaactgagcttgccaacatccacagcgctgtaggtggtgcttggtgttacagtgttgctagaacatgcagattgagtgctgccttagaaacccacaggaaggggaacatcacactctggggactgttgtggggtggggggaggggggagggatagcattgggagatatacctaatgctagatgacgagttagtgggtgcagcacaccagcatggcacatgtatacgtatgtaactaacttgcacaatgtgcacatgtaccctaaaacttaaagtataataataaaaaaattaaaaaaaaacccctttaatagatatgcctttcgccaggcacggtggctcatgcctgtaatcccagcactttgggaggctgaggcgggtggatcacctgaggtcaggagttcaagaccagcctggccaacatggtgaaaccctgtctccactaaaaatacaaaaaaattagctgggcatggtggtgcgtgcctctaattccagatacttgggaagctgaggcaggacaatcgcttgagcccaggaggcagaggttgcagtgagcagagatcgcaccattgcactccagcctgggcaacagagcaagactccatctcaaaaaaaaaagaggtacgctgtatgcagaaaagttggaaatcttggcgtggcgtggtggcacgcacctgtggtcccagctattccgaaggctgggtgggaggattgcttgagcccagaaggttgaggtttcagtgagctgtgattgcgccactgcattccagcctgcacaacagagcaagaccctgtctcaaaaaaaagttgaaaatcttgaaacatagaagttggaaaaagatatataggtaattcttatacacagtgcgtgtaccgtgtttatcttctttgcaccgttatgacttttaatgtgcacagcatgatcttaacaagtcagagtcagcactgtgctttttcacctgatttcatgtaactgctgatgaatggctccgtcgtgttctgctgtgtttcgatactgcactcagctctgtcacttcctgcctcttgtgagcagtcacggacgcctgggtttggttacagacccgttctcgtgtcaggattgtttcgtgaggatgggcccttagagatggacttctgggttccaggacacgagagtggtgttggggtctgcacacctggtggctctcagctgctctctgagcagtgctttggtggccgaggcagccccaggaacaccccacccccaaattggattaaacatggtgtcgctgattgcaggtatttaattggcatcacgctgattgccctcaccttaggtgttacatactccgcttcgtgacctgactctgcgtgtctgtgggctccttggggccttttcttccccacgagtgtgagtttcctccggtgaagggcgatgggtattgccccaggtggttgttggccttttcctttttttttggaccaaagttttaattttaatgtcaaaccgtttttttctcctttatttagttatttttacttttaagcctgcagtcttattaagagatttaacaagtagtcatttatatttttctctaccgtttattaagacagaattattgattcatttggggtttcttttggtctacagtagaaccccgcccttcccagtaggtaaccagttgctttagtgccattttgtgtctgtagggaccagcaccacaaggtcggtgggtttctccctgtgtgtggagatgagagagtgtagaaataaagacacaagacaaagagataaaagacagctgggcccgggggacaactaccaccaagttgcagagaccggtagcggccccgaatgccaggctgcactgatattattggatacaagacaaaggggcagtgtaaggaatgtgagccatctccaacggtaggtaaggtctcgtgggtcacgtgtccactggacggggggcccttccctgcctggcagccgaggcagagagagagagaggagaaggagataaacagcttacattattatttctgcttatcagagacttttcactaatttgctactgctaactaaacggcagagccaggtgtacaggatggaacgtgaaggcagactaggagcgtgaccactgaagcacagcatcacagggagacggttaggcctccggataactgcgggcgagcctgactgatgtcaggccctccacaggaggtggaggagtagagtcttctctaaactcccccggggaaagggagactctctttcccggtccgctaagtagcgggtgtttttccttgacactaacgctaccgctagaccacggtccgcttgtcaacaggcgtcttcccagacgctggcgttaccgctagaccaaggagccctctggtggccctgtctgggcataacagaaggctcgcactcttgtcttctggtcacacctcactatgtcccctcagctcctatctctgtatggcctggcttttcctaggttatgattatagagcgaggattattataatattggaataaagaataattgctaccaactaatgattaatgatatatataatcatatctaagatctgtatctggtataactattcttgttttatattttattatattggaacagctcgtgtccttggtctcttgcctcggcacctgggtggcttgccgcccacagtattccgcttttccattcatttctaatgctctgtgggaactctgtgcgttttaaagggaacacggtttgtcaccaccttaatgctgcttccttctgcgatgaagttaactgccctgggccccttttgcagatccgctaaagttaactctcctggggaggacacatgagtttcttttttctttccttttcttttcgagacagggtctcactctgttgcccaggcgcgagtgcagtggcgtgatcacagtttactgcaacctccatctcctaggctcaagcaatcctcccaccttagcctccccagtagctgggactgcaggcgcatgccacgacacccagccaatttctttttctttttttttttttgagacggagctttgctcttgttgcccaggctggagtgcagtggcgtgattttggctctactggagtgcaatggcgtgatctcagctccactgaacctctgcctccctggttcaagtgattatcctgcctcagcctcctgagtagctaggattacaggtgtgcgccagcacccctggctaatttttgtatttttagtagagacggggtttcaccatagtggccagggtggtctcaaactcctgacctcaggtgatccacccgtcttgacctcccaaagtgttgggattacaggcatgagccactgcgcccggccatgcctggctaatttttgtattattttctagagatggggtttatttatttatttatttatttatttatttttacggggtcttgctctgttgctaggctggagtgcaatggtgagatctcggctcactgcaacctccgcctcctgagttcaagtgattctcatgcctcagcctcccgagtagctgggattacaggaatgcgccaccatgcccagctaattttttaatatttttagtagagatggggtgcaagacaggctgttctcgaacttctgacgtcgtgattcacctgccttggcctcccaaagtgctgggattacgggcttgagccactgcgcctggccaagatgggggtcttaccatgtttaccaggctggtcttgaactcctgaactcaagctattcacccacctccgcctcccaaattgctgggattacaggggtgagccactgtgcccagccaaatgattctttactttctggaaatagggacttctttccccattgttcatgctgagcccctccctaagcatgctccacagggacagtggcggaggggagaggtccttgctgttacgagcagttggcaggtgccagccgtcctgtcagctgggcagcgcttctgttttgtgagggccatgaccgagtaggatggcacgtgcgtggctgtctcctgtgtgttaagtgccctgagagggcttgtccccacggaagcatggagccggctctcgcgcaggccaactagatggatgtgctggaacaagggccgggaaggtgggatggccggagttgaagttgcagtggagatgacgtgggggccggagggaggttgggcgtcatagcctggcagctccagcttccacgtctcaccttgcctggggtctccacgtagctgtctcgtgggcgtcgcgtggggcactcccccacgtggactcttccgcctcctggccctcccaagtgtcccttccgggaggtggccttgtggctgttgagggagcgcctggtgcctccctcctggcatcactgccgtctccttccccccaccccataaaggtgtggctaggatgccagtcagacctgccggcatggcctaaagaggaggtgggcaggcttggccagtactggtcctgtccccagcacctctcccactcggctgctctgcttcgaccatgttgcctttgcagttcgcgagttcccttggctcccttctgccctgggccctggctctcctgcttccctgggcagcagcactttcctcccaggttttgcagcccccctcgttgagctccgtggcttccgtcctctctctaacgaggccatgccctcccgtttccttcgtaacttttctttgcactgtggaagtccccagctgtttgtcgtttctctccagagtgtcagctgtgggagggaagggccttgtctgttctccgtgtggcagtgccagtctcgatcatggaggcaagctgggggcctggcctatgaactcctggtggagaaatcaggaggatctgggctaattagctgggcatggtggcgtgcgcttgtagtcccagctactcgagaggctgaggcaggagaattgcttgaacctgggaggcagaggttgcagtgagtcaagatcacaccactgcattccagcctgggtgacagcacaagactccatctcaaaaaaaaggaagacttgggctttttttttttttttttgagacagagtcttgttctgtctctcaggctggagtgcagtggcacaatcttggctcactgcaacctccgcctcccgggttcacgcgattctctggccttagcctcctgagtagctgggattacaggcgcacagcaccacacccggctaattttttgtgtatttttaatagcgacagggtttcactatgttggccagactggtctcgaactcctgacctcgtgatccgccctcctcgtcctccaaagtgctgggattacaggcatgagccactgcgcccggccagatttgggcttttggtttgggagctctgtgtgctcaaggtgtcctgcgctgaggccgggctgcaagaggggtggggagtgtgagcactgcctggaacacgaggccgagtccaacagggaagactttcatggggctacacgagcagctggctgtggaaacaggcctgtgcacaagacgcatggcaggtgtgggggagggaggtcccaggggctggggcccagctgccggggccaggccttgcacgtgggcacggtgtcctgaggtcaagggatgcagagttgggtccagggaggagggaggggctgagaagtgggcaggggctccctggcggtgatggggacaggtaaaactgggggggtggagggggcaggcggggggggatgggcagtaggcctgcgacctgagaggttgtggtggggaaccggctgctgagggccctggtcagggcagcgacttggtttctagggttggagagaggaggaactagctggaggaggacaggactcagtacagagctggcatcttggtgtaagggtgcgtgaggtgggagggcctggggaggtgggtgtgtgtggggtgggctggtgaggcgtgggcgaggtctcagtgctgaggccttggttgagctgtatccttttggcagatttatcacacgtcctgatgtcaagcaaagcaagatggctgagttcctggactggagcctgtgcaatctggcccgttcctccttccagaccatgcagggggtcatcaccatggatgggacgctgcaggccctggtaagtgctgcccgcaggggctgtggagatcgcagggaaatggcgccttacatggggaccacggaatgatgttacctgtgattccatcttgacgtaattggaaccccgtgggattgatttaaccgggccagggtcttgggcagtttccttttccctctgctttgggtcctgcctcaggcagggctggtttctgcgctggtgctggtggatgggcttggagccccacctgttgccagcagagggcagtggtgccacgcagccggggctccccagggtaggtttctctgcatctgggctgcttagttcctgtttaagtgcagagactgaacgagctctaataaaacaaggtgggtgagttgaaatttgattctgttcctttgcactgggctcgggttggatgttcctgactgcttcgttgggacacagaccctggcctctgcctgcaggtgcctggttagtgccctggctgcagccctttgccagccctttccctgccctttcgctctgattgtctcttgtgttaccttttcttgtgctaacgaggaggaaaggtcaagtctcagaagagggcaaagcctcttttgggtcagcgtcctggaggctgcagctccctggtcagccttctggagggggagccggcagccggctgtggcctttggcgtggtgggttcagcgccttcttctctctttaattacagcgggtgaggctttgagagcacttctcatccttgtctcacgctgtggagcctgtggtccctctgaggagcggggcactttgttcttgtttaaaaaatatattttatagagacagggtcttgctatgtaggtcagggtggtcttaaactcctggcctcaagtgatcctcctgcctttgtgatgatcccaaagtgctgggattacaggcttgagccgccgcgcctggaaggacactttggagcgcgttttaggggagatgatgagtgccacctcgccacggcgtcctcctgtccgtggcgtcgtcctcctgtccgcagcatcgtcttcctatccgcggcattgtcttcctatccgcggcgttgtcttcctgtctgtggcgtcgtcctgtctgcggtggcgtcgtcctgtctgcggtggcgtcctcctgtccgcagaggcgtcctcatgtcctcagtgttgtcttcctgtccatggcgttgtcttcctgtctgcggtgtcgtcttcctgtccatggcggcctcctgtccgcggtgccctcctgtccatggtggcctcctgtccgctgtgccctcctgtccgcggcgtcgtcttcctgtctgtggtatcatcttcctgcccgcggttttgtcctggccgtggcaggttctgccagggagcgggaggctgtcagctgggtggaggggggctgtgggagtgatagcctggggtgggggcatacgtttcttgagggggaattgggaagtgtcctcctcaatgtctgctgcttcccggtcatgctgccgtggtcttcaggagggcagcctttgaaatgaggaaaaggtttcagacgtgtgagagaaaactgcagacgtgtttcctggagcctgtgctctgcccaggtgatgtctgttttcttcaggcgtcccctcaacctccacataaatgtgacagattcagcagttttcaaaaatcaagatataattcacataccacaagtaatttatccttctaaggtaaacaattctgtagttttctgtgcggtcatcaccattatctaacttcaggacactgtcatcatcgtgagagaaaccttgattgcaccgagcagtccgtccctcaccttccccagcccctgcagccgtggatccatgtgctgtccctgtggacttgctggttgcggacatctcacctcaccagagtcgtacacgacacagccttttgcgtctggccttcactgagcccgatgtgtccaaggttcatctgcgctgtggtgttgtcagtgcctcgttccctttatggccgaatcataagccaacgtgtgggtattttccatatgccagcgtgtgggtattttccatatgccagtgtgtgggtattttctgctcttacaaattacgctgtgaagaactttcatgtgcaagtttttgtttaaacttaatgctttcaggccgggcgcggtggctcatgcctataatcccagcactttgggaggccgaggcaggcagattacttgaggtcgggagttcgagaccagcctggtcaacgtggtgaaaccccatctctactaaaaatgcaaaaaatagccaggcatagtggcgtgggcctgtaatcccagctactccggaggctgaggcaggagaattgcttgaacctgggaggcggaggttgagtgagccgagatcatgccactgcaccccagcctaggtgacagagcaagactctgccagaaaaaaaaaacagaaaaaacaaacccaacttaatactttcagtacccttgggtacacaacactagtttttaataaaattttaaacaaaatttggaatgttttcatctttctggagtctttctaaaaagatttttctggtggcatacctgtcgtactgatgaaatagaggacctcctcatgccaggcatttttgggcattgcaggtacagatgtgctgtctgtgtccccaggtgcccctcgttccggccgtgctggggcagcatcctcaatgcctaaagaggattcattgctatcgtggaggtcagggcaggctgaggctggccttgaagggtacgggggtggaggggtagggcagggaggactcaggtctcggacgtacccactgtgccattggtccatggatcctcagggaatgtgcgttttatgttttaggcaattctggtaaaggtggtggatttagttgcaattggattcttcattttttgccttgggtctcactgaggaaacatgaagaaggggtagatggcagtggccagggtgggggtcctgggaattctggtagcttcaccttaatgtttgtgatgctgggtgtacagacagcctcccacatgaccaaggacacgctcttaggtccctaagaccccagaagaatgggccgctactgccaagaagtatgacatgcgtgtggaagaccatgagccttacccggctggtggcatggggtgtggcaactgccgcagctccccgaaccattgcagtgggaaaggggtacgtgctgtgactaagaccactggacccgacccatcgcagcgacagggggtccatgctgtgtgactgagaccactggaccccacccatcgcagcgggaggggggtccatgctgtgtgactgggaccactggatcccacccatcgcagcgacagggggtccatgctgtgtgactgagaccactggaccccacccatcgcagcgggaggggggtccatgctgtgtgactgggaccactggaccccacccatcgcagcgggaggggggtccatgctgtgtgactgggaccactggatcccacccatcgcagcgacagggggtccatgctgtgtgactgagaccactggatcccacccatcgcagcgggaggggggtccatgctgtgtgactgggaccactggacccgacccatcgcagcgggaggggggtccatgctgtgtgactgggaccactggatcccacccatcgcagcgggaggggggtccatgctgtgtgactgggaccactggacccgacccatcgcagcgggaggggggtccatgctgtgtgactgggaccactggacccgacccatcgcagcgggaggggggtccatgctgtgtgactgggaccactggatcccacccatcgcagcgggaggggcgtccatgctgtgtgactgggaccactggacccgacccatcgcagcgggaggggggtccatgctgtgtgactgggaccactggacccgacccatcgcagcgggaggggggtccatgctgtgtgactgggaccactggatcccacccatcgcagcgggaggggggtccatgatgtgtgactgggaccactggatcccgtccatcgcagcgggaggggggtccatgctgtgtgactgggaccactggatcccgcccatcgcagcgggaggggggtccatgctgtgtgactgggaccactggacccgacccatcgcagcgggaggggggtccatgctgtgtgactgggaccactggacccgacccatcgcagtgggagggggtccatgctgtgactgggaccacctggcctgaggttggactggtgaaatgacaatgttggcacctacatgtgtgtcaggatccatgtggatatgtcccgcacacctgcttcttggaatattgtgtaagcagctcttcagcttcacggccttcatgatcgtgttctgggtggggaagaattaaccagcctaccagcccgtggggccaaagcagtgtccttataatcatctgcacctggaaccaggtggcgatcccaccgtagaacctgtggctcacaggatctgaggtggcttcgagggcttctctgccctctaggattccctcatccttagaaatttaaccttaatgaaatccctaataaaactcagtgctgtgggggaaaaacatctcaggtcaggggagcaaatgggaggtctaacaggatgtgaccagagctggttgtctccaatggctctgccccgagtgtggtgcctctgcaggggaggccgttagccctgccccgagtgtgggtgctgctttgggaggggaggcaaatttgatctctgtccggtctcttaacgggcttctaggggtctcctgcagctctcgtcagcctggcctgggagcctcccctcctctgccgtccccaccccatgctgttgggtcagcaggatatcccagccttggggctggagccagctgtggctgcccagggacttgcaggcaggtgaggcgtgccaccttctggccaggctggctgtgggagaggcagcctcctggtgaggggctgtgggccactgcgttcaggctgccttggagggctccacggtgtcccctgggtgcagggctccgagtccttctcggcttgggagggtcttgtggccacatgtgtctagttctgcagtttctttgttgtgggttcggttctttactttttttttttttttttttgatgatcttgttggttttctctagattgttcccaagttttctgttcttccatcccaagtgggagacacgtgttgcacagcctgcatttggaatacccagagggtgggtgggcgggacggctcgctgccccattcccctcctagctgctgggacaggtgggaattcctgtagcaaagtcaaaccagccaggagtggggaagtgctttttattttgacatctccaagttccacgttgaggtggagagacattcgtttttccccttcctcccgaggtgtaaaacggtcttctcaaaggcttaggagagccgagccctgtgccaccccccggcatatgctggcaaagagtgaggcgtgctgtcctgccgtttagggcagagcacccaggcggtttggcagcagcacctcagaactattcagagatttgccctcagcaagagtgagcaattgtctgacgcagccggctgaaatccctgggaagggaatgaatgaaactgccgtgaagcaacgcctggcggggccgggcttctggcagctcctggggccagcacgtcccttccagagcgtctgaagccctgggcggctgctggagcatctcgagtctttccagagtcatgtgtgttgtttccttctgtctcttggaagggtccgtttggtctgatccaggttgcctcagcaggaggaagtcgtgctgggtgctgagcgggtgggaggtttcaccttgggcttggcagagctgcaggcagaggccgggcgcctgctgtacatgatgaaacttgcaggtggattctgcttagggtttcatctgtttcctttgatgcacttggcttcattgtcatccacctgttcattactgtgggcgaaacaggtgaactctcaacaagtaccatcgaaaccaggatttgatcttcatttccctcgaagcgtagttcccttgcagtgagggtttttaactcctgtgggagggaagcaagtgtttggcaatgtaatttccctggaaggcccctgtacttcagctttaaaaacacgctttggtttagtcccaatttaagcattaagattaatgcaaattgaggaaattcaaggaaggagaaaaacacattaaaaatggaaaatgggctgggcacagtggctcatgccggtaatcccagcgctttgggaggccgaggcaggtggatcacttgaggccaggagtttgataccagcctggccaacatggtgaaaccctgtctctactaaaaatacaaaaaattagttgggcatggtggtgcgcgcctgtaatcccagctacttgggaggctgaggcaggaaaatcgcttgaacccgggaggtggaggttgcagtgagccgacatggcgccactgcattccagcctgggcaacagagcaagactccatctaaaaaaaaatttacaaaaaggaaaatggctgtcatttcatgtgtgactctgcttgctgattgatagttgtgctctcttggtttctagtgctctgattggaagattgtcgactgtgtggagtgggtttctccctgtgtgttctcacaatggctgggaggcggcggcggggctgggggactcggactgcgagacggggctgttgactatgaaagtggtaataggatgctcttccccttatcggctgttaggctcgagtctcccctttgcagtgcggtttctttttatttttatcattgacaaaagcacaactcttgttaaaggataaaatagtcacacacaacagcattaaaaaccaagaaagccaaagaacgctggcactgtcagcctcactcccagctcccgctcggcccttgtgaagagaggtgctgaagccactctgcttttttatagttaataaaagcagccaggtccccaagtaggagtggttgtggccaagagtgtgtgggccgggaaccagggcttgagctgctgtgagctgtgcccaggccctttgctgactccgtctctcctgtgacctgaggccagggtgagcaccagcgcccgccccacctgggagggaagcagcagacctctcaccgcagaggctggtgtgaggctaattagcacagtcagtctttgaagatgaaagaagacagctgattatctaaaacatttcacatttaggctttgatttctcttcagatttggggaacagcaccctactgtttcatttagggttcagtgtggccagaggaagatgacccacgtggtcctttttagttgtagtgctctcttggggcaaggttttggatggagaaaataggacaagagcagtttgaatgtgggtactttccagagatcatgctcctgtagcatttgggtgaaacgaggtaccccaggccacgctggttcggtctcctcgtggcgttaaggaaagacctggagcagccagctcctaacactcatttcccatcactcagcattttatgtggggcgggcacagtgccgtgagtcttacagaaacctgcatggtgagccgcacgcctttgagtccccatcagccctggcccatccctgctgaggtggcgcgacctgctcacagacgtgtgctcacaggcagcccgtcgcggggtcatgtgctagacggggagggggcttggcgggtcaccagcctcaccccgctcagttcttagatgaggaagagacaggcagagagctgggctgggctgctgctgagtgggctagagctgggtctcagtggcccctgccccagtcgtcctgacctgtggcccctgtgcaggttggggtgcccctgccctctcccctgccccgccctcacctggctcacagacccgtgatgcctcactgcccacgcagtcaccttagaggcaccttccctctaaggcagatgtccctcaggctttggtcctggctgttgatatctcagctctgattcacccttgacctttattacctgatttctgtccttggttctcgagccctccttctgtggacccgttgggtacacgtgtgacacttcagaacccgcaagtcccaggtcacacctgttgtaccatcactttcccctcctggcctgtttacccgggagcccagcaacaaatgggagcttctgtgctgctgtccgtgcatacggcccaggagccgggctcatccccgagacgccgtgttccctcccgctgtccgctcacacctgcctgtgtggacgtggctctgacatgtctccttcctggttcattgctcatctgttctcatgtggctgcgccgccaccctgtcctgggggtccttgtcccagcacgtggctctgtgcttcacgtcatcctgagtctgtcccgctctgccgcctggtccaggtgggagccatttccttctgtgaagtgttccctctggaggccctgggctccccgactaccctcccgcctctcctgtggctgtcggctgcagtaaaggtgctggtggagggtgtgagccatccattcatagagtgccagactctgtcccatgctgcctctgtgcccttgatcctggcagcacacctgctgtcctgtggcctgcgtaaagggtggcctcggaagcctgtggcctgggtaaagcgtggcctcggaagcttgtggcctgggtagtgggtggcctcatcttggcctcggaagcaggagggctcaggctgtggcccacgcctggggttccccatccccccgtgtgtcctggtgtctttgcttggctcgccggcctccatgggctccccaggtggcaggtggctctcagccatgctctccgtcctcatgcttgtttctgccctggcagagctgctcagtggccagcccgtgggacccctgtgcaccctgccgcccccagcatatgtcagcagcgccgtccgggggagatgtggcatcagcacagccttgtccttgtctctgcccgttcttccttccttgcctctatgtgtctgcttttttctcttccacatggtgtccacagtggataaccacatccactggcctcctggttggtggatcctcctcctgctgggctcagagctgtgccacccccacctgcactgcagagaagctcagacccctctctgacctcagacgctggagcctgagccccctgcttcccaggccaatgccccttcaggtccctgcaaagccactgctctttgtggtctccctgccgccgttgccctccctttgccgctgagcccgtgggctgcttggtggcttgggagctgcatacaattctattttgtctggtttgttttcaggctttctgtggcaggaattgtgtctcttgcatctttttttttttttttttttagacggagtctcgctctgttgccctggctggagtgcagtggcgcgatctcggctcactgcaagctccgcctcccgggttcacgccattctcctggctcagcctcctgagtagctgggactacaggcaccctccaccacgcctggctaatttttttgtattttagtagagatggggtttcaccgtgttagccaggatggtctcgatctcctgacctcgtgatctgcctgcctcggcctcccaaagtgctgggattacaggcgtgaaccactgtgcccggccatggatcattaacctcttttctagcatcttacctctgtggtggttcacttttgcgagcttttgctgggccttggaaggtgcgtgggctcgctgctcctctcttctgtgggaactgttgcctttgggcagggggcacaccccagaggtggtcacacacacctgaacgggagcacagtcataagtccctgtcatgcaaagatgggctgtgcagaatgagctcggaatagcagccagaaggctcagtgatgggggagttgtttaagctggaatactgtaatgctgctggctgtttatggctgtgaggtcactacgtgggctgctgagaacattttaaaatgctgagtgagtcatgaaacagtcatgcgtcccctaacaatgagggtagtcctgagaactgcgtcgttgggcagtgtcgtcgtgtgaacaccgtagcgtgcacttaaacatagatggtgtggcctgctgctcccaggccaggtggtgcggcctgctgcactcccaggccaggtggtgtggcccgctgctcccaggctgcaaacctgtacagcacctgactgtgctgaatactgcagggaactgtaacacagtggtgtttgcacatctaagcatagaaaaggtacagtaaaaatatatcatcagctgggcacggtggatcacgcctgtaatcccagcactttgggaggccgaggcgggtggatcacgaggtcaagagatcgagaccatcctggctaaaatggtgaaaccccatctctactaaaaatacaaaaattagccgggcgtggtggcgggcgcctgtagtcccagcgactcgggaagccgaggcaggagaatcgctcgaacccaggaggcagaggttgcagtgagccgagattgtgtcactgcattccagcctgggtgacagagcgagactccgtctccaaaaaaaaaaaaaaaattatatgtatatacacacgtgtatacatgtgtgcacacacacacacacatatatgtgtatatatatgtatatataaaatccttttatgggctcactatcaatatgtggttcctcattgaccagaatgttctatgatgtaggactctagtgcgatacactgtcatgaacagattgataaattaggtgaaggatgatgcctgtgaatgacagacgtaggaagccacaatcattttgtgttttccacactctctttgagagctgtgttgccttggtttatggatgaggacatggacccaggtcaggggctgccaggtcggtgctggggtgtggagctgggccttgcatggcccccacctgtgaaggtaattagtgtttaccttacagtccaaagtttggtgaaaaataacacttcgttctggaaagataaaagctagatgtgattatttcgatcattgaagcatttttgtgtgaaattacctttttttttggcgtcagtggcatgatctcagctcactgcaacctccacctcccgggctgaagtcatcctcccccctcagcctcctgagtagctgggattacaggtggacgccaccacacctggctaatttttgtacttttagtagagatgaggtcttgccatgttgtccgggctggtctgggactcttaggctcaagtaaccctcctgccttggcctcccaaagcgctcggattctaggtgtgagccactacacccagcctgaaattagttttcattttgatatttgttttcttaaaattctttataatttgtcagaaatttattttgtcagaaacagtatattttttcactctggggctctgattctaatcagtcatttaccaatccagcaatgaaagttttcacttccgtcaatggcttttttcctctgaatgtgtggtggtcctgaggggagtgcattttgctcgctcctgggggaggcagtggtctggcctgtccccaccagtgccccctaggccccgccttgaggacaagctctcttctgtttctgagcgctctcccgtcctgtctagggcaactgctgctctttctaggggtggtagtggggctctttaagatgtccctcgctttgatttttgcaggccagcaaatgcactggacgttgtggtttttctggcctccagtagtggtgtggtgggaaggttcttttcctgccctgctgctgaggggagcctcgagcgtaccagagttcctcagtgaagcctttgcacgtcctgcagggtgcagcccagcatgggtttcactgccctccaggaaaggcctggccctggtgggctcgctgcagcacaggcacggacctggggctgtgctctcaaggcattccagcctggaaagggttgttttggtgttaaagatcctcttccgtgcctgtcctgtggcccctctgtgtggcatgcccaagagtggctttgaacatggctgccctccgtgtgctgagcctgcgggggcacggctaccctccgtgtgctgagcctgcgggggcacggatgcgattggttgcttcccaagataccatttcttggtgtcggagcaggactcgggatggcagaaaggggaacagactcgctctcctcatctgcagagtcggcatggttatgtggggccacagggtgacccgctggcctggagctagcgtggtctcagccatctgcctcagtgccggccggcactcacagcttctcagaagcctgtgttaccagccagagccaagcctgaactggtgtggtgtgggggcccttctcccagggcctcgggtggagttgcttttcttggcctagatttggcagtgcctgaagggagcctcaaaccagcatctcctgcttggcagcgggtgagcttgctcccgagtagctcgacagcctgtgatttactgggcttggagaacatgccccaggggggggaagctggctcgcacgttgcagagaagccagcttgggtgggtagccatcgaaaggtggggcgggttaggatgattgctgagaaactccttttgtttgcagcttgtgctgtgctggtttctagaacaacaaaaacagacctgcagtcattcctcatttaccatgcagggctgttttcctctaatccctggtgtcatcacctctgtctagtgtatgcttttcagcaggtggttttaatttggttcccattatgcttccatgaaagtgggctgtgccccccattttatggcctagcttatgagcactcaagaccattgatgactagagtgcgctctctctggccgcgtcctcctgctgacaggtaccccatcccaccgccacgctgagcactggccactgcacactgcacactttctctggtgaagatggccttacttttcagtgaaataaatggaaacaaagccctgtcttcattgactcgttccttccctgtcgtctcttttgccctcctgcacccatgcctgggaaagtggataacttttggggcttttctctgtgtgtgctgaatgcccaggaggctgcctgtgtaattcagctggaaactgtccccagggtagagagaagtgtgaggagaaaaagacccttcgccctgtaaatgtgtggggttctggtttctcccttactgcagatggtggcgggccctggccttggtgctgtctcctgtgtgtagctggggacggtggaagctgggctgggcctttccaggtgtggggcatccaggccagttacaagagatgatgcttgctttcccgagaactcatcaccacttgtatcttagtctgctgtagagaatgttgtactacacttcataggaattgagtaactaaacaacgttcatgtgtgagggcactctaggaatttcacagtgtcttggattctttttatttagtgagagaaaccagacgacgtgttagcccgttgccaagtaagactgggggacacgtcagcctgttgccgagagagaccaggggacatgttagcccgttgctgagagagaccgggggacacgatagcctgttgctgagagagaccggggaacacggtagcctgttgctgagagaggtcatttcccggatctttgtcctgcgtccgcccacagctgcacagctgctcttctggtttaggttctggcctttcccactggggttttccagcagcctctgtagcggtcttcgttgttgagcacttcactgttcatccccaggttctccatccagctgctgttggaatctggtcatgtggccatggctgcaggtgatacggtggtgctctttgcctgtaggatgagatttcagccgctcgcaggttcatttgttgtggaacaacgtactccacagctggtggcatcagtgacagccgcactcttgcgtggatcgattctgtggcctcgcagggtggggtgcagggggccgtttgttactgccctttgatgcctgggcctctgccgagaagaccacgtggcaggtgccttgaagggctgggtgcggcaggggcccttgactgaagctggctcttcctgcatggcagccggcttcccggagggagtgtctcaaggggaggtgtctggagaggccctgaaagaggccgccaggcttctgacctgggattgggggtcactggcatcactcctgcctgcctctgttggttgtggcagttggaagcctaccaaggtggtgggtgagggacccttgattgtccgtctggcaaactctgttccccactgagctggccagccggctgcagtgacagcttctctgtgaagtgtcttgtcttcttatcccccaggcgcggtccggcttctcgttgcacactggtgggcttcaggccgtcagcccacctcccagggaatttgagtgtgtgcttggccctgcgactgcccccgaaccccgcgtcccgttgcggggagctcgcctgtgccccacggtttctgctcagcaagtgttggctctgtaaaccgatgacttagggttaaaacacatattaaattagatacatctggactggtgtgaaataatttaactttcgattttatatttcacacaaactaaagatggggaagagttcttaaagttaaatgagaacttgttttgggcaaacaaggatcatctccattcacttggtagggaacgtgttactatccatttcgctaaagagaaaggggctaagtctctgatcaccttggtgaatgtgttattctgagtggctcagggaggtgggtgctgccactgccccattttacagacagaggaacaggagcgcagagaccctgctctgctccacaggcgtgactggtggtctgtctggctgtctccttcctgttttgatcgtaggtgtgggatctgcaccacaggtgtgactggtggtctgtgtgcctttgctgcttctccactcagcgcttaggagagccccccagcgggctccatggagagagtctaagttccctctccttttaagaagatgtttctattctacacttaagtaagagatcaggcagtttacagggttcataatgcaaataaaagacaccagtatttagtgaaagcctcttcaccttgtctgagcatctcctgatgggcggcacctgcttcttcatttttccgtgtggtgggcgacagcaggacaggggtggcgtggtgtgcggtgcagatagtctgagacagatgcagttctcaccttgactgtgaaattctgttttctgaaggaaaggaaattcattcgcgttttcttagaagggctcagttctaggattcttcgattatgaggcttggatatttatgtgaatcatcgcatttgtcctccagactttaaagcagaaggtaaaacctcaggttgagaattcaggagggctagaaccagtgtttgagagaaaatctgatattcctgtttggtctgatggactccaggtgatgacgtccgtgtgtgcgcatcgtggggaccgggctgccaggtgtgtgtgtgagacacgggctgagctggtcacccttctcatttgttggtgaagcatgaatgcagatggaggcctttgtgtgaggtggtttggcctgtaacttttatcctttgtaactttatttatacgcagataatttttaaaaacctactgagatatcttctttttccaggctagtagtgccctgaacttaaacctgggcacgttttgtgatgccattgatgagggaggggtggagaggctgcagtctccatgaggggactggacttatcattgcatccctattttcagatgaatttttgggagatgatttcactagtctcttataattactttatcatgtacagaaactgttttctttattattaggtggtgagtgtttagaataaaaattctgaaagatgtgatgaattgttttcacaatttgtgtgtatgttttaaacttctatttgtatttgtaacattaaaaatctttttttttttttttaggcacaaatatttaaacatggaaaacgtgaagactgtttgccctatggtaaggtttatttttaagagacgatatctttgtgatgtgagtttgctcatatacaatcaagtgtctttccttaacattttattcatagatataggaactgtacattggtatgtttggacactatcgttcttttttttgttgtgggttttagtaactgaacttttttttttttttttttttttttttttttttgagactgagtctccctctgttgcccaggctggattgcagtggcacaatcttggctcactgcagcctccgcgtcctgggttcaagcaattcttctgcctcagcctcccgagtagctgggactacaggtgcctgccaccatgcccagctaatttttgtatttttttttttttgagatggattttctctctgtcgcccaggctggagtgcagtggcactatctcagctcactgcaaactccgcctcctggattcacgccattctcctgcatcaacctcccgagtagctgggactacaggtgcctgccacaatgcccagctaattttttgtatttttagtagagatggggtttcaccgtgttagccaggatggtctcgatctcctgaccttgagatccacctgcctcggcttcccaaagtgctgggattacaggtgtgagccaccgtgcccggcctaatttttgtatttttaatagagatggggtttcaccatgttggccaggctagtcttgaactgctgacctagtgatctgcctgcctcggcctcccaaagtgctgggattacaggcgtaataactggactttttgtcactttcctagtcctttgataaagagggattgctgccaggggtctcgtgagggaggtctgggcaaagcccgtgtcatgatctgaggttggacctggcttcttggggcccaggagcagccatgttcctctgatagccacagccaccacctcttttgccttcttcctaattctcttaatttattctttttgagactgcatcttactgtgtcgcccaggctggaatacatgacacagctcactgcagcttcgacctcctgggctcaagccatcctcccacctcagccccctgagtggctgggactacaggcgagctctaccacgcccggctaatttttttagcagtggggtcttgctgtgctgtccaggctggtcttgaactcctgggctcaagtgatctgccctgccttggcctcccaaagtgctgggcttaaaggtatgagccaccacgcctggctcaattctcttaattttagattgagcctcaatttctgaaaataagggcagtgtttttctccacgcagaggtttaccatctggaaaaagagaaacttcttagagcctttgtgtgttttagaagctatccggactgggcgttgtggctcacgcctgtaatcccagcgctttgggaggctgaggcgggtggatcacgaggtcaggagatcgagaccagcctggccaacatagtgaaaccccatctctactaaaaatacaaaaattagctgggcatggtggcacatgcctgtaatcccagctactcgggaggcggaggcaggagaatcccttgagccagggagttggaggttgcagtgagctgagatcgcgccacagcactctagcctggcgacagagcaagactctgtctcaaaaaaaaaaaaaaaaaaaaaagaaactatccgaatatcaaatttgaataactttctttttttgaaagtttttcattatggaaaatttgaaacatgtataaagaagagagaatggcgtgcacgccccgtgtctctctcaggagtgtgcgagttttcgtgtgcagcctgtttcatccctgcaccgcacaggagggacacacagtgccatctcacctgtgtgtacttccatacatgtctctggaaggtggggctctttatgtcctcaccacacccgagaacgcgagcagccgttgccaggccctgtcggcgggaggagcgtccttggtgacgtgaacacagacctccctcttgggctgtcgtgcttgtcacccacgctcattgtgcccactgtcagagccttctgagaagttactcagatgctctttcagctgacctggttttataggcaagcattatgagttaaacggcacctctgcccgaggtcacggcacccacataaaactggtgaacgttcactttctgtcatttcccagcctcaaggcagagcttcctgcagggcactgcagctccagcccccatccccctgctctgtccccgccccactgccccttcctccatctccttgtcttccatcacctcacctaactctcagctctgtcttcagcttctcttcttttctcctgtcccctgtcagttggttgcagtcttgtccatttcacttccagcccatctctgaagccgccatgcacttccaccccagcccttgtctgtcccgggaatgctgtcctcctggcctcagcttgccctcgtcgcagcacccgggcgtctcctgctcgcaggctctccctgtcgtgctgtgcccagtgctaccttgagcctccccttggctcagcctcctgtcctgctattgtcatcactgcatgacaccgagtgattccccctgaaaaacagagcaagccacaggaaccccgtggcctgtgtgttctccccagccgcagtgtgctccatggcttctggggttgctgcagtgtgccctgtggcctgtgtgttctccccggccacagcatgcccgtggcctgcgtggtctctgtggccgcaggatgcccgtggcctgtggggtctccgtggctgcagtgtgcctgtggtcggttgggcctttgtgtgtgctgccccccttcagattggctccctgccctctgagtacttgctctcctgacctccactgatgttgcttcacagcaaggaagtcgagtaggttcaactccagcagctcttggttcatgatttgggatgatgggggtcttggtgatgtctcctgcctcaaggcccctgtggagccggctgttggtttcggggacacaggtggtgcagtcagaagatgcctgcagcccttcctgcgctgagtccagttcttgtttgcagctgccactgtcctcaggtgcctcgatggctgcagactccctgagagcaaccagaccctgctgcggaagctgggggtgaagcttgtgcagcgactggggctgacattcctgaagccgaaggtggcagcatggaggtaggcaccatgagggcggtgcctggggagggccacggggtggggaggggttgctgtggggggcaggcgccattgatgagggcggggcaggtgctgttggggcaggtgctgtggggaggcagtcgccctgttgcggggtgggggaggcaggcgccatggggtggggaggcaggcgccttggttctggacacagttgggggcactctctggagggcaggccgagccgtaggtgagcgtctggtgtggctggtgctgtggcttttgtgtccagtggtgatggcagagaagatgtgttagtaacaagtgttttctgctttcattcatttctttaatcctagaagtgtttctgattttgagaggaatggttttcttttggttattttctgactgcatctcccagttggaagaactgcagctggcgttggcaggaaggtggcgtgtgcgtcgtgtggctcggagtcagcgtggcaggatggcggcgtgtgtgtcgtgtggctcggagtcagcgtggcaggatggcggcatgtgtgtcgtcgtgtggctcagggtcagcgtggcaggaggctggcgtgtgcgtcgtgtggctcggtcagcgtggcaggagggtggcgtgtgcgtcgtgtggctcagagtcagcgtggcaggagggcggcgtgtgcgttgtgtgggtcggagtcagcgtggcaggagggcggcgtgtgcgttgtgtggctcggagtcagcgtggcaggagggtgacgtgtgcgtgatcgtgtggctcagggtcagcgtggcaggagggcggcgtgtgcatcgtcgtgtggctcggagtcagcgtggcaggagggcggcgtgtgcgtcgtgtggttcggagtcagcgtggcaggagggcgtcgtgtgcgtcgtgtggttcggagtcagcgtggcaggagggcggcgtgtgtgtcgtcgtgtggctcggagtcagcgtggcagcagggtggcatgtgtgtcgtgtggctcggggtcagctcagcctccctggcgtggcagcgtgtgtgcgtcgtgttgctcagaggcggtgcggcctccctggtgtggacgcgctgtgggggaaagctgcatcggatcagtgatgagtctgaatgacaggctccctttcaaagactgttggagaaagtgaaaccgcctttcttgctggcagaaatgatgtcttagcagtctgtagcggccggtgtgaacgggttggttctcaaggagacagacttttctagtgttcttagggtgctgtgtgttagcgaccttcagtttgtttcaagtgctataatacgtgtggtttgggaaggaattacttggttaaggtcagctcacactccgtcctggatgatggcaaattccagagacgcgtgttgtgttgcagtgttgggtgtgcagctcactctgtaggaagttgctcattaggcacagtgttcgtggctagtttctcaaagctgctgtggggaatgttcagtgctgtaccaggcagggttctccagagaagcagagcccataggatgtgtgtgtgtcggcgaggctgtgagctggagaccaggagagctcatggtggttcttggccaaaggcctcagggtggagacccaggaagagctgattggttttagtctgaagacagaacaagtccagttgagagattgccaggcaggagggcttcccccctcctcagggagggccggcgttttgttctgctggggccttccgctggctgaacgaggccccctgcatttggcagggtcctctgcctgactttgtctacagattcacatgctggtccagagcccctgacacaagcactggaagcaggtgtgatgaaatagcggggcgccccacggcgcagtcaggttgccatgtaaagttaagcatcacaagcactgaaatgttggtacagaaaataatccagtatcctagttctctcgataatgatgtgcgtgttgccacatacacttcacgtaattctaacgtggttgggttttagtccccgtcttgtgtttttctcttccgtctttctctacgtttcctgtatttctaacttttttccatttttatctcctcggttggattttcgttgtctctgttagtaccgttctcttcttggttgtcttctgttgatgaggacggacttacgctctgacgggctgttagatttctggttcatcccactcctcctgccagccttggctcgaggctttgttagggtgggtctttctcagctcttttcctccagggattggtctttcctccacagcatggtccttgctttaagtatgtagcctttcagggacttaggtgaaagtcacggctttctctcccgtcctgctgggcccgggtctccggggccctctgagggttgcacagtctccaagttctctgcggcactcggcctcccagccattctctgacaggtgcgtctgagtctcgccttgtgcttccttatcttggagtgcccagggatccaagggaatttttgggcagagttttgggcctctgtctcagcagctctcttctccccaacatcctctcccccacatatgagccctccactcattgagattgctgcttcctgggctgtttccttggtacggtgtagaaagtacccctgcggggaggaggtggaggtggcccacctgcagcttcccctcgctggggattgttgccctgccttggttgccatcacctgctggccaacagtggctttaagtcttccgtccgagtctcaccattgttgaggtcgggagggcatgtgtagaagcagcctgaggtcattgtctttgtggtgccgtctggtctttgtgaggtggctgagctgcgcgcttgcgtgaggagaatggcggctggggtgcaccggtctgtggggcgttaggggagactgggggctggggtgtgccagccatgggccattaggggagactgggggctgaggtgcacctgcccgtgggacgttaggggagactgggggctggggtgtgcctgcctgtggggcgttaggggagagtgggggccggggtgcacctgcctgtggggcgttagcggggagtgggggccggggtgcacctgcctgtagagtttaggggagagtgggggctggggtgcacctgcctgtagagtttaggggagagtgggggctggggtgtgcctgcctgtggggtgttggggaagagtgggggctggggtgtgcctgctcgtggggcattaggcatcttgctgggtgtctgatggtctccgccacggtcctaagatggctgatgatactctcttcataccagttaccctacattacagtgtaccccgaaatttagcagcttaaacagtgcactttttcctcacagttttggtgggtctggaatcttgacgtggctcagctgggtccctggtcagggtctctcctgaggcttcttaaacagtgcactttttcctcacagttttggtgggtctggaatcttgacgtggctcagctgggtccctggttagggtctctcctgaggcttcttgaaggcgccggcctggccactgccgtctcaaggcctgcattgctggggggtgtgcttccatgctcctcatgggttgctgtcgggacccggtgccttgtgggctgttggtggggacctgtttgaagtccttaccatgtgggcccctccgcagggcagtgcacagcatggtagctggcttcattggaggctgagaggcgggtggaaaccacggctgtttggaaggtggcagctctcaccagactctgcgtattctgttccttgggagggaatcattgggcccaggccacaccccgtgtgagaggaacgctaggcggtgggggtcgtgggctgtcttggaaactgcccccctccttgtttcctagacttggaaactgagtcccagagggctagagctaggatgagtcattcgaagcaggttgatggcatcagcaccagtgtgtgagttctggttctgccgccaaagcctaagctgtttgtcctctgggaggctgtctcaggctacagccgcagcagctgccctgaactctcactggacaccttttctgcatgagaccggggaagcagggcccacagccaggcggcccgccctgcactcacccttggcaggagcagctgtgtacgcgggggccttgctcagcgcagggctgggctgcacgccgagcgcagactctgacggctcctcacacagctctctgcgtaggactgcgttcccattttatagagggggaagtgggggcatggagcggctcaggagctgttcagaatcacacagcaagtaggcgtagagcaggcctgaccaggagccaggtcccagggtctgtgccatgggccccttcatggcgtgtccaggggatgacaatgcaggttccccatgtgggtgtgaagagggctacacgttgctgccttttgaggggcattcgggaggcaggatctgtaggaactggtgaccggtgagacgcagcacctggtgatgaaggggcggtgtgtggcctgggcggtggcagtggtggccgttcaggaaggggctgccaggaggcagagggtcccgaaggccgggtgcttccccagggaaggcgctggtcctgtcgtctgtgtacccatcatctgccttctctcctgactttccctaatcaaagctggacactagctgaggatgttctggactcggggcgtgttttgtggcccacaccaggatcttcctggcagtttgtgctgatggcactgcctccaggttctcccttcttatccggtctctgcaaagtgcatggaattttcacaggcacgctttaagattcaaagtgacactgaatgactggttccagtcatcaggatgctgtgagctacaaagctgatctgaggatgctttgctttgcacaggtaccagcgtggctgccgatctttggctgcaaatctgcagctcctcactcagggtcagagtgagcagaagccactcatcctgaccgaagatgacgacgaagatgacgacgtcccagagggggtggagcgtgtgataggtgcgtggggtctaagcggcggcctctgctcttgggcaccgtcgggccaattcccctctactccaggaccacacttccttcttccttgctggtgccggcactgtctggccacccgtccccttcgctgagtgcacggtcactgcccgtcctctggctcctgaacccaggcctgtccctgaccatggacagtctcttcctgtgtgccgtagaagccctttttcccaccgcctcgcctccttcctgacctgggctgcctgttctgggcagctgggtgtgtcctcaggaaacagttctcccaggaaattgagttggggtccctggggctcaggtctctggctccttggcccctaaaccctgctcagttccttacctcaggagccatttcaaactcccttaaaccacattacaccttgcaggggtctccatccactgccctgttctcctcctgtggggtctcctgctgcacagagacagagccatcagcggagcccctcatggcggccatcctgggctcctgtccacacactgtcctgccctcctgccgcggttggatgaagtcttccctggacccaggcagggcctcttcatgtcccctccctgtgaggcccccatcctcccagtatctcccagcttcctgatgggcaggcggggccacgctgcctgtgctgtgctgcactctgctcacatccccgccgctccctccagggcaggtttctccccagtcatctgcaccccacctcgaccgtgaccatcagggcgcctgtggcaccgttgccagccccgagccagcatccactccggcccttcccttgacctttgcttctcagagccctccctggttgcgtggtaggcgcccgcatctgtgctgggcggctctgagtcccgggcggggccctgggtctgccccttccccgtgtccgcagcctgccccaggttcattcccgtctcccacccgctgcaggcagtcccccctgcccgcattccagctgctgtgctggctccagactgtctctccaccctcccctgtggtcactcagcgagcttgtccatcagggtcttcccagggctgcttggtgcccacaggcgaaggcttcacccttgctggggcttgcagggccctcaccgtgtgacctgacccctccctgcatcctctaggcttctgtgtggttcttaaaagttcagcctgccgccaaggcctggtccctgggagagacgtcttcgtgcagccgctggctgggggttttctctggaagcttcccagcccactttggtcacccgtgagctgcgggctcttcccctggcctgggtggggcccttgatgttggccttcccctgggggcaggcagctgctccctgtagccggctttaatggggtagatctctttcttaggaacagagaacttgggaacatggctgtatgtgatgatttgagaacggagggaaggaaatgttcttttcctgtcattaaaattaatattgttaatgtaattcccttcggcgtgtgcactgagtagcgtacaggatgggtcaccttacagctgggaaactaggaactttgtgtggactctgtcacgcatcaccttcctcttcctacagagcagctgctggtcgggctgaaggacaaggacacggtcgtgcggtggtctgcagccaaggggtaggtgtctgtggccgcagaagcaccccggggggtgggccggcctctcctgtgcgattcagcagctacaaatacccaacagctttggagtggcagcgcggccccctcctcggccccctccaacttatgtgtgttgctttacgtgttggcgtgaagatggttcccgaggcggagcttcggtctcctccgtcctcctgcctctggctggccctgccgggtcacgagcaggccgggtttacctgtttatcttcaaaatgttcccttgcttttccacatcctcatcactgtgccccccacctatcgttccccacagatgggggtcacggctcctacaatgacggtgctcagggaagagccctcttttgtggggtgagcaggtgccagtccctcattcacccctcactagcacctgtcatacctgtgggagtcgacatgcaccctgcaccccaggcctcagtggaggtcgtggggcagatccagtggggcctggccttgaacacaacaggtggagccctggcctggaggagccggtggccctgtgggctcgggctgtgcagggacagcgatacacgtgaagaagatgctgaagtgtcggggaggcccctgctgtggaggagaggaggcaggtgcaggggccagcaggtgctgaggtgtcagggaggtaccttctgtggaggggatgaggcaggtgcaggggccagcagatgctggggttgggggaggcccctgctgtggagaggatgaggcaggtgcgggggcagtaggtgttgaggtggggggaggcccctgctgtggaggggacgaggcaggtggaggggctgacaggtgctggggggcggggaggcccctgctgtggaggggatgaggcaggtggaggggtggcaggtcctggggggcgggttggcccctgctgtggaggggatgaggcaggtccaagggctggcaggtgctggggggcagagagaaccctgctgtggaggggacaaggcaggtggaggggctggcaggtgctggggggcagagaggcccctgctgtggaggggatgaggcaggtgcaggggccggcaggtgctgaggtgtcagggaggtccctgctgtggaggggacgaggcaggtggaggggctggcaggtgctgaggtgtcagggaggtccctgctgtggaagggatgaagcaggtggaggggctggcaggtgctgaggtatcagggtggtccctgctatggaggggacaaggcaggtggaggggataaggcaggtgcaggggctggcaggtgctgggggatgaggcaggtagaggggccagcaggtgctgggggacggggaggctggtttttgccattgctctcccatgcgtctgtgctgggtccgtccataccatgatctctgggaggagctccacagggctgtgcaggggctcacataggcctttgtgttgctgtacgcaggggatggcttttcagcccagagcctcgtctggttgggtgtgatgggcccacgcagtgagaggctgggcaggccttcccagtgtccttcctggaggcccctggccaggaccttccccacggggccatctccagggacttggaccctgtgagccagcctcaggcggcctccatgtggggccgtgagcccatcacctggcctgatgggtgcctgcacagtcagcgtttggggtggcacagaggaagcccggctccagtagggagggtcagggtgaagccctcagcgttcgcctgctgcctcggtaccctcagccgtcactggtggcctgcagcgtccgcgttacagtggtacatggtgacctaccctgtgccgcgtgtgctcactcgtcccctttgaatctggctgcaggctcctttaccctgcagcgtgttttagcgcgggggctccaagcagggtgcgggcttgcctggagttggcctcttctctcctggtctctggaggaaaggatgggtgttcaggccattcacacgtgtcacgcatgcccttggcgacaggctggtggtgcccctgacggattgctgcgtttctctttcagcatcggtaggatggctggcaggcttcccagagccctggcggatgatgtggtcgggtctgtgctggactgcttcaggtatgtgagaagagcaggggaggcgtgtgggcctgaccctgagttgagaagccctggctttccttatatcctttcacgcttgcttttcattgagctgtttgtcagaactccagaagctcttttttcccccttttgaagttaaacttgagaactcttgttatttctggtatgttgcttttatcaattccattctatttaaaaaccttaaggaaaaagagagtcagtttagacatatacccatgtagatgtttattctgaaaggaaaagctctactgagtgagttggggctgctccgagagctttctgtgggaggttcgggtctacccctcgcctacccattagccacgtgtatcactcagaccttgaagtgaggctggtgtgaccaaggcctgagtttgaattggatttcattttaacgaaatgtgaggctttgggaggccaaagtgggaggacggcttgagcctgtgaattcaagaccagcctgggcaacgaagcgaaaccccatctctacagagagttaaaaaattagccagacgtggtcccagctactcgggaggctgaggtgggaggatcacttgaggccaggagtttgaggcttcatgagccatgatggtgccactgctgcactccagactgggcaacagagtgagacccggtctcagaacaaaactgagtgtagacagccacgtgtgctgtgccgcatttctcttgtcagccttcagggagttctgggtcttgggaccgtgtggcttgtgggtggtaagttgtgggctgggatgtgcgggtggcagggcctgggatttcagcctggggcctgcagtcctgccctggtgtgctcacacgtgtgaggcatcgatctgtgacctccccagggaattctcccttttgcttgtgtaaatgtctctcccagtttcagaagcggagggtcgagagcaggcgtccagcttgctcaggaccccgggcgtgctgttgctcttcattagcctggacaccgtggcgaaagctgtgctgtcagcactttggaggctccagttcgcgttgcctgtcagtcaccagggacagctccggagccgttcacaaagccttgttttccttctggaggagatttcttgtgcacttagcctccagcctgctcagtgacaatttcaggagcacaggaaacaatgtgtcagatacgggtcatgtttttcagagcagtgtgcatgcatgtgtgagaaatattcttccagtggaaacattgctagcagaaaacatgctctttaccacaactgcttgatgggaggcaggggttggagggtgctacgtgcttggcttctctgtaggcgacctccagccttgtttcaggcgtgtccctggagctcctttctggtggtcatggtgggcatatgtcctcctgtcgcctggtgccacctgcggccttcacaacagtgtggtgggctccaggccgggcctgcctgtgcctgtctggactttgcctctctcctccagccgctgggcggcctgctcatcaggcctagtgcgtctcctaaactcactgtgtgtctttccctccacaacgtgcagcctctctggactgtgtgttccttactctagctcaccttcttggtctagtttcatttttcctggctggtttaatcttcaggtgctttttaacctttatttttgttattttaatgtgctcattccatttttgtagctaggttctgggacggggtggcctttttactcttgatttcgcagggccttcatcccaaagtagctgcagggccatcatcccgagtcctcgcaggatgcagctctggtcagtgcctgccttcccttttcctgggtgctcagtgtgtgattgtcaaccgtggcataaaaaggcggctctggacagcgcctgctttccctttcgctgggtgctcagcatgtgattgtcaaccatggcataaaaaggtgcagcctcagagcaggatgtctgaagacaccaggaagccaggagttgctggggtgtggggcggcccacagccctgcatggtggctgctccaatcttgtccttccctgggacgtgtggtaagctgccagcctcttctgaaacgggtccgagaaagggcattaattatattaactgtaagaacacccagcacccaggagggttaacttactccccgctcctttcctgggctgggttatgcagtgagtggaactgcacccatccccagggggttcaggatctgtgtggctgatgtggctgtcccccaagcgtgcacgactccctcaggacctggggccccctcctgactcccatcaccagccctgcagcattaccctggacctaggaagtagcgccagaccccaggctgtggcagaagcagggtgccttggagaggagtgtgtctgtgtctgtgccaaccccattggtttctcccgtgagcaaaccaactgaacctgtgcccgggcccagctgtgggtcctgctgacttgcccgagggcatcttctgagacactcggtgtggagcgtctggaagccacggcactacgctgtgcctccccctcgcccgccgccccgtgtcagcaggagcctcaccacgtgggttcctttctgttgagctttacggtttcatcgaggttttggactgggtgatgtgttcattcaaaagtcaaaccaaagggaagaagacagcctccccagaccccagagcccccccgcaggtgacctggggcacccgtttcgcatccctccggggactgatgcaggtgtgagcagatggatacagaggttttcttgttttgtttttgagatggagtctcgctctgtcgccaggctggagtgcagtggcgcggtcttggctcactgcgatctccgcctcctgggttcaagccattcccctgccgcagcccccaagtagctgggactacaggcgtgcaccaccacgcttggctaattttttgtatttagtagagacggggtttcaccatgttggccagtcgggtctctgtctcctgaccttgtgatcagcccgcctcggcctcccggagtgctgggatgacaggctgagccaccgcgcccggctgttttgtttttagagatggggtcttgctctgttgctcaggcaccatgatagctcactgcggcctctacttcctaagttcaagtgatcctcctgcctcagcctccgagtagctaggactataggtgtgcagcaccacacctggctaattattttatttcatttttgtagagatggggacttgctatgttgcccaggctagtcttgaactcctggcctcaagcagtcctcttgcctcggtttcccaaagtgctgggactatagacctgagccctgtacctggctaaaattgtctctttcattttacacagataatggcttacttgtcacactttaacaccaaacgcatctttgaggtcattttacattagtgctgttccccttgctcttgatgatctgagacccgtgtacctgcgacactctttacccgcctcctctctctctctctctcttcctctcccgctcatccgcccactcatagcttccactattttctgttgtcttccctcctctgagaccccccctgtgcttccaggagtgccttaagcttggatctgagggcgggaactcgccccggctgcttggcttctccctgtgcccctggtgtccatggacagggtcccctgtccggttccactgtgccgtggtggtgctgggcctctgaggcgagccggatggacggacggcatcccctggaccctgccacccttgccaccgtgccacagtgaacacgtgtctgatttagaagtagacattggtctgacaggcatttgttttggtatttttaagtcacggtaaccttggtgttttgtcaagttcattcagatgttaactaaatctttgtgaaaggtgtgaagcatctttctccaatgaaaaccctaaaggacgcaagtgctgatgtgaaaatacgcaaggggctcacggagcctctgggcagacagtacacgtctggaacttgtttaattgtgattgagtctgtcggtgacagtgagctctgaggagcccgctggtggacgctggtgtctgtctcagcccctcctctctgggctgggcacgcaggaggtgaggcagccactgggcggacaggcactctccgattttcctaagtattcttgtccatactgattgccagctagtcatacaatttagtgggttttcctaaacatttatttgctgtcaagtcaatttaattagaatcaggagagcttctgaaccaccccggggaaattagtacgtataaaatattatgacttgatcgatggccattgcaattgttcattaaaagttcatatttcaaatactgtgaaaaatcttgaaatgccaattcattattgtagcatttaattctgagtttgactaaacagtggggtgtcatttaaagaaggtcttcctgctcccttttccactgacgtcttcctgtgctgggattcctgttttaagttcctacttttctgaagtgtcttatttctttctatgggagcgtgggtgttgcccgtacttggagcgacaccactgtggtgggaaaaccccacctgggacggcacagacgggacggtctctttgtttggggactgaccaagacttgtcctcactctcgggagatctgaagaggccctggggtaggcacggctgttgtcttcatactcagttgcagtgtgttatttcttcagccaactgattatttgtttttttattttgagacggagtcttgctctgtcacccaggctagagtgcagtggcgcgatctcagctcactgcaacctccgcctccctggttcaagcgattctcctgcctcagcctcttgagtagctgggattataggcgtgagccgctgtgcccagccttgatactttaaaaacttaggaatgggttttagtgagccttacgtgagccttacaggcagaggatatggacctgccaggctgtgctccttgccatgctgtgggctttgaaccaaaagctgacacgtgggctgtggtctcaggatctttgttgctctcagtttccaggagactgacaaggcgtggcatgggggatgtctggcgctggcagagctgggcaggagaggcctgttgctgccgtctcgactcgtggatggtgagtagctgaggcacggtcaggggggatgtctggcgctggcggagctgggcaggagaggcctgttgctgccatctcgactcgtggatggtgagtagctgaagcacggtcagctgcgtcaccaggctgtccgtggcaggctgcagcccttcgtctgaacccatctccgcggtgtggccctgccgcgggcacgcccagaagagcttgagaacaaggtctgtctacctttttctcgcattggcctttgtaatttcctaattgcctcttttgtctgctgtggaattttaatgccacagattaccctgtgtagctggttttggagggccacgaatccttgtaatgtctgattttcttactccccaaaaccggttttcattcttgagggacattgtcgccccttaaggacacatgcagtggcacctgcttcagttgtagaaccaggtacccctggcagcatcctgggtcacctggagtgacgtggtgctccctggagatgaggctcacgccagcgtgaaaccagggtgggaactggggtggagggccaggggagctctgcagtggccagcagtggggtggggacagagggcacagcatggcagatgcaggggcactgccccagaccagctcttgtgccgtggccacacgcagccctgtctgtgtttggtggggagagtccctgggtgtggctggcagtgccctctgagggcaggaaggaaaggatgtctgtacaggatagagtgggggcccatcctgagagggcctcaccacagagacttgattctgtccaaaataaagacacctgagatgtggtggcctcacgtcttcccagtgtggagctgtggtggcgtctgaagtgaccgctttgcacttggcattttgatgtatggggagagcttttagagcctgcagttcttttttttaatgtctctgcttatttttttccagacttctttaatgtttagacctctttattgcgatctaatttacatgccataaaatgcactcatttaagtgtacggttaagtggtttttatatatttacagagttgcgcaactattgccataatttaatttccgaacattttcattgcctccaaaggaaccctgtgtttaagaactcactctttactctccccagcacccccgccctggcagccatgtctccagtgtctctgtgaatttgtcttttatagacatttcctaacagtggaacctacgacatgtgatctttggcgtccgaattcttcggctgagtttctctgtgtcgtagcctgtggagtgcctccttccttcctgtggcagagccttgtcctgctgtgtaaatgcaccacacgccacgttttgtccatccttttcatcagctgatgtacatctgggttgtttccacctttcactgttaggttaatgctgccatgaacatcgtgtacacgtttttgagtggatgttgggtgtaggcctagtagaaatgctgggtcatacggtaactccacgtttaactttctaagaacctgccaaactttttccaaaatgattgcaccatttcaagttcctgcctgtagtgtgtgagggttctgcttctctgatcctcaccaacacttgcttttatctttttttttttggacgcggtttcactttgttgcccaggctggagtgtggtgatgcaatctctgctcactgtaatctctgcctcccaggaccaggcgatcctctcacctcagcctcctgagtagctgggaccaccggtgcccaccaccatgccacattaatttttttttttagttttgttagagacagggcttcaccacattgcccaggctggtcttgaagtcctcagctgaagcagtccacccgccttggcctcccagagtgtggggaatacaggcgtgagccaccacacttgccccctgcttctttaaaaaaaaaaaaaaaaaaaaaagccgtcctagtgagtgtgaagcgccaccttgttttgcttttcatctgcttttccccagtgactgatgacactgagcattttctgtgtttgcccgtttgtatgtcttctttggagaaatgtcttttcaagttctttactcatttaaaaaaatatttttttaattgttgttgtaagtaagagtttttttatgtattctggatataagtctcttattggatatatgatttgcaaatgttttattgcgttccatggttgccttttcactttctattgattgattgacagagtcttgctccgttgcccaggctagagtgcagtggccccatcacagctcgttgccaccttgatctcctgggctcaagccatattcccaccttagcttcccaagtagttgggactacaggggtgcaccaccatgcctggcaacttttttttctttttttgagacaggatctcattcccatcgcccaggccggagtgcagtggcgtgatctcagctcactgcagcctccacctctcaggctcaggcggtctgcctacctcagtcccctaagtagctggggctacaggtatgtgccaccatgcccagctaatttttgtattttttatagagatggggttttcccatgttgtccgggctggtctcgaactcctgagctcaagcgatccccccgcttcagcctcccaaagtgctaggattataggcgtgagctactgcacctggccttcatgcctggctaattaaaaaagttttttgtagagatgggggtctcactatgtggcccaggctcgtcttgaacttctggcctccagtgatcctcctgcctcagcctcccaaagtgctgggattgtaggctgtacctggtgtgttttcaatttctttgatggtgatatttgacccaggttttaaattttaattaagtccagctcatcagtctttttctttcttgtgtttctggtgtcatagctaagaaatcattgctgaccccagaaccatgaagttgtggtttcatttaacgttttgttccatccgaagtaagtgactcgtaatgtttatttgtgacactagatgtgtgtgagggtgtgtgtgtgaatgtgtagctgggatggaatgaagtccctgcctgtggggagccagctccaggttcactcaaaggagacaagagactctactggcttgtgtgtgtgctctgtcatgtcttatggcaacatgcactgaccccaggcagctggggcgagaggatatgggtgttggcatcataaacgaaaagggtaaagctatggttcagaaactgacacgtgatgtggaatacactggcccatgaccttcgcatggttggttggccccttctgcctggcggtgccctccatgtgagctgaaccctctttgcagcccccattctgttcctggtgggacatggagaagctgtgctgtctctgcacagggcaagggttctttcaggcaggggtgaaagagatcccatcttggggctgactcaggaggtgacagggctgacatttgatgagcatttgcagcatgctttttatgtttttgttttagacctcacaccattcctctgagagccgtcttgtttatataaagctatagttgggagccacgtgtggtggcggtgcctttaatcctagcctcttgggaggccaaggcaggaggatcacttgagcctaggaatttgataccagcctggacatcatagtgagacaccctctctgaacaaacaaacacacacacacaaacactgcagctgtgggagccaggaagtctttctggtgtcacagctcatgctcagcccttcggcctcctccatgtcacacggctgagctgtccctgcacctccttgtctccttggagagttactgtggttctctgtcagtttggtttgaaaagtgaaaacaggctgggcacggcggctcatgcctataatcccagcactttgggaggccaaggcggggggatcacctgaggccaggagttcgagaccagcctggccaacatggtgaaaccccgtctctgctaaaaatacaaggatgtggtggtgcatgtctgtaatcccagctactcgggaggctgaggcagaagaatcgcgtgaacccaggaggcagaggttgcagtgaaccgagatcgcaccactgcactccagcctgggtgacagagcaagatcctgtctcaaaaaaaagaaaaaaaagcgcgaaaacaaatgcttggcaaataaatgtcgtagaaagacacaatatagatgagcatgtttgatgactaaagcttttgtttgtcttagaggaaatgtggagcttcattggtgcatgctaaaggaggaagaagtaaaactagggaagtcaggtgggcaggcagtgatgcgatgtttgcctggaaggcaccctgggtctttctgcccttagtcctctgaatagggggactctgcctgctggactcaggaaaaaagcatcgcattttctttgggttactttttagggaatcctgctgattcctctccacacatacagtgcacacacacacagaatctccatctgttgtgctgtaagcctatttcttggtctctgactctgtgcacaccaccacgcccagctaattttttaaagaaattcgaaagtagcctgcgcaacaaaatgagatcctgtttctacaaaaattgttttaaaaaggtagttgggtgcagtcccagctactcaggaggttgaggtgggagaattgcttgagtccaggaggttgaggctgcagtgagccatgatcgcagtgctgcactcacgcgatcctcctgcctcggcctgtggacagtgggccatgttctttttctctttgcatcatcacctctgtttgaggactactgttaaagggctacttggtctttattttaggtgattcaaattccaggacttttcttgagtggtcctggcgtaggtcctttcaccttttttgtggctcctctttgaacacctctgttgttgtggcaggaggaggtgggcactcctcaccatgagtaagctcctacaatgtttgtgaacccttacggtttcctttgttggatacaagaagcacaggtggggggatgtattggtttaagtttaccttttttttttttttctttttttgagacagagtcttgctctgttgcccaggctggagtgcagtggcgccctcttggctcactgccagctccatctcccaggttcaagtgattctcatgactcagcctcccgagtagctgggagtcaggcgcccgccaccatgcccagccaatttttttatttttagtagagaccagatttctccatgttggccaggctggtctcgaactcctgacctcaagtgatctgcctgccttggcttcccaaagtgctgggattacaggcgtgaggcactgcgcccagccaactgtactattttgataaaatgtatacatgtgctccttattatgcattttgtggttttcatcagtattttgctttttgaaaaatgtcaagtgttctgatctctttggacattttgtatgaaccctatttcccttgctatccttattgattgagaattgtgcatattgatttgggtaataataactagcacttggtgtttttctgagcttggatgtgtagattcatgtctttcatcaaactcgggtagttttcagtcattgtttcttcaggtatttttgctgcccctctcctctccttgtgggactcttgttatgttaatacacatgttggtactcttggtggtaccctatgagtctcttaggttttgcactcatttcagctcttgagtcttcttgttatgttaatacacatgttggtacgcttgatggtgccctatgagtttcttaggttctgccctcatttcagctcttgagtcctcttgttatgttaatacacatgttggtaagcttgatggtgccctatgagtctcttaggttctgtgctcatttcagctgttgagtcctcttgttgtgttaatatacatgttggtaagcttgatggtgccctatgagtctcttaggttctgcactcatttcagctgttgagtcctcagttccagaatttctctttagtttctcttttaataatttctttttgagacagggtcttgctctgtcgcccaggctggagtgcagtggtggtatcacggcttactgcagcctcaacctcccaggcccaagcagctctcccgcctcagcctcctgagtagctgagaccacaggcctgctgcactggaaaaaaaaattgtagaaacaggatctcactttattgtccagactgctttcaaattcttggactcaagtgatcttcctgccttggcctgccttgggattataggagtgagctgctgtgcccagcctgtttttataatttctgtctctttatcaacattccatgttagtttaaatgttgttcttttggtctcctttagttctttgtccacagttttcttgagatctgtgagcatatttttgtctaagactgagcacagtggctcacacttgcttcccagcacttaacctttgctttaaagcctaaaaaggaagaaatctttgcatatgtgtttcccaaataacagatttgagggctgtgttggtgacataggtctgtttatacccactgtgtggctaaagcaggtctctgttaaattagcatctacaaagcttttctcctgccttccctcaaacttaggaagctccctatgcaatcttcaggctggggtccttcactgccccctctcaaggaggcctaccccttcccccagaaggtgcagtctgtcaccccatgtcttataaagtgtaatggtctggtgtcccaaagccacagagaagcccattctaaccttcctgcaactttctgaaggttggagagcatgtttgttttactgctaggaggctcaaggtccctgtgaacctgcatcaggtagtaagccctgcatgtcggaaatacagactgcctaactcttatctaaggtgatgttttgagaaaatttttaaatgtataatacattttataaatttcgaaaaaattttaataaacattaaatttttataagtttatataaatgttataaattttgaaaaatgtacagagttgcattggagcacacgctctcagtgttcatcgaagacgtacaagcagcgtcttacgacgatgttgctgcagctgccttggggtcttgttaaaagcaccattcagtagattaattcccacctgtggactgtgttttctggcttccaaaagaaactgtcatgtttttctctctggatgacgaaaactctgcacgtacttcctatgacaagtgcgattggcgcccactgctcttggcagttgaggtgaggacacagcgtttctgtgacggtgaaggggacagggtttggagggagattcagacattaaacaaggaaacgaagggagcaatttcagagaatggataaagtcgttaagaaaatacaaaagggcggtgagatcctcagtgatggggccaaccagtgacttgaataagacttggggaagacctcctggggcgacatttacgctgagagcttctaccgtgaaggagccgagcaggatggactcctgaccgcagcatctcaaagaggaacgaaggctcgcacgagctgggacagcggaaagagcagaagagtgggcacagaaaagcgcctgggggccagatcctagaggggcttcaggaacacagtgaggggtttggaaattattcaacataaagtcagatactggggaatacacgggggtgcagtggaaaggaagagcgagggagagtgaggccattcgggagccaccacagtgttcggagtgagaccagagctgtgaagaaagagaaaaggaaatacgctgcatgtaggattctgaactcaacgactttgctgttctattcagtgaaagagagtgagatagtaaggtcagtgagtgacatgttggagccttccacatagtaatggtctacaaagttatggattgatgagttcacacaggagggagtgagagatgaggaaggtgaatgggtggaaaagcttgaaccgggttcccaggctcactggcatggggaggtggagaaaaggggaggaagcagccgacatggaaacccgcagaggctccttcagaagggatattttataggagaggagtccgattctgagagggggaaggggtggaggaccagagtttcctcacaggctctggagcactgaggtggatggtaaattccaggagagcagctccagctgaggtctagggacagggcattccctccctggtagagccgttggggctcagtgccgaggctggctcaggctcttgtggggggccctgctgtctgtccagccctggctgtggcctggcctgaccctgctgccccctgcaggcctgtgtacctcagttcccaggtgatcaaggggccctgggagaggttgggtctgagcacgtcctgacatggccccagtgtccagttccccgcctgtttttgttggcttgtttaatcttggtaggcttttaagctttcaggttttcaggaaaatgcaaagcatgagacatctttgactttgtacgtggaccgattgttctttttttgtgttaatggtgtttttttccttgtgtgaacgtgtgtgtttcgtgttgcactccgccctgctctccctccctccctccctgtagaacgtggcattttggctgaacgttaacactggtgggggcagacggcagtgggcccccgttaagactgtttagaaagggcgttgtcggcatcttctcttacatgtgaattcaaggatcctttattttttttcagctttattgatatgtaattcgtctaccatataattcacccatttaaaatatatagttccatggtttttagaatattctattattacttagaaaattgtggcaaaatatgtataacaaatttgctctttttattattaagcatgttaatccagtggcattaattacactctcacttttgtacaaccatcaccattatctggttccaaaacttctcatcaccccagattaagaagtcactcgcccctgatgctccttcccttcaaccctttgtaactctagtctactttctgcttgaaaaaggactttgcctgttttagagatcttgtacaagtggaattggacaatatttggcctttcatgtctggcttattttatttagcatcatgttttcaaggttaatctgtgttgtagcatgtatcagaattttctttcttttaaaggctgaataatatttcattgtatggacataccatatatttatttattttatttttacttttatttttatttttttttgagacagagtcttgctctatcacccaggctggagtgcagtggtgcgatctcggctcactgcaagctccgcctcccaggttcacgccattctcctgcctcagcctcctgagtagctgggactacaggcgcccgccaccatgcccggctaattcgttttgtatttttagtagagatggagttttatcatgttagccaggatggtctcgatctcctgacctcatgatccacccaccttggcctctcaaagtgctgggattacaggtgtgagccaccgcgcccgacccatatatttattttttaaagataggatctcactgtattgtccaggctggagtgcagtggctattcacaggcccaatcatagtacaccacagcttccaactcctgggcttgagcgactctcccacctcagcctcctgagtggctgtgattgcaggtgtgcaccaccgcccctggccatattttcttgatccattcatttgtcagtggacgcttgggttattcccaccttttgggtattgtgaataatgctgctgtggacatggatacaagaacctgtttgacacccctttttttagttcctttgggtatataccctgaagtggaattagtgggtcatgtggtaattctatgttcagctttttgagagcttatcactttttgtatgtaaaaattacgagtgtttagttcttaagtcggatcatgcataaatgcagaaacgtagttaaaaaataagtctcttttttttttctttttgctataaagctctaggaatcgattttgcttttagagatagacacaaagggcttatcctggttgcaatgggtgagctattgcagatgacctttggaggaattgtgtcggagtgtagaattttcacagtgtagctcgccatgcatcaggcacatgtagcctgtgccacaaccattgtgcttgggcggggttctccatgctgccctgttgcaggaggatgctctgcccctgcttctccctatttgtcatttaagatgattcctggtgctttttggtgagcgatcaaatggtgttctcagaatctttgggcccttgacaacggagggctgtattcttgggggtgtgatgtgagagctccttgtctgcagggtgtgaggctttgggtcctgagtgtggaccgtggcatgtgatgtcttgtcacggctccctgcacggctgtttagtttctgaaagctggaagtataatatttttgttctttgccaaaacatactggtgtatataaacagaagtgcccaggtgagcgactcagcactgcgcctgtgtttatggttctgcgtctgaccgtgtgccttttaggctggtgtagtggttgtctgaggtgggtgcctgacagggctgggggacctgctggtgtccttgctgctgctttagggacagcttgaagcagtgtcctcagataccccttggaattgtgacaaactctgtatccctcttacaagttttatagaactctaaccagttgcaaataactatttgccatcctgagtattgtcattttaaaataaaactattgcgtcactcatctgaataaatctgggaaattgaggtagaataatctaccattcttcgttaaaaaatttacagggctgggcgccatgtctcacatctgtactcccagcactttgggaggctgaggtgggaggatcacttgagccccgggaggttgaggctgcagtgagctgtgatcgcgccactgcactccggcctgggccagtgagcgagaccctgtctaaaaaacaatttcataggcaagtttttctctcacagaaattttattcttcctttttcttcttaagcccatatttccatttacttttttcccagagcattttaccctaatgtaatgtatttctgtgcctaagaatctttattgatctatcatttatctgcaacgaaagaaaataacataaacataaacttcaacttttgcattttgtatggccataagatgctagttatttatttattttttccacaggtgttcatgaccttttttttttattatttttttaactatacttttaagttttaaggtgctagttacttagaagtttttttagattgggttttaaaaaattatgagtacagagttgaccaaaacaacataaaatagcatattattgaaatttagctcttaataagatagctgtttagtttgagttatcttttgatgagtcaggctttttttgtttttattttttgaaatgattcttgctctgtcacccaggctggagtgaagtggtatgatcttggctcactgcagccttgacctcctgggctcaagcaatcctcctgcctcagcctctcaagttggtgggactacaggcaaacatcccattgctcagctaatttttgtattttttgtagggatggggtctccctgtgttgcccagactggtcttgaactccttggctcaagcagtcctctcacctcagcctcccaaagtgctgggattatgggtgtgtgccaccatgcctggccgtgagccatgcttttaaccagaataaggcaaggttctgcaacagtacaatttttgctttttatttatgtattttttttgagaaaaggtctcactctgtcacccaggctggagtgcagtagtgtgatcatggctcactacaacctctgcctcccaggctcaggccatcctcccgcctcagcctcccaagtagctgggaccgcaggtatgtgccaccacacctggctgactatttttattagagacggtgtttttccatgttgcccaggctggtctcaaactcctgacctcaagcaatccatccgctttggcctctcaatgtgctgggatgacaggtgtgagccactacgcccggcccctatttttactttcagttttaagtgctaagaagtcttattcattcaagtcttattcaagtagctaggaatggcagaaattttgctttagcaatgctggtgtttcaactttttccaagctcacgcctgacctctgtgctctgtcactgagcagcttcagtagggtggcctcagtcctgtgaagtgatgcgttgacagccacctgcatggggaagcatttcccagtctctggagcagttcccatcgtagtgtccactgcatggtttccagtgtgttgggtgagaggctgcctttcttgaaaagtgagagaaagggctgttgtgagaggggacatggggatggagaaaccctttctcaagcagagccttaggggctgaggctccggaagtctacgctcctaaagcactctgaagcctgaggaccccatggatggccattgagtagccccaggggtgcttcgcacatgccggtacttgaccactgctttaaacccatgtgcacacatgcacgctcacacacatgcacgatgcagaagtgcatacacacgtgtacatgtgcacactgacacatgcacgttgacacgtgtacacccaatcgaatgtgcacaactacccccacagatagcacacacccacacaatcgaatgtgcatacacccacagatacacacacgtgcacacccgtacaatcgaatgcacacatccgcagatatgtacacgtggacacccacacgattgaatgtgcccccccacagatatgcacctttgcacacccacacaattgaatgcacacacacccccccacaggcacacgtgcacacccacacaatctaatgcacacacacccccatagatatgagcacgtggacacccacacgattgaatgtgcatacactcacagatacgcacacatgcacacccaatcgaacgcacacacacctgcagatatgtacacgtggacacgcacgattcaatatgcatacacccacagatacgcacatgtgcacatccacacaatcgaatgcacacccccccgcagatatgcacacgtgcacacccacacagttgaatgtgcatacacccacagacacacatgcacacccgtacaatcgaatgcacacacccgcagatatgcacacgtggacacccacacgattgaatgcgccccccacagatatgcacatgtgcacacccacacaattgaatgcacacacacccccccacaggcacacgtgcacacccacacaatctaatgcacacacacacccatagatatgcgcacgtggacacccacacgattgaatgtgcactcacagatacatgcacacccaatcgaatgcacacacacccgcagatatgtacacgtggacacgcacacgattgaatatgcatacacccacagatacacacacgtgcacatccacacaatcgaatgcaccccccccgcagatatgcacacgtgcacaccggcacaatggaatgtgccccccccgattgcacacgtgcacacccacacaattgaatgcacacacacccgcaggtacgcacacatgcacacccacacaatcgaatgcgcacacacctgcagatatgtacacatgcacacccacagaatcgagtgtgcacacacccatacataatgcgcatgcactcacatgattgaatgtgcacacacccagagatgcacacacacacatctaatcagatgtgcacccccacacagatatgcacatgtgcacacccacaggatcgaatgtgcacgcctaatcagatgtgtacacccctcccacatatgtacacatgcacactaacacaaatgtgtacacacccgcaggtatgtacacatgcacacctacacagtcgagtgtgcatgccccccacggatatgcacacgtgcatacccacacaatcccatatacccacccccacaatcacgtgtacacacccccgcagatatgcacacacgcacacccacaggatcgaatgcgcacacacccacagatagcacacacgcacacccacacaattgaatgcgcaccccccacagatatgcacacgtgcacacccacacaatagaatgtgcacacacccgcagagatgcacaagcgcatacccacacccgcagacgtgcacatgcacacatccacacgatcaaatgtgcacgtgcatctgcagacatgcacaagcagacacctacacgcactcgcagacatgcacacccacatgggcgaatgtgcacaccccccccacacagatagcacacgtgtacacccacacaattgaatgtgcatacacgcacccgttcacaggttaatcgctgccacagctatcagctctttttcattgactgttacggcaaaatattctaaaggataacatagatttatgtttatttgcattttatgtttccttatggttcatatgagtttattggaaaattagcaacatacacatcattttggggaatggaaagtgaggcagagtaagccagaacattcactgtaacattataagcaagtagaataaattgataataccttcaccagtaatgcactttccctagtggaaataaattatttgtataaatagcctcttgatgtttgtgtgttatttagttatacaaatcacatttttcttttttacatatggcactttaatgttagtactgaaaatgttttttctgacattttttcagtaattgtcatttacatcaaatatgcagctagagctaatagaaaaacagttaaaacaatttgttgtaatggtgagatatttataaggaaacatttataaaagatcttctgtaagacagcttagacttgaaaatacatatcagtcttagagtcattcaggtgtttttacaaccaaaagtagaagcaccttttaatattcatgcttaatatttataaaaactgaattggagggttttttgtttgtttgtttgtttgtttttttgagaagcagcagctgcatttgtaaaaatgtgaaagtgccagttcagaggtgttgtagcttgccaccttggaaggcgtgtgtgtggccgtagctctgtgaacacacgtgtgaacccggcgttaggacacccgggccctccttcgtagtgtgaacactctggccgtgtcctgcagcttcgccttcttagctccttgctgggattttccagcatcccttagacttgtcctcttttgtcctttgggtctgaggtcacactgggcctcttggctctccatggagctcagtgtgggtgtgtcttgccggcaggcaggttccggggccgcagcatccccatcgcccacccggatgttcctggggctgtaggccgccagctggcacagggccacggctgccgtctgcttctgctcctcgctgctgtccaccgcgcatgcgtctggagcctcctcgccggggcctgtgggtggggccccgtcaccgtcgaggctgcctggcttggtctcagggtggctgggcccatcctcagaaccttctgtcccagtcttctgtggaacagcagcagcaggttctgcagctcgtggtcgaccggggaaggcaggcctcggagcctgggtgttacaggggtccttcaccgagagattgagtggaaggtcctgcagctctgagaagctggcggtttccgcctgggggctgccttggtacgtgggttcgtgggtggctgccaggtttatctctgatttcttggagaggttgagggggcccatcccggagctgtcgtccggactggaaggcgcggcctccgagacgagagaggcgcttccggtcggagcaggagggtctccgttcacaacattgaggctagaagaagccaagaaaaagcttagtaggagcttgcttagaaaagcaactgcgtgaagcagtgtgagcaagtataagcctggctcatggaacccaaccagaaacattcccttggaggttttgaaaatgacattttcttaccttactggagactctgctgtggtctcagcagcctgggcaggtaggcattctgtgcttttcttaacaggcctgaaggctgtgaggctttgctctggcgggtagagtcttcccagtgcgctggaggctgccttgttggagaggtcgtacaggccttcgcaggtctggctcgtctgcatgaagtcggtggggctcggcctccctggggagcccgtggctgcactccctgcgcgggggctcattttggacccttccgtgtctctctgcccagccttggaggagtctttagcctcaggaattggactttcgaactcgacgtgttttctgttggggtccgaagggtttaacctggaaggactcgaggctggatagaccagggtggcttcttcaagcaggtgagagctctgatctcgggtgaggccagtgacaggtgggagtctgagaccataggaggaaaatgcagactctggcctgtaaaatccgtaaggaatcggcaggttagagggatattgctggaaaaacctgtagtgatcgtatgtggctggagatggagccaggtgcttagggatcggccccgggtgaggcaggaagtgtctcgggtcttgggttccgtagactgacagcaggggtgcgtcacactcaggcgagctcccagccagcaggtaaggcgagtagatggtggccagcccgtgctctgtgtaaaagtgaggcgggtactctgggattgtggggtgcatgtaaggggaaatggccccaagcccctttgtagatgagattttatgtggaaactctggtggaaggaaaggtgagccggctttccaggggtagccaggagtgtggaaggccgacttggtgtggaaagacacggccttggcagtggggttgtgtaaagccagtgtctcgggcgcctcggcgttgtctggccccttgagtctgtgctcgccgactggaacaaatgcagaaggccgagctgcgccttccagagcaggctgggcaccgagggcggcttccggagctgggctcttgcagggtgatgccctgtggagggctggcttctgtcccaggcacctgtgggttccccgggcttgcagctccaggttttccttgatgtcttccctggcagagctgtgctgaagcttcgagtcgaaggcagagagtccatttgcgacagacttggaagaggctggcttcgccgtggcatcgggctggttggtttgcttggggtctagtgagttagatttagggcacttgggaactcgatcctgctctgatactaaagtaatcgagtttttacaaagaccatacttcatgtgattaaaaagatgtgacttctcattgcaagtaaagggacattggaaacatttatacttgaagggctttcctggaggcctggggatgtaatgtggcttttttggcttccgctctttgaggagactcattttcctccttatgccttggactctggctgtccaggtggcgtgatcactgtcgacgccgcgtgcacttcgtggtttctaaagaggcacctcccgctttgctttctttcccgatcacttctatcagaagccagctctgcgtgctgagggtctggcgagagcctccgtcatctggcggctgggagctgtaataaagagcagtcttggtgtcaggacagcgagtgaggggtcggcgagaagccggcctcggctcgccacagtgccacaggatccctgaagcagaacccctgaagggctgaaactgcctgctcctgaggggagcagctgccggtcacagaagcagccctgccctacccttggtaacctggctgctgactccccaccgtgttttctgttttctgagtctgatctgaaagagtcacctcggggcctagaggtggagtgtggtgtgtggtgcgttgagtgtctgttctgagaatgcctgtaagcctttgagttttgggaactttcatcctgtgacctggacctttcctcgaaagcgccctgccgggggctgaggacaccgagccccctcccagggtctggacagagtcctgtcccagggctgcccgactctgcttgggggttacacgcttgaagcagtgggtgtgtgatcggccacactctcacgtgaaatacgaaggggtttgtggctgtttccccttaacatgtacccacagtcacagagtgcccctcacttttacacagagcgtgggctggccaccgtctacttgctcctacctgctggctgggagctctcccaagtgctgtgcgcccctgccgtcggcctgtagaacccaagaccatggatgctgctgcctcccctggggccgatccctaagcactcgtggcagtttctgcccactttagccacgtcgttggtgtattctagtgtgcttgtttaaaaatgaagaacattcgaacacaagactctaccctactgcttctaaagtcagctttatcattaagtagcatttatgttgtctcagatatgaatacaaatgctatatttatgttgacttaaatggttgaaatactgttggtgaatttgtacatcctgtgagtgacagcagcattgtgagacatgctttcacggtcacccggttcctgctggccaggaggcatggccagcagcgcctgcccgtccagatgcaccaccaaatggaagaaccaaagctttgccacactcctgcccgagaggagaccagagtgagtagtatccgctttagagatggttgggtcatgggaggaagctgtcctggcccttaacctttagggagtgggttcagccctctggccacacccactcaggtcctgggacccaccagaggctgtgtgtgtgatgtcagagctggcctgctcttttggattcttccagagggtctctgtgtcccccttaccagcctcaggtttccttcagaggctgtgccgcacgcccaaggctgagaacaaaggctgtttttctttttttgagacagagtttctcccttgttgcccagtctggagtgccatggcgcaatctcagctcactgcaacctccgcctcctgggttcaagcgattctcctgcctcagcctcccgagtagctggaattacaggcgcccaccaccatgcccagctaattttttttgtatttttagtagagacggggttttgccatgtgggccaggctggtctcgagctcctgacctcaggtgatccacctgccttagcctcccaaagtgctgggattagaggcgtgagccaccgcacccgtcccagaacaaaggctttgagagtctgggactgtccacctggcagctgggcctggagcgactcaagcagcaactgtgcctgggagacagggtgagtgggagatggggtggaggtgcaatggatcaaggctaagcactttaattcgtattaaaaatgtaaaaaagaaaaggtctttagggtctaaatattttcaaacagcttaaaaataaagttaaatgacccaaatgcctatcagtgatagactgaataaagaaaatgcggcacatatacaccatggaatactgtgcagccataaaaaggaacgcgatcatgtccttcgcagggagaaatggatggagctggaagccagcatcctcagcaaactaacgcaggaagagaaaaccaaacgtgcatggtctcacccataagtgggagctgaacagtgaaaacacatggacacagggaggggaacatcacacaccagggcctgtttaggggtgggggtcggggggagggagagcattaagacaaatagctaatgcatgcagggcttaaaacctagatgatcggttgatgggtacagtaaaccaccatggcacacatttacctgtgtaacctacacgttctgcacttgtgtcctggaacttaaagtataataaaaaaaaaatacattaaagtaaagttaaatggagggctgggggccgtggctcatgcctgtaatcccagcactttgggaggccgaggtgggaggatcccttgagcccaggagattgaggctgcagggagctgtcatcccaccaccgcactgcagcctggtgggcaacagaatgagaccctgcctcaaaaaaaagctaaatggaaatgacttaagaaaactgtttcaactgcagtattttttttaaggaatgggcagatgtgcccattcttgagtctgtgaggttttatgtgtagacatcagggtggctaaaagtcaagtgaaaagccgccccttgaaaatagagcaacgtgtgtgggagcctaggaggcagctgtccctgaagcaaggcgccacccctcctccctgcacccgtgtccttcctcccacacgccaggggccaggggtggtggctgggctttcatatggctgccccgaactctggggaagtgctctgattttgttctcagcaaactggtttctctactgatttattcatatttctttctttctttcttttttgagacggagttttggtcttgttgcccaggctggagggcagtggtgcgatctcggttcactgcaacctctgcctcctgggttcaagagattctcctgcctcagcctccctagtagctgggattacaggtgcctaccaccacgcccagctaatttttttgtaattttagtagagatggggtttcactatgttggcccggctggtcttgaactcctgacctcaggcgatctgcccgcctcagcctcccaaagtgctgggattacaggcatgagccaccgtgcctggctcatttatttataattcttaaaaacacaaccacccttccccctacaaactgcctctattaacatactttaagttctttaagacatttatttactaagaagtggtttgggtagaaaaggggctctgctgacctgccaccttcgctgtgatgagtttctgtgtagcagggacagcgaggcacggtttggatgaggacaagatgtttgttaccctacaaccagggagggtgtcgggtgacaccctgggctcagaccccgcgctcagcacccgtctcccaccgtgggctgccacagaagctacaaggcaccgggtcaaggccaagcaaatgaaacacgtaatgatagctctgtctttctaatttccccctattagaagaaagaacgtgaaataattctttatgggctcagtccctaccgtgtggggcagacctgctctgggtgatgaaagcagtttccctgcctcccttcaggaagtagagaagccgggtgcctggttccagccaaacgctgggccagccagctcagtcagtggggcctgtgccggcatgcctcgccgcgctccctggttctgaaggcgtgagaacctctgcaagtcaggttcccatgattgtataggatgtgttacggcagggatctgaaagctgatgatttcatcactagctggaagcatcaggatcgaaacgatgacagttgcaaaatgttcatcaagtgagagctgcgtcctcgcgagaccgaaacgccgcctctagcacctgaaacacaagccctcagaggagcagatgattccctcaggatttaagaaaattgaggacttcagttttcgaagccgcattatttcacattgctgatacctctagcgcctgaaacacaagcgctcagaggagcaaatgattccctcaggatttaagaaaatgaggacttcagttttcgaagcagcattatttcacattgctgatacttttaggcaaaaaaaaaaacaaaacaaaacaaaaccaaaaaacaaaaaaacaaaaaaacccacaaaacccgtgttggttagattttctcaaaagctttacaacaggcaggttacgtgtaagctctgctgttgcccaaaatagtaattagggaaataattgcttttaaatgaatatgtctgttttctagtcagatttgcccttttgttctttgatcagttagttcacgtaagcgggtgtggcagggaggaagcccctggtggtgagagtgtttggagctcaattgctcgaagggaattggtgtcgatatggagtctcgggcagtggttttagtaaccttggataaaccgacctctcaggcttgcacaatttgctaattaaaacagggagcacagctgcttcagttgtaagccgggcgtaggtcacctgatctgtaaaactacaatagtgtcagagaagtaagtgggataacattgttgctttggtaagctttcaaatgatgatgatgtcagcctgtgagttctgtgtcctgcttaagtgaggtttataaggatgaagaaaccaaacccgacggccagtacctcaggctgtcacagctgtctgtgggcacagcgtttgaaatagtctctgtgtggtcagtttctaccagcccgactttgtactctggcagctgctggtgttaaatattcccaaaagagtatgttgttgcccaaacagtgtaacccagaaatctagctgtttacagtaatttggatttgtatttagaggtgcagtttttctctagaggggataaagaagtgcggagcgtctttctctcctgggggaggtgtgtttccattttagttaataacatgcccggagagctgtctgtctgtctgttaataaagcagagtctcattcattatctgctttcatttgagaactgcagtgctagcgtgttttacagtgaagacctcggtgtgatcctgaaggagggtttcatcctcctctcatttcccactggatcggcaggaagcgttagcagggtggacatgccacagagcttccagatctggatcaaaggtggctgttgctgaaatacttatgcagagtcttccctgactgctgctggctaatgtgtgccctcttctccaacacacctcctccgagcctggcctggcacaaagccttctttctccaagttatttcagatcaagcagccaatgtagacagtgtctacactaaagggcgtaagaacagtggggtgcagtggcttcaaacatgctcaggatccagctgagctttcaccaggcttttcttgccatatttacagatgccactctgtgcctttctaaatattttaaatgttgtgtgctcagccgatgcacttggcttctggaaagtgcgctgagctgagagctcgcttctcttcctgctcaacgtgcactgggccgggtgttggggcgtagctgcccacacagacagtgctttgaagagtgagtggtttcggttggccatggggttgtgtctaaattgccaatatactgtctttccaaaggttcctaagtgtggacagttaatgcagcagacagttgttagggtaatagtgagaagttgggatgcttaacaagcttctaaggagtttgaactttgaaaaatagacaagagaaagagttcttaaaaaaaaaaactttgataggacacagcggaagtaattacagtttaactttatgggacgtttctgtgacaggctgggtaactatgcttgtcatgcgtcctaacctgtgccctgagattgtgctgtaatgttccttttggtggtgtccagctgtctggcaaggagcctgctcggctggagcattgtgaagggcatgctgtaattacaatattgtgatgtggcgttgttgcataactcaaggacacaccattgtcgcctacccactgtgatgtcgcaagaacgagatttgtgagttttactccaattgagcttttccagtgattgactgccactccctcccagcctttcggttctttaaaatgaaagataaacctcaggacaaccaagacctggggaaaagacagtctttgggaatgtaatttggaagaatggatccagaaaaacaaccaggggctcttaactctagtttcggcaggagatcccgagttacagacctgagctcgtaaacaaacgctcaccactttacagtcgccgcctcatcctgaaactccggtcagaaatgctggaaggcctttgctaatgcgcagtgaaaattaggggcacagatgtggacggactgtgcttggtcagtaattgttctcctccaaatcaagtttatgagaaatttcatataaggaaaaaaacccttttgtatctgtgtctatatgtacagaagaccttaacaaccaaacagaaacttaacccctttggtttggttttgttttcgaaagcttatgcccaattttaaacttcatgtaagcttatgtacttattttaaactttaaaactattaaaagttaaactagatagtaaattcggcactgtctaatgtgcatacaccacaaacatataaccctaaattcagctgtgtctaatgtgtatacaccacacatatatataaccctaaattcagcctgatgtacttataccacacatatataaccctaaattcagcctaatgtacatataccacacacacatatatataaccctaaattcagcctaatgtacatacaccacacatatatataaccctaaattcagccctaatgtacatacaccacacatatataaccctaaattcagcctaatgtacatacaccacacatatatataaccctaaattcagccctaatgtacatacaccacacatataaccctaaattcaccctaatgtacatacaccacacatatatatatgacccttacctcttgttagcatttattgtagtttgtttttgaggttaggagcagttaagcaataatatgaatttgtgttggtttaacttttatgaattttagggcagaacaaggagttaatttccagataagcttgttcatgttcttagaataaagtgtcagcctcattagaagttttgtaatcgtggtctgcatcccagccatgcacctgctgggtcctgagtaatcctcggagcccagagcaaggcagagcagacacggagcaaacgctgcgttcagctgggtattttagatacgtctgagaagagttttaaaataaaacttgaatttgaaaagaaatagtgagtacttaccagaggtgggcagtgctgggatgtggccggtcttggtgccggtggctggcggtgctcaggaagcagtacctgttctcacgcttgctgggtgaaactggagcctgctgttccagtgggagggatttaagtgtaggagttgagccctcggggcgtagagatgcacctgatattcctcctgcccgcagctacgattcatgtgtttgcacccaccgagctgctgcgggcagcctccccagcactggacccagcaagcaagttatctcgccgactcccagcgctgtctccagactcaactgtctgtgagtgcggcgtcggtgctgcctggacggccatatgtcagagggctttcgatgtgtccgcagttagaatagagattactatattcatcagaatcacacccgatgaatatttggcgtcatgataaagacatgtgagactttcctttagaacttgagcatgtgtacgcaggaggcaaacacttggattgattctcaagcgcgcataccctgggaggcacagtattcatggcgtccttgccatgaggtccagtgaggcctttgaggatctgtggaccttccaccctctaccctgctcctgagagtctctgtccctggtcctcctcaggagctgagccggcagggagggagcttatcccagagcctggctgcagggacctgccggagcttgcccgacaccaggcaccgcaagagctgcggagcagggtgtgtgggtgcgggggagggggccagctgtgcactcccgcaaaccaccctccccccactttaaattgcagaggcacttaacttgggggccagtttttacctccacacccccccaccaaaactgcttgcttgcttaatcggaggccgcaccccagttgtagcgaaggctggcatgtggtgtcggtttgaggactgggaaaggaggtgggatgagctggtgtcaggcccttggatgagcctgaggctgcagggcagaggctgcagggctgtggcatagggacgagctggccaggacagacaaactggtttttttttttttttttttttttttttttgagacagagtttcactgttgctgcccaggctggagtgcaatggcatgatcttggctcactgcgtttctcctgcctcagcctcccgagtagctgggactacaggcgcctgccaccacgcccggctaattttttgtatttttagtagagatggggtttcaccgtgttagccaggatggtcttgatctcctgaccttgtgatccacccacgtcggcctcccaaagtgcttggattacaggtgtgagccactgcacccggtctgtttttttgtttttgttatttttttccttaagacttaagattttacatggctttgcgtttacttttatatttaattccttttttttttcttttgagacagggtcttgccctgtcacccaagctggagtgcagtggtgcgatcacggttcactgtagcctcaacctcctggactcgagtgatcctcccgcctcagtctccccagtagctgggactacaggcacggtcactatgcctggagaattttttgtagagacagggttttgccatgtttcctaggatggtttaataccttaaaattttttttggtggcttttgtccattgagacatccatatactttatgaagtcaaaaagagttatgtaagtcttatgacaaaaaacagcagttccctgtccctcttacctattcctggatagcaaactatcccaaacttagtggcttaaaacaagcaccgttttattacgtcttaggatatattgtgtcaggagtttgtggagggcctggccgagtgctgcttctgtttcatggacactgactgaggtggctccgtgggagaaagctggcaggtgactggtctggagggtccaggacagctttactcacctgccttctgtcctggaggggcagctggaatcctgagatcagctggaacctcatcctcacttagtagcacttcagaggcctccctagcagggtggtcagctgtatgatggctcaggacttcaagagagcaaggcggaaggttccagtcctccagaaggctgggccgcagattgtcagggtgtcccttctgtcacctttctctgctgaggcagcctcgtgctgcccagatgcaaggcgggagccgagggctccacctctcagcggcaggagtgccaggtgtctgcgctacgactccctctgcccggaagccccaccttggcctttcctaagctgagtgttctgacccttgccatggagggtccagtgaggcctttgagaatctgtgtaccttccaccctctaccctgctcctgagagtctctgtccctggtcctccttgggagctgagacggcagggagggagcttatcccagcgcctggctgggtgtttacctcctcgattccagccttactgatctgttggtggttctgtgccctctctccccctctctcccttctccactcctggtcgaggtgttgtttggtggcttcccttcatggaagatgggaatttgcctctctttgccccttctgcccccatgtctgccttccccgtcacccagggggttttgcctgcctctctcttgcactggaaggcctgctgctcggatcccatgtcgtctttctcttgagttaatcatttagtttgacatgaggcacacaccttttataggctcttgagaaagtgcaagagagatttttttggaggtcttgaattattgaaaatgtttttatctactcttcaacctcactgatagtttggctgagtctagaatttcaggccagaaatcatttaccttcagatttttgcaagtgttcttcattttctttctttcttttttttttttttttttgagatggaatctcgctctgtcacccaggctggagtgcagtggcgcgatctcggctcactgcaaactccacctcccatgttcacgccattctcttgcctcagcctcccaagtagctgggactacaggcgccctccaccacgtccggctgattttttgtatttttagtagagacggggtttcaccgtgttagccaggatggtctcgatctcctgacctcgtgatccgcccgcctcggcctcccaaagtgctaggattacaggtgtgagccaccacacccggccgcaagtgttctctattttctctagcttctagtactgtggttgagaaccttgatgccattctgattcctgattctttctctcttaacattttagtgtgaaaattttcaaaatacagacaagttgtaaggatgctccagtgaactctcatatgcccaacggtggggttctccagttaacacagctgtctgtgttcccttcccttcccctccctgtccagcttacttacccttcccttcccctcccctcccctccccgtccagcttacatacccttcccttcccctcgccgtccagcttacttatcattcccttcccctccccgtccagcttatatacccttcctttcccctccccatccagcttacatacccttcccttcccctccccgtccagcttacttacccttcccttcccctcaccatccagcttacttacccttcccttcccctcaccatccagcttacttacccttcccttcccctccccgtccagcttacttacccttcccttcccctccccgtccagcttacttacccttcccttcccctccccatccagcttaatcgtcttgctgcatttcaggtcagttgcagacatcagtatgctttgccccaaacacttttcaggcatattcttattagtttatgattcttctttcaaaggtaaggtttacattcagtgaagggcacaggtcttaagaggatcatttaacgagttttgacaaatgtgttctcccattatggccccagagagttccgtcacagcagtgccacccttccccacccagaccgtggcaactgcaggctgatacttttccaccatggattagttttatgtgttgtagaattttatgtcagtagtgattcctgatttttatggacagctgtttctcacctgcaggttctttcctttatcctcagtagtcttagttttcttaactttatatttcaacacttctgttaagtacttggtttctgattttggtttccatgagctctgttttgttctgagtgttccttttgtagcatctcattctcatgcagtactttcagtagcttttcttatctaaggattttagtgatagctttcttttagtggggagtggaggagtgggggtggatgttctccgtgtgtgtgtgtgtgtgtgtgtgtgtgtgtttaaagacctggggtcttgctgtgttacccaggctggacttgaactccgggtctcaagtgcttctcctgcctcagcctcccgggtagctgggactgcaggagcgccatgccatgcctggtgccctccctgcatcgtcagtgtggctgcctgccttccagggcctctgctgagcacctcggagagtcagccctgtctcctgccccagtgctccttgggttaggcctaccctgcccctccccacagagttctctggtgccacagatctggagctttttagggacctgtcctgtggatcagggggagtctgagttgcctccctccaggggagggctgggcttcttggtctgaggcatttcctgctgtccctgcacttccaggctcctccgtggtcctggtgctgccttccctgcccttcctcttctaccctgtagcttatttcttgaaaaaagaaaatggtccgtttctgctgtttttagtgggattttacccgctattttttacatgttcaaccccctgtgttactcagaattcttgcgattaggtttttgaccaaatcttaggaaccgtcatgggggtggcagctgatgtttcttgcgtgttgatggtgtggggcaccgtgccaggtgcatcacctgcactggtccatttactcagaagcaccacgcacctggcctgtggagtccccccacccacaggtcgggaacatggccgaggtacccagcccagagggcgatgagcagagttacaccagaggtggggggtgcttccctgggtggggaaggaggggtacctggggtggtggctgctcttgggggtaagcaccggtgccagtgtgtgttggggggtgccagggacccaggcaggtgctggcgccgcggcctctgtgtcagggcctctttccctaggggcacacaggctggaagtgcagtcctggttgagctttcctagtttccaggtcgggggtgaggcacaggacatggccggctcggccccttcctctccatcctgtccagctcagccccttcctgtccatcttgtgcggcccagccccttcctctccgtccatcctgtccggcctggccccttcctctctgtcctgtctggcctggccccttcctctctgtccatcctgtctggctcggccccttcctctccgtcctgtccagcttggccccttcctctccatcttgtccggcccggccccttcctctccatctcgtctggcccggccccttcctctccgtctgtcctgtccggcccggccccttcctctccgtcctgtccagctcagccccttcctgtccatcttgtgtggcccagccccttcctctccgtctgtcctgtctggcctggccccttgctctccctccgtcctgtccggctcagccctttcctctccgtcctgcccagcccaccccggtcccttccgcagcagcatcctctccagtgcactgtgtgctgggactcaagtcttggctcttccatcttcaccctttgtgacttggggcagcaattgctgacctccctgggcctcggtcttcctgtccgtgaaagggacttgtgagcatctctcacagaacacctgtgatgaaggaagggcgtcacatcttggatcttcttaaaatacaagattgtttctgttttaatcctttgtgttccttgtgaggtgctgcatccagaggaaaggagaaaggaaatgaaaactctgcggaaaatccacaggcctggcatcagcctcccagtctgattttgacgcggctgtaggggagacacagcaacattctatcccccgagggcacagcttcaggaacggctccgggccggagggcacctctcgcctggctgtgttgtgtctcagggctctgcgcttctaaagggactcaggccagtgggcagaactgtgggatgggactgggaggcttagggggtgagggtgtaagccctgtgcctccctccacgtgctgcgtccggcatgccacgtcccctcgtccagccctctgctgccccctccacgcgctgcgtcctctgtgctgtgtcctcttgtccagccctctgctgccccctccacgtgctgcgtccagcgtgccgtgtcctctcgtccagccctctgctgccccctccatgcgctgtgtcccatgtgccgtgtcctctcgtccagccctctgctgcccgctgctctctttgggacttccattgtttccccttccccttcctttcctggttttcttccctagtgaggtgcccttcctgctgctgcagggccctgctgtggcctctgccttccgtccctggcggtagtgagactggctgagacccaggggaagcttggagactgtcctagatttcggagatggtggtacacaggcttgctggcttgggttagggctctaggccctgccttcgggttgtctggaagccgccagccaggcctggacacctctctgcccccgtcacctcggagcagcagcccaggagcgggtcacagcccttcccctgtgttacatggtcacctgcctgagaacccctgcaggcccctgtgttttgggaagttgatttaactgaacagagcgcagctgagaaggggcgcctccctccccacccaccctcattgcctgggaccgcgtgtccaggagccgggcctcgggtgtctggtctctgggccacacaggctaacatggccaagcccagctgcacccccggggtcctcacccgccatgtgcctgtggtcgtggccaaggtctgggcccaacctgctctgggcgctgtgggcaccgctcagccattttctacaggtggccgaggagacatttggtttctcattaaaaagaaacaggccgggcgtggtggctcacgcctgtaatcccagcactttgggaggccaaggtgggcggatcatgaggtcaggagatcgagaccatcttgtctaacacagtgaaaccccgtctctactaaaaatacacaaaaaattagctgggcgtggtggtgggtgcctgtaatcccaactactcgggaggctgaggcaggagaatggtgtgaacctgggaggcggagcttgcagtgagccgagatcatgccactgtattccagcctgggcaacagagcgagactccatgtcaaagaaaaaaaaaaaaaaaaaaaaaaagaaacaaccctgagaacatcagtggggttttactgactgtgtcagacaactcagcgatgcagagaaatgaaagtggagttgatttggctcttgtggtgagatacagccaaggtgtatgagagaatttggggaaagctttctttctggacatttgttgacgttgatgagtagtggagggctttatttgtaagttgaagtctgagatttgtcatgccaatacctaaattttaatttgtttgtacaaataacgccacaatttaattcttttttctttttgagacagagtcttgctctgtcacccaggctggagtgcagtagtgcgatctccgcctcccgagttcaagtcattctcctgcctcagcctcccgaatagctgggatcacagttgcgtggtaccacgcctggctagtattttgtatttttagtagagatggggtttcatcatgttagccaggatggtcttgatctcctgacctcgtgatccaccctcctcggcctcccaaagtgctgggattactgggattacaggcgtgagccaccgggccgggcccacgatttgaatttttatggaactggggctaacttaattttttcagacgagtgggagtagagcaaacggcccctgtctgttgcccctttttcctaccaaggcccctccaggctgtctcttgcctggtgagtgtgaggagatgggtgggcgcggccctgtgggatggtgctctgtggcagggctggcagtttctgggtgtgtggcctgtgggtagcctttgtactgggcgcacagtccccggctcctcccttccaacaccttcgccctgagcggcctcggaaatggggcttctggcggctctgcaggcaccgtcagagtcagagggagggcgagcggcttttggtttctgtttaaacagcgtcctgtcgctccctcctctcctgtgcggattggcgctgcggcttctgtgttgagagggaaacttgaaaccctgagctatgtatggcttgttttgtctttgattgggaaacccaattcaggtttgtgaacttgggccaagtttaagaattcccacagttttcttcagctcctctcctccctgaaccccgacagcgaggtgtcttacgcttcggcattctcactcgcctgactcagacttgttagttttccagagcaactcatgtggccgccgtctagggagtttattcagagggtgcctctacatgcacagcagccaggtacagaagtcatgagttaaatcgcacaaggacaagtaaaatgaaaaaaattagcactcagatcttcttttttttcatgctacaaaataacagtgaaaaacctaacgatgaaaatagatgcgaacagacaaaaggtcaatgggcttgatcccttctcatcctctctcctgtgtctcctggaggcttctgcacctctgtgtcttcccccgctctgctgcgtcttctccacctcgatgtccccctctgcctgctgcgtcttctccacctcgatgtccccctctgcctgctgcgtcttctccacctcgatgtccccctctgcctgctgcgtcttctccacctcgatgtccccctctgtctgctgcgtcttctccacctcgatgtccccctctgcctgctgcgtcttctccacctcgatgtccccctctgcctgctgcgtcttctccacctcgatgtccccctctgcctgctgcgtcttctcacctcgatgtccccctctgcctgctgcgtcttctccacctcgatgttcccctctgcctgctgcgtcttctccatctcgatgtccccctctgcctgctgcgtcttctcacctcgatgtccccctctgcctgctgcgtcttctccacctcaatgtcccccgctctgctgcgtcttctccacctcgatgtccccctctgcctgctgcgtcttctccacctcgatgtccccctctgtctgctgcgtcggggctgcctaccgggcttggtcttcagggccactgtttctcctcagctaagtcctgagagtcacatttccatccattgcagtgaaatcttttccttcaggtatttccagaccttggttttggccccttttcatatcttccttgtttcctcgctgtggttttcatttcccctttcgtctccttaacctgttttttgatggtgtctttttaggttatctcaagttcatttcaagctctgaaagtaggaagtaaagtaagaaccgcgtggcactagcaatcactaggcattgttccaagcacacggataaactgagaatcctcgtggtcgccccgggggtgggactgccattgtccagagagacctgcttttgcctgtggtgccacacgggtccctctcacaggatgcgaccatggtggctttgcgtcatgtcacctcagccaggcaggaccttctgctggaacccccttccctggtagtcctcggagagggctgtgcacaatctggaggcagaagcgaagcagtagcccccgtgcgcggcagctcttgaggctgtgctgctgttggctgtgctgttgttggctgtgctgttgttggctgttttgctgttggctgtgctgttgttgcctgtgctgctgttggctgtgctgctgttggctgtgctgctgttggctgtgctgctgttggctgtgctgttgttggctgtgctgttgttggctgtgctgttgttggctgtgctgctgttggctgtgctgtgctgctgttggctgtgctgctgttggctgtgctgctgttggctgtgttgttgttggctgtgctgttgttggctgtgctgttgttgcctgtgctgctgttggctgtgctgctgttggctgtgctgttgttggctgtgctgctgttggctgtgctgctgttggctgtgctgttgttggctgtgttgttgttggctgtgctgctgttggctgtgctgttgttggctgtgctcttctgctgttggctgtgctgttgttggctgtgctgttgttggctgtcctgttgttggctgtcctgttgttggctgtgctgttgttggctgtgctgttgttggctgtgctgttggctgtgctgttgttggctgtgctgttttgctgttggctgtgctgttgttggctgtgctgttgttggctgtgctgttttgctgttggctgtgctgttgttggctgtgctgttgttagctgtgctgttgttggctgtgctgttgttggctgtgctgctgttggctgtcctgttgttggctgtgctgttgttggctgtgctgttttgctgttggctgtgctgttgttggctgtgctgttgttggttgtgtgtgctgaccccggaccccctacagtatggctgtgcatggactggtgatttggcccccatggcctcatcagccctgatccatccctgcattgaattcgtatggggcttgtggtgagtctggactgactcagctttctaaaagctgaaaagcaaaagttaataggtctgcagagataaatggacagacccggtatcctcctgagagctcaaaacacctcccaattattgataactaaatatgtagtggagatatagatatgtataaaacgcacattacatactgtgtgtgcacatacaatatttcaacagcagaggcgactggcatgattccataattgatacagaaccgtgtagctagccgttggagaatacacatttgtaggcacctgaggaacattcacagatattacacagccaggccataaaacaagtctcgagacatttcagagactcactggcggacagatggtattccatgctcacaaagtaatgaaattaaaaactggatacagaataataaaggaaaggtgataatttttagttagaagatatacaaatgtgtaaatcacatgagtcaagtctcaggaggttttaaaataaaaagttaaaaaagtttaaaaataaaaataaacagtcacaaaattattctatctaaaattttgggatgcagctaaggaaacttaaacctttaaacaggtgtgacgaaattgtggcctgcaggcccagtggggcctcagcctgtttctgtacagctttggagccaagaagggttttcacattttaaaaatgttatcaatgagaataaacacaaccaagcagagtctgcgatgtggactgcatgtggcccacagggcccgaggttctctctggccctggcaggaatcacttggtgactcggcctcagacacgtgtacagaaaaggagaaaggttcactctgcacagggcgggtgggaagagggcagtgagcagaaccctagaaatgaaggaggtggaagacaaagatgagagaggacacacagagccaaacgcagctcttcgagagggctgatgggaccaataaacgcgtggccgacgggcagaaagcaggagccttacacacggaagggagccctcgtgcagccaccgtggagatggaaaatggcatgttaagaatatcttttgccaggaaatttggtagcttaggcaaaatagacgttccgagagaaatgtaatttatcaaagttgacccaggtgggaatagaaaagtgactcctcactgcttcagcgcatctgcttgtaagcgggaacgattactgttgaccccataggatttttaatgattttgttgagacgcaattcacatgccattcagttctgtcattaagtgtacagttcagtggcttgtaacgcatttgcagagttttgcagccatcgccacagtcagttgtagaacattttaccccacgctccttcgctgtcatccccaacccccccgacagatggataaaccccccctcctagacaccacagatgggttctctgtgtctacccattctggacatttcctgtgaatggaaccgtgccccctgtggtcctctgtggtggctccttgccccgagcgtggcgttggcgtggtccgtgggcgatgcagcccccagcagtgctccttttcttttccttgttgaagcctgttccatcgtgtggcatcttagtcagctcaggctgtggaaacaagtcaccacagatgggggctcaagcagcacaaatgtatccctcacagttctggaggctgggtgtccaaggtcgaggtgccagcaggctcggcagcaggctcggtttcttccgggttttcctgggcctgcaggcgctgccttcctgctgcgtgctcgccgttcggtctgtgtcttggtgtccttgtttcctcttcttaggcggacactggtcatagcagatccgggccccacttgcgtggcctcattttaccttacgcatctctaagggccacatctccagatacaggcactcgggggcactggggttaagacttcagtatgtggatttcagggagacagaattcagcccacgacgtacatggaggccgcattttatttatccatctgtcagttggtagacgtttgggttgtttcccactgtaggctgctgtgaataaagcattcgtgtgtgagtttttgtgtggatgtggtttttgtcttgggtataggcctgggcttggagcataggactgttcggaaagttaagggaatgaacgtattcagagctcagaaccgtgtctggcttgcgatgcgttctgttttgaggttagtgatgatgatggagagcggctcccgaggacgagagctcgtgatggagagtgcctctttatgcccgatgtgaatgtggctactcagctttctctctctctttttttttaaattaatttattttgtcgagacaggttcttgctctgttgcccaggctggagtgcagtggtgtgatcatagctcactgcatccttgacctcttgggcgcaagtgatcctctgacctcagcctcctgagtagctggaaccacaggcatgtgccaccacgcccagctaattgtcgtattttttttctttttctttttttgtaagggtagggttttgccatgtagctggtctcaaagtcctgggcttaagcagtccacctgtctcagcttcctaaggtgctgggattacaggcttgagccactgcatccagcaacaccccccctccttttttttttctgtttttgagtcagggtcttgctctgttgcccaggctggagtgcagtggctcactcacggctcactgtagctttgaactcatgggctagatccatcccctgacctcagcctcacaagtagctgagactacaggtgtttgccagcacacccagctcattttttctttttttttttgtagagacggtctcaccatctagcccaggttggtcttgaactcctcgcctcaaatgatcctctcatcttggcctcccaaagtattgcgattacaggcatgagccactgttaatggccccagctttctttgggttcgtgttttctcagtgtattcttttctgtcttttaatttttttatattcttgcattttagatgtatgttgagtaaaaatctaccgtatgtgattttaagctggtgagtttagtccatttactttactgacatgtttgggtgtctttgtcttattatatgaattttgctttttcagatttttttttgtttttaaaagttgtggttcctattgggcccccaacccagtcccattccacatcttcttccttgttggtttggaatcatctattctgtttcctgtgtttcttcaggggtcgtattcagcttgtaccacgaatattcagagccaacagccagcttcttagcctaccctccaagtaacacacagcacaccctgacctcgatcactttccatctgacatatttgacattgttgagtttttagttcttcttgtttaacattagacattacaggttgagcaccctgaatccgaaaatccaaaaccgaaaactttttgaatgctgagttgacactctgcaggtgatgggctgcagtcaaaacacaggtaaacaacacacagttgattcagcaccccaaggggaaaaagatcctcccagcccccttcagctttgataaatcctttccacataagaccaggttccctcatgcaagcacgtccacaaagggcgatgaaatgtcgggtgcaggccggacgcaggcgctgcaggctccttatgaggctccacatgggcgagacctgtgcgcaccgctcgtgtgtttgcgtatcctctgctctgtggtgtacagatactgttgaaaacatcagaaaggcctgcaggttacttgtatgggggtgtacagatactgttgaaaatgtcagaaaggcctgcaggttacttgtatgggtaacagtggtcagaaaaggggcaagcattcacgtttgcatgtcgcacagaaagtcagactgctggggggagctgggcagcagtgtaagagcacggtgctggagtgagtgccagagatgacctaagaaacaggaggaatggttgacgttctgtgctggaaacgatgaccagaaaaaccctgcacaaagctacacgtgaaatttctatcacgtattgaaagagtggatctgtcagcatcgcagtggacacaagccacttaacagtgccaatcacaagacaagcaaagctctgtgtaaaggccctgatcgcattcatgaagctctgtccttgggactcatcatctacgaaaggccacacctcctaacaccgtgctcttgggagtgaggatttcagcaggaattctggggaacagaagcattggggcgtcgcatctccctgtggccttcctccctgtggccttcctccgcctgccagctgccccctcaccctgctgtccacctcacggacccctcttcgccccatatgggccactttggcccccaccaccccttcctggatgtgcagaccctatgcggtgccacctgatgcttcaagactgaattttccagaggggcagggaaaggtgtttgcttttttttttttttttttttttttttttttttttttaattttttagagccagggtcactctgttgctcacgctggagtgagtgccatggtgtagtcgcggctcactgcagtcttggcctcctggactaaagcgatccttccacctcagcctcccaagtcactgtggcactatgggtgcatgctaccgtgcccggctaattttttttatcttttgaagagatgggatctcactatgttgcccaggctggtcacgaactcctgggctcacgtgatctactcacctcggcctcctgaagggctgggattacaggtgtgagccactgtgcctggccaggtgtttgctcttaaaaagtcatttctctctttctgtgtgtatttgtgttttgaggtaaaatttcacataacataaaaataaccattaactttaaagtgaaaaactcagagcatttagtacatacccaatgttgcacagctattacttctgtctacttttaacacatttttgtcaccgaaaaaatactctggtgtccattcacatagtcatgacacatcacgacacatgactgtattcccaacccctggcacctgccaggctgttttctgcctctacgtttacttattctgagaattttatacacatggagtctgcaatgcgtgaccctttgtgcctggttcatctgtattgtagcatgtgtcaggccttcatttgtttttatggctgaataatattgctttgtatgggtagactccccccccactttttttttttttttttttttttttgtagagacagggtctcaccatctagcccaggttggtcttgaactcctggcctcaaatgatcctctcatcttggcctcccaaagtattgtgattacaggcatgagcctgaatctgaaaaagcaaaattcatatagtaagacaaagacacccaaacatgtcagtgaagtaaatggactaaactcaccagcttaaaatcatatggtagaattttactcaacatacatctaaaatgcaagaatataaaaagattaaaaggaaagacagaaaagaatatgctgagaaaacactaaccaaaagaaagctggggccagtaacagtggcttaatgcctgtaatcacaatactttgggaggccaagatgagaggatcatttgaggcgaggagttcaagaccaacctgggctagatggtgagaccctgtctctacaaagaaaaaaagaaaaaaaacagacgccccaatgcttgcgttccccaaaattcctgctgaaatcctgactcccaagggcacagtgttaggtgtggcctttcgtagatgatgagtcacagggacagagcttgatgaatgctatcagggcccttacacagttgacggacacttaagttttcccaccttttggcccttgtgaagaatgcttctgtgaacgtttgcgtacaagtgtctgtttgaatccctgtcttccccttttttgggtgcgcatccagggcgggatcgctggaccgcgtgcggaccctcgctgcgcatccagggcgggatcgctggaccgcgtgcggaccctcgctgcgcatccagggcgggatcgctggaccgcgtgcggaccctcggtgcgcatccagggcgggatcgctggaccgcgtgcggaccctcgctgcgcatccagggcgggatcgctggaccgcgtgcggaccctcggtgcgcatccagggcgggatcgctggaccgcgtgcggaccctcggtgcgcatccagggcgggatcgctggaccgcgtgcggaccctcggtgtgttactgaggcgtccccaagctgtttccacagacgctgtgctgccctgcattcccaccagcaaggcgcagagcttctggtttctccatgtcctcaccaacacctgtgttgttcttttttaaaaaattataatcagcctcgtaggtgtgagggggtatcttgtgattttgatttgaatttttcttaatgacgaatgacactgagcatcttttcatgtgctccttggttgtttgtgtatttctctggataaatgtctagtcaagtcctttgaccatttttaaattggattgtttgtccttttgttgttgagttgtaaagctgtttgtatcttctggatattaaactcttatcagatatatcatttgcaagtattttctcccattctgttggttgtctttttttttcttttgataatgtctttgtattgtgtcgtgtttaatgtaaacatttcaccattgttttaattccctcttttcagttcttttctgtgtgtgtgcagtttttgggtgtgtgtgatgtgtacatacacacatgcacatatacaggtgtctaaaaagtattttgtttttttgttttaaatatttgacacttttaaattggagttgagattctgtatggagtaacgtattgttgaatgacaggaaagtatgaagcttgtcggagtgttattacttggcatagccacaggagccatacaaatgatacaaccttgctgcttgtgtctcatggtttttttttttttttaatttaatttaatttttttttcattttttttttaaattatactttaagttttagggtacatgtgcacattgtgcaggttagttacatatgtatacatgtgccatgctgctgcactgcacccactaactcgtcatctagcattattttaatttgttttagttttttttttgaaaaagggtcttgctgtgtcactcaggcaggagtacagtggtatgatcacagctcaccgcagccttgacctcccaggctcaagcgatcctcctgcttcagcctcccaagtagctggtgctacaggggcacaccatcatacctggctaacttttgtatttttttgtagagatgggatctccctatgttgtccaggctggtctcgaactcctgggctcaagtgatcctcccgcctcagcctccctaaatgctgggattacgaacatgagccactgtgcccagccagcctttgttgtttttgaaagttgaaattcatgtttttggatcaaagctaagctgtgacatataaacatgaagtgatctagttaggtttggttatacaccatgtgcagaaagcaacctcttcatgaatcttttaatgaacatctttctacctggaagaaaccctttacctactaaacttactttcacaccttcctaattttgttgtcttccgtgtttttgctagctccaggcctattcggcatttaaaataaaatgcaggttggccagtctggctgggcagttctacaggtactacggctggaggatcccagttgacttgaaattcaggttttgcttgtgaaagtagctggctggggcttctgttgatgacagtgctgtgtggacggcctggttcgctgggtgtgcctcacagacacaggacactttttagggttgcttttgaatgtgcctgaggtgaggttcctgtgttttccttgtacttaccttcatattttctgaccctcctgtggatggaaaatcgactgagtgtgtgaagggcctgtcggtgtgaacgggccctgctcagccggtccatggctgtcttaggatcccgcttggtggcgaggagggtgcggctcgtgggtggctgcctggggctaccccgtgtagacttgctgggactttgtctagacaagagaactgctgtcagtggcgcttcctgcggggggatgagtgcggctctcagcgcctctgtggggctgggggtcttgggccgtgaggccggggccaggctgcgtggcaaccctgagtcccaccctcattgtctttgctcggggccccgagaggccatggggagcctgccggctctgtgtcctccccgcactggcttttagggaaagagagtctcgtgggtcatccggcctgccggctctgtgtcctccctacactgacacactggctttcagggaaggggagtcttgtgggtcgtctggcctgccggctctgtgtcctccccgcactggctttcagggaaagagagtctcgtgggtcgtctggcctgccggctctgtgtcctccctacactgacacactggctttcagagaaagggagtctcgtgggtcgtctggcctgccggctctgtgtcctccctacactgacacactggctttcagggaaagggagtcttgtgggtcgtctggcctgccggctctgtgtcctccccgcactggctttcagggaaagagagtctcgtgggtcgtctggcctgccagctctgtgtcctccctacactcacacactggctttcagggagattgggccttgtgtgtcctgttgggtgagcagacacacaagctgtgacttcagggctacggaagttgctctgtggtttccggcactgcagactccaagtgtgagccctgtagtgaggacaaagagtggaggttggagttcagaattgtggacaggctcctgaggaccagcagaggctggaggccagggcttgcccgccgggagtgtggctgtggaaagattccagtccacagtgggggctgctgcccagactcaccctgaataaagtgtcttcagagccacctgtcctgcctgttcatggcagtgacccagaaagattcatcagtgggcggtgagttgggaacagaaagaaaacccttgagataactgggttggagacagggagcaggcttgtcattgtgcactggtgacatggcctttggcctccccagccgtctggcctgggcctcgtggtcctgctcttgggcttcatgtgtccttgggtgtcagctccagcatggcgtcctctgggccctgctgcttctgaagtgcctgtgccagggacactgtcttggggccagtggaggtctgagtatgggggctgggagtcctaggcagtgagtcatggcagaactggcccctgacttcctggttaagcctttaattctcccgaatgcctgtttttgcttctttcaagttgttgtgcttgagccactctgtcattagctgtgggcgttccgagtgccagcgcacagtgttgagcagagcgggtaggagcgccctggcttcagggagggcccccgccccctgcatggcggtcacgctgcgctgagcgtcccctcccctctggtggcctttcgcagtggtggaggggcaggaactgactggctcttttccctgtggtggctgctcgggtggcagtgagcggacagcgagggggacagacacaggtggaaggaaccacggtgggtttcattaacaatgacagtggctcaggagatcctgaggctgattaatttgcaaacagcaattacttgggattgcttgaaaagaaagttctagcttagaacaggaacctgaggagggctggccacactggaatccagtgcccactgtgacagtggagagccagcagacgccactggctttgatggatgatggagagggtcctggtgtcttctgccatttgtggggggtccttgtgtgctgtgtttgcaggcaccatgggtctccctggacggggttcggttccaccccagcgcccttgtcttgtttcatcgcccgtgtccgggctgtgtaagaagcatgtccatttgtcccgagcggagggtctctgccccgcccctgagggaggccaggaggcccttgttggatgctctggcgggcggcactgggacacggccattgcacccggccctggacacagggcggccaccgcatccggccctggacacagggtggccagggacttggcggggggagctcttcagaatctgtcacatgcacgtgaatgctttatggctttggtattcttctgtttaattttagtaaaaccgcggcccgttgcaagaagagtgtgggcgttggcagctttgtcccaggtgctgcagggttggggtggtccctgtcaccgcctgctgctggtgggggtcagctgcacggatgcacggcctcgcaccagcggcagccccagaggccatgcatagggcaggccccggtggtcagggacccacccagtcctgccaggcgttgggcttgggatgtgcggccggctgggggcacacattcatgccgcaggtccccgtgagtctgggccgtgtgcctggcgagccctgaattccacctcacgtcagccgctggttcacgtcagccgctggttcacgtcagctgctggttcacgtcagctgctggtgttgagtgttcgcatgatgcttttctttcttgggggatggatcagtggatggagaaataaagctgtgagggcataaaatcaatgtttgtttatattgataatcatcccttaaactcagatccaggggcgtcaagagacctgagcccggccccggtgtgccgcgcactggccatgtgtccggagagggctgtgattgcggctgtcagccctgtccattggagctgcagcttggtaaatgcacagatggattttgagaaggtttccctctaaagatgtgggagtctttgcacctcaccaagctgtgctggtgtggccgtggcacataccgggctttttacgtctcttctagggagtgagtcggtgggcataggatggctaaggtatgggaattttaatagggaattttctagtaaatggttctgttagtattacagcttattttagaaagtaaggtgctttcatagagaacgtttaaaattattaagaggtagacaattcttttaaaaacctgaaggtcttttttttttttcttttttttgagacagagtctcgctgtcgcccaggctggagtgctggagtgcagtggcgcgatctcggctcactgcaacctccgcctcccaggttcacgccattctcctgcctcagcctcctgagtagctgggactacaggcgcccgccaccttgcccggctaattttttgtatttttagtagagacggggtttcaccgtgttagccaggatggtcttgatctcctgacctcatgatctgcccgcctcagcctcccaaagtgctgggattacaggcgtgagccactgcgcccggccaaaacctgaaggtcttatattgtggtgtgagtttatatttatttccatcattttatatttgtcagatttttatgcaggggggctgcataatgtctccctggagagcctcagcctctgtggaagagttgggtcaggagaagcctctcggcggaggaagccggagggagaagcctctcggtggaggaaccttcacccagagaccagcctgggggtccttggcccagacgggggaggtgggaacatggccttgggttctttcctccttgcagtttgggtgaataatgtgtgatgaggcctaagaggagatttataaagagtataatctctcagtcttagagaaaagtgtttcaaagtatgggttctcagtgtctgtattgaaaaaataaaaaattcagtgaatgggtaggttatttttcgatctgagggttatttctaagcacatgatttatctttagcacgggagggtgatgccccgccatgtctttttagcttagggactgtcttctgccgtgagttggcctctctgcctgtgcacgtgtgttgccggccccggctcagctgtggcagaagtcagtcacctgtggagttatggaagtccaggcggccaccccaggccggggcctcattccgttaagtagggccaggtgtctgtcctctcacgcgtccgaggtggctgccggcgtgcgggtgtgactgtcgatgagagctctgagctgggatatctggtgacggctgcccctgcttggtcttgcggtgtggctggggagaggattactgggtggaatgtagccgtccgccttttgtgttgacctcttgacctcccttttgggaggcttattaatgtcaaaaagtgaagatatgaggatgggatcgtaatttctttgtgttgctttccagtagcccagggaccaagctgtgggaaccaggcctccatgtgctggccccaccgtcctcgtggtgcctgtgtctgtccaggcttagtcctcagatcagctgcttcaccacattggctgcaggctgggtggcagatgcccccaggaggaggagaagcatttcttcccagggctttggcctgtgctgtgtgcctggaacctttaggtgctgtggcttcgcagacccggacgcagcgtggaggccaagcggtgtctgtacaggacccttcagtgatgagggtggccaggctccagccaggtcctagggaaagctctccgagagcgacggcttaagcagttctgaaaaattgcaaatgatctgtgttcttggagaaagaatgggagagaagcactcactcacaataatgttgcacctactgtgtgcgggtagggtgcaggcagtgtggtccagtgtgagcggggagggtgctggttgaggggttagtgctcgggacgcagcctttggacccagtgccctcccaaaactctgctcatcagtgcccctgagctcagcattgacccctggaggaactgggcgccttccctggtctcagactgtaagcctcctcgggaagcagcagttggctcctgatgcagctggcctcagatcctgttgggagagcaggattggtgaggaacctggagaggagtaggaggtgctgcctgatagcagaggtgggtgatgggggcagagagggtagcaggggcccagttcagtcctgtctggttttcacgtggagctttttatagagttgtgcttctcaagcctttcaaatgcctcacagcggcagtccgacgtgcagtcagtgacagctgagtagattaccaccctcaggactaaatgcaaaatcatcttcactgggtgcagcatttacagttttggtgctggaacctcctaaccagtgttcttaggggctgtcttaccagtgaagggagctgcctgctgttgacgctccacaggaggtttgcggcatggctgccatctgtgttgtggcctgggactttcttagagagtgggtaaaagatgagtcatctcttgtgtgatttatcagcttcacttgtgcttccagggctctttgaagcgtctcactttttaatttcatgaagaaacaaatgtagtgcagagaacagaaagctgctgtgtgacctgcgggtgcccagcctgtggggcttcctcatcgcccccatccaggcagatcgagtgccggctctctgtgctctccaggaggtggcctttcacagcagggacgttctgtgctcttattttaacaactgtaagaatctgagcttggtgacagttgggtgacccgggctctgtgtcttcgtgttggccagggtgtgtcatacacctggcctggcctgcgtgcctcacgtgtggtggggatttgtgactgtccccagcaccttgacagagggtccttgactctgcgaccctgcacagtgggtggtggcaggtgggatcttggttcacaggcacaggtggggagagttgctgggccagcgtggctgggtgactttcctgtggaaagagcgggcttggggcttggtgcgtgatcccaccgaggccggggttgtgcttggggcactgggggagagcagagcaggtgatgcatatccgggcgcccaccctagcagcacaggaagggctgggatcaccactccccggggcaccgtggggacagcgggggcctgctcactccccggggcaccgtggggacagcgggggcctgctcactccctggggcaccgtggggacagcgggggcctgcttgtgttgggggtggggctccttgccccccaagggcaggccgagcaccaagtctgtgcttgccccactgtgcagcgttgcaggtgcagcagacatgaggccagctgctgctccctgcaggcagctgagggcctctgggaaggcttctctacaacgtcctgtgggaactggaaacccagatgtcagtggaaccaggtgttctgtccatcactgcctcttacctcctagcaaattcaacactggcgtttttttttctgagcaagttgagctgcatttttgggacaggagccatggctgtgtgtgctggtgctgaagggagggtctgcagggacggccacacggatggctgtgtgtgctggtgctgaagggagggtctgcagggacggccacgcggctctcgggagccgtttcctgcgctcgggctctgcaccggcaggctccacgctgagggtccctccacatccaccccatcgtgggagggaggctcagtgctctgcaggggcctgagcagtcggggagacaccccctgcccacagccaccctctctgggctatgtgggaggtgcccacgtttccacgccttcctcgtggagggtgtggcgggctgtctgtgccgcgggggtactcggctgcactgtgcacagccctcaccgcccagtgccgaaatgggaaggcctgacagggcgatgcggtctgcaccagctacatctgcagaagtccagcacgatgcagtttatgcctggcagtgatgtttgtttttaaaattagtaaaacctcattagttatcagaaggcgtaactatatgatgattttttgtggagggattatttctaccttttgtgcagagaatgcctggatcccttctgccccttggggtcacatattgcagtggggactgtggtgctctgagggttaagttgtttctgtcacctggaggctgctttttcctcaggcaattggcgttcaacaaatgacaggctgtctagagagaagggtttttcaattacatggctggacctgggttgccaaaaggaagcctcctggggtgtgttctatacgcgacatgcatttgctgtgtgtaattggaaccatgagaaaggtttttgttcagagctattggatagtttccttattttaaacctgttgaatctggaaagagttgtttttgaaatttttttctgataataacgttatataaaagtttatggcagaggagtttctgttccacacgcccctccccgagctttgtggtcgcccaggtgcctggctgtcaaggctggcctgtcccttgtgttcagggtcccgagatgtcagagctggcagcccaagtcctcccctttatcccgagcaggagaagcagtcctcactccatttttcaccccagggtatagcagcacctaccaccctgggatgaatcagagccaagaggcttggtttttctgttcttgttaaggaaattgatcatctcacaccctctcaagctgttttactttgtgcaaatcagattcctttctagggacctgcgaggagaaacatcctcagcttctaggactcccggggatgccgtcagcagccaggccttggcagctgccgcttcacctgtgctggcgtgtggggccctgacgtctcttgcgggtgtcatggagcaggattggaggtttctgagcagcaggagggcaggagaaaggccccaggactttgcgctgtggcctggcctggaaggaggctggctgggcccttctggatgcctgtagcagcactgccacctgggcagaggccccagaggccccagaggccgaggcaggctttgttctctgctgctgggactcagccctgcgggagcacagggaggacagctggaagcccagcccctctgtggctctgtccacagctggggacagcagtccagtgtgcacgggccacccacagccctctcaggaactggcctcttctctttaagacagaggagtgcgccaggtgggcctctggctggacctcctaggccatcagttttcccagcaggaagtgctgatcagactgaaggaaggcctgcgtgtgtgtgttggcccagatgcctgttagtggacgctgtgtctgcacagctgtctctgggtggctgattcatcccagcagctgactacgatggtgctaaagagaaccatcttacacggacttggggacagaaacctgggctcccctaccgaggtcaggtcctgggggtgtggtgggatcagctcccccagcacctccgtggcctggggtggggggtctgtgtcctcccttgggggcttctcacagggctgccaagcagtgtccaggtgcatgcgttgggcgtgcaggaggcctgaggccattgtccatgctggccactgccactcgcggttgtctgttgggagtcggtctgtccagtggatgaataaattgggactcagcggtttgcacccagatgcccgaggctatggagttgccgggtggtcgtgcctggggctgcctggagtggtgttgcagtgactgtccctggggatctggcctggcagggatgccacatttgggcagcgctttcctcttgaaggtgccacagcctgttagttttgatgtgttggccacgaacaggctgccctgttagcacagaaagtgaacgtgagcagtgcgagaaggctcagagtggactttccggggcaaacaactgagggccttttgggcgtcacagatttggtttagttcggatcgaggtaatcatcttgaacccgcttattagagtcagtggctttttctgtctcacagccgccttcttgtttggtttcgcgtctcacatgcattctgtgatcctcactgactttttagaaggaaaatgtttgacatttacaagaagtgagagatactcttgcaaatcatccagcagtttctggtttgcagattgatggcagccctggcctttaccctcagtgcctcctgccggtgatggtgctgccggctctgacctgtgtgaggagggccttggagagcacaggtcccccagggggaggactccgggaggtgctttgcgggagggagtcatggccgagagagggaacgcagagctgccgtgtgtggccgtgcagggccttccacagtgagttgtggggtcctgggggtgagagctgatggtggtctgaccatggtgggaggtggtccggtcctgtagaggcgtggctgccgcagttggggcgggctctgggaatggcgcggtgtctggatgtggaggagtgaggaggagccggccctgagctgcacccaaggagagggctggccatggcgggggcaccacaccggaggacagctcttctgtgggcactgggcttgaagaagctgcagcgcatccaggtggggtgtcctgaggaaaggtggcttggagaggggtgggcccctgcctggagccctggcaggctggggagaccttggtgtctggcagggaccccggaatgtcctgctgctcccccgggcctctgtgtgcagcgccctgcgtcgtggctgggctgagaggaggcagtttccctagcccctcactctggcgaatttcacattcttgataccacggtatctttgaactttctattttgaggaaagttcatttttatgtagttttagtaagtgtataaacgtaataatcttattaaaagtaatcaccatatgtatataaaatacactgtgcagaaacatccatttttattgctgtttatagagaataaaagatccttagatgcaaaaagtcagaggggaaatttgcatataatattcgtagtcctacagttgttgcttatggtgttttgcctaagaccatttctaggtgcatttttctgggagataatgtatctgatgacagttgcatgtgcagataaccggcctctcatgtatccatcccgggagtgccttttctcagactgtgtgtagtgttagtgaacttgattggtgggtgtgaagtgtacagacggcgtgtgcgtggagcgggtcgtgtgcagagccccgaacgagaccctggcgtgtgcgtggagcgggtcgtgtgcagagccccgaacgagaccctggcgtgtgcgtggagcgggtcgtgtgcagagccctgaatgaggccttggtgtgtgggtgcttcagcgtgagggccacctggggaggagtgcttatctggggaggctgagctgggttggaggcttgggtgctccccctggctccgtgggtctccattgctggcttcatagctgtgttccgttttctttgttcagcagttgatctcaagtatttattccaaagcacttgaaatacatgaacctaataaatcgaacaaatacagtaaaactttagcttcttggaacatccccatatacttacaccacgtcctaaaatcctctcatgtctatgtaaaaaatcgggtagcctgggtaacgtgggatgccatctctacaaaaaatttaaaaagtagctgggtgtgatggtggcatgcttgtagtctcagctacttaggaggctgaggagggaggatcgcttgagcctgggaggtggaaggtgcagtgagccaagattgtggcactgcactccagcctgggagacagagccagaccctgtctcaaaaaaataagaaataaatgaaatcacacttgtgtgatgtcagattacccattaacccacttttgaatggagctggaaggataatccacacctacctcggatttctctgcgtggctgttttgcataggagccctgcatgggttattcttgaagtcagcactgtaggagccgtggccggctttgcattttcatcctggttcaccccagacctgctctgggcagagccaggcatcccctgggacgctctgcctttgcgtgtccacgacagtacaattccaggcactgcctggcatctgcgtctctccctcccctgaaccaggggcgcctctccctcccctgaaccaggggctcctcttcctccctgcctggcaggagctgcgtttccttgagtctcctcagactcggcagacccctgggtggtatcatgtgctattctgaaggagcttttgcttcatggcacttgaaaaaaatcctttcactggatctgagttggtgagcatgcatcttcctttcgtaggtttgttttctgaccaggccgtgggtctaacaggagccccgaacctctgggtgggctccgtgtcgcttgcgtgcctcactcatctggcaccgtgaccgcgctccggccctgagccccacttctctgaagcctcacgtgttgcccgtgtggtctgctcctcaccgtcttttctcttgtccttgcccagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgaggtaggcccattcgtcgaggtacatcggatgcgccgtgccccctgacggcgccgtgtgtcgtttcctccatgagaggtgtgcacagcagatgctcgtgaaaaggtgaaattacttggccagaggatctgtgacaaagccaccgcttggaggtcaagctccttttctgtgggtgagcaaccagagcagaagtgtgtggaggaacattctggaggtcttggccaccctgcaggcagtggattcttgggcgcaggtgatcgacaaccagagcagaagtgtgtggaggaacattccggaggtcttggtcaccctgcaggcagcagattcttgggcgcaggtgatcggcacgctgggtggcgtgggaggaagcaagtggggcacgggaatcgcctgtgcgtgctccctgcggtcgtgggtcttggcgagaggcgaattctgtctctatctcctttcaagttcctctggaatacagcaggcatgttggacatggcagtcttcagatggtgtttgtttttgttgaggagctggattttgtgtttttgtggaccagcacttgagagaatgttcagtagcaatagccttcgctggcatgcctgatgtcagctcctctgagatgtaagtgaacacttcagaacctctgggaggtagggagacactttttccctctggcttcctgatgagaaaactgaagccagcaggtttcatgggatcaccagaaccccagaagctgtgcggcctgtggcgggcggggctcctgcctcggtgtccagtgcgcgcacccagctgagccccgtagtggtgtcctgtgccagggactttcaggatctgatactttttgcttaggaaacatgcaaaacatgtgtccccagcgcaggaaacgattcaattcaattcaaccgtgtgcgctggttttgtacactgcttttggactgaaatgagttcttttgtgctgaagaaggcaggtgcttcctttcttgttgtgcatgaaggagctggaggcgggacaccgaggaaggcgactcagtgtcactgtccgtcatgggtgtgtgagcccacggctgaatcatcacaaggtttcacacccgcacttcacctgacaacttttactaggaaaatgaactagggaaactgacttcagaattatgcccaagtcttagaagctcctcctgcagctgttcaggagccgagcgtcccctgctcactacaagacgcctgaaggggtcatgggatgcagcgtctgaagcttccacctggaagtgcactgctccttttggtctgggcggggcggggcgccggtggcagatgcccctggtggcaggctcaggctactgtgctgggtcccctctgccccgcacgccccgcgagcaccagcagggcctccccggcatgtggcggggccagcgttggcctggggcccgcttggctttgatctcgtggggcttcgtcttttggacgtcctgggtgcgcctccactgtggctcctgggttccctcacgcacccgggtgtaagcgccactgcctgtgtccgacaagcagctcgttgtgaggcacacgctggtaagcagctcgttgtgaggcacacgctggtgtaggctccgaagggtctcggtgacaggcgcttttctcttgttcctgcccactgctgttccatcttaccaaatactcagtagcgtccggagagggacctcaacccggttacttccctgggtgtgcagcacgtggccagcgtctcatagtctagattcttgcatcagagcgaagcctgagaggagccgagggtcctcctcctatccagggagaccgtgtgtttcccgaggcagctgtgaacacgcacgtccctcttgtcctgctcctcttcggaggagaacagcgcggctggagggtgctggtgctggccaacgtgttatggagagtgtggcttacctgaggccagggaggtctggggtggctgagagcggctgtggcctctgtctgctgctctccccagtggccactctggcagcgctgctgggcaggggcttggctgctggtggtcttcagggagcagtgccttgcagagtggagcagagaagacggagaggtccggctttaggcccctgccgagctcctgaggccctgccgcgtgcctgtgccagcctgcagcgctgctgtctgtgtgcgggagctcttgtgtgtgatcagcctcaggaaaggctcttcctgttacttccttgtgctgctcctgcacttctaggaagttgatcctgtaactaggaagtgaaagcaaaaaaatgtatctttcttattgttgataggaatagtcacagaacgagaaaacttccttacgttgatatctcattcagtttccttagcaaccctgagaggtgggcaggggccaccgtcattctggtttcactgaggaagtcaggacagcactgaagacacctgtccagcaccttgtgctgacggcttcccagccaggcccatcacctggtggccgaaggcttctgagccaggcccatcacctggtggccgacggcttctgagccaggcccggcacctcgtggccgacggcttctgagccaggcccggcacctcgtggccgacggcttctgagccaggcccggcacctcgtggccgacggcttctgagccaggcccgtctgggcagcagctcccaggccctggcccggggctcagcgctgcctcgtggctgagaagctcctcaccacctgctgtgaggccgtggaaagaccctgaatgcagacgtgtgacggctgcagctgcatctggcccctcagatggtggttcccctttcatggtgaaaatcctcacggatttccttttcagcctcatattttgtctaagagctgtcaacatcactgaaacctgggcctgcccttcatcctggggaggactccctggtccagtgtcacaggaggagtcgggccagggttgagggctggcacaggacatgggggtgagacgaaacctccactcacctgggagggtgtctaggtgggcacggaacccagggtcgtgtatgggccatcactcatgggttctctgttttgggggaaagctgatcccactggagggtgactgtaatgagagtctccagatcaggtgccgactttggagaaatgcaggtgcaactgtccgaacaaatcaagtccccgctactggacggggctggcagctcagctggggccggagagaaaagtcacgagcaagaaagttcttacctaaggtcctggacaggcagatacataacttctgcctttggcaacgttagatgtcatcgttccagagtaaaatacctataaaaacctgccgatgcgcggggagcctggccttggtctgggtgtggagggctgggggccggccggtcggtaggtcctggtgcaggcgggccccgtgcttcatggaggttggcgccgctcggtggcctgctcgcttattcttaggcctgattcacagaggctggggccactcagtgatctgttcgcacattctcaggcatgaaccttcagggctggactcctgttcttttgtgcagtttccacaggggaccctcttgctccagggtcatctttctcactttgaagccccttgagccgcccctgcacagcctcctgttggccccgtgagggtcctgactggggctcctcttttggagcagctgccacgtgtggaccggcacgggcatggtcgtggtctgcccagctgggtgtggggttgagcccatcatgctgtggggtgctccctgggggttgtgtgtgtgtgggtcccacggtgggaggtggggttggggtgagtgtgacttctgtctggggcatgttgggtgggcgtgcaagggggtcctgggactcctgagtttctcaggcctgaaggactgtaggacgcactgtgggctgcaggcttgaagaaggatgtgagtttctggagtagcctggactgcacagccagggcctccccggcatgtggcggggccagcgttggcctgggtcccacttggctttgatctcgtggggctttggtttttggaggtcctgggtgcgtctccaccatggctcccgggttcccttgcgcacaccgagccagcagctgctggggcctcagggctcgcagctcacaggcttctgacgcctcagcctggagctggcgttgtgcccctcgcccctttacctgtgccatcccggccgcagacccaagggtgcccttggagccgtgcccgccggcctgggtgtcaggcttgtccaacgggttcttagagaacctgggccccatccctccttggcccacgcagactccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaattaccagcttttatgcccgtcaatttgggaacgtgatacaatcttgatttctctaactttcacaagttcttcggtgggtcctgtaacagtgggtgcttgggatcagagcatcagagtggaattttcgcagggaaatggaaatgcctgatcgagctgggcggtggcagcagccgctcctcactcttcaggtgcctggctcttctgagagtcagttcgggggtttagtggctcactttttctaattggttcctagctttttgctaaagaaacttggattaactgttcttttgcctcatggtgtgaatttatactgttcctgttttataaataccagaaggagcttcgtaggtaacttttaccatgtgttgaaggtagcattggttttgaaaacctgatttcctcagtgtcgcacacgggtagcttaagaggtgggataattgttggagtagtgaatggatttccctgagaagccaagtgcaatttaggggcagtgacagtgcgaagttaaagtgggacagagtggttatgtgttatctgcaaaatccctcctaaccagtaatcacagtctaatttgcaagaaggaaaagaaagccgagccctacgctgctgctgctgccattgtgtgtccagtgatttcctcacctgaaactcttttgtaagcagctcatgttgacatcagctccgcccaggcagccacggggccctcccctgccagggggcagcctctgactttcggcctccacctcgagcaaacctgctgagcggcgcggcccagggaggatccgccgaggcctgcagatccgagatctcttcctcgggggcaggattgtcctggaaaatcaggaaatggcaggcattgctcagagctacgtcttgttctccctcaccggtgttgctcagtggcacagcttccaggggaagacaacacgtgtttttcaagaaaagttaagtggccattaccgagcagagtcctaaccctgtgaaacccggcaaatcctgcctccacgtcagctcaggtgtgactcgaaagcacttaaaaaattctcgtgttttaccactgtgttgattagtgtgagctttggttcttgggggttaggaaaattcagccataggcaggtccgatatgatttgcaactttcaaaaaacaggatggctaaataacaaattactagtctgatattttttaaatgtctgactttcaaatgacacagaattattgtttcttaaggtaaaaacagtgtatttggctttttattgctataaaatattatataaataagaaaacttgagctggggtgaggtctgcactttgctgtacctgccgaaaatgaggtgcctggagcttgggacaagtcgaggcgtgcacttccccttgactcggacaggaaagagaatccctttctgtttgacacagaccatttctctgtgttgggaaatcctggtgaagtatcacataaacttctccagcgaaagcaaacgggcgaggacacctagggcacgtttcagcgcagacaggccggcccttctcgcggcctcgcagtgtctctctccaggttcccggggatggtagatgaacgtggtgactcactcagggtgttcctgcgaagggaaactgagaggcccacgtgggacgttgggtgtcctgttggagtagtcctttaggaaggagcttttatatttatatttaactagcatcattaaacctgtttgtatttatttctcgatgagccagttttgttctgagaatgagaaaatagagccgttttaataaatgtccaaatcaggacagtgttaaatttgttgtaagtccatatatagttgattggtcgaattaacttgggagtctgtgtttagttaaaaacagcgtttctcaggcgttgctgtattttctgtgaggttcagtaaaatatacacgcaacagcaaccattttgacttctcatggcaggagccagcttcgttgaagtgggccaggctgaagtgaggccagctttgcctgctgcagccctgtggtctgtgtccaaattgctgagtactgccgggagagggagccgggagtgcctgcgtctcctgctgtcagccggtctgactgcctgagcggagctgttgaagtggactgaacaacagtaaccttagagggttagacttggtgaggatggtagatgattttaagtttcttctcttttttccattctttcttcattaatcaatgttccacactttaaatatagtaatttaaacaaataacacatttcaagaattcagtgtaacatgtgacctttcagtagtattggctggagccggcggcaataaagatagaagcctgtgttcctcttgtggcaaatgttaaaggaaaccagaaattcttgattcatatttttccctagaacacgtggctttacaggtttcaaaaaatgaaactcttgttcatatggtaaatatgacacacatttctatgcattctgaaaagatttagaataaactgccatttgttgttaaaaatagcagttatataactttttttttttcttgagacggagtcttcctctgtcgcccaggctggagtgcagtggtgcgatcttggctcactgcaatctccgcctcctgggttcaagcaattcttctgcctgcctagtagctgggattacaggtgcgcatcaccacccccgattaagttttttgtatttttagtagagacagggtttcactgtgttggccaggctgttctcgaactcctgatctcgtgatccacccaccttggcctcccaaagtgctgggattacaggcgtgagccactgcgcccggctgtagttatataacttttagttattagaagatcacattcatatgtcttgatcagtttaatgatttctaagatatcattaacaaaagccattatgatgtattgaaataggattgatcttaaaacgttcgtgctaatgtaacgtgagttccctttaattttaaaccagtatttttctcttcttatttaggctatagtttgttataaagagtatagagaggaaaatggagtgcttttctgttcatagagtttttctgaaattaaagtcaaaattttcagtttcaagtagtgaaagcagtgttaacagaaagtttcccagatactaatcctgggtcttttaagatctttagataattagttgctttccaaaatagcttttaattctgaactcattttagacttaaagaagaattgcaaaaccagtggagttcttctagaccctccacagcattctccgatgtgaacatctcacatttggaagccaggaagtgcagtgtgggataaaggccactaacaggctggtctgcccgggaccccgcatggcatctggtggtcctgtgccctcagcctcctctgctctgtgagctcctcagtctttatctttcttgatcttggggcacttaaaaaataggttttattgagatgaattcacttgccataaaattcacccctttagggtccacagttcagtggtttttagtgtattctcagacttgaggagacctcaccccagacagaagccatgtgcaccaggtcccgtcacccgctccaagcctggcactgccagcctgctttccgcccctgtggatttgaccctgagacctccagagacgactggccagatgttctgtaggacgcccctctctctgatgctttctcgtgtgttactggaaagagtgatgtgaggtgacctgccctcctccgtgtgctgttgggcccatatagtgccccacaacgggtcctgcgtggtctggaccttgatccctggtcaagatggggcctgccaggtgcctccacttgaggagactgtgttttcctctgtaactagcagtgttcttgtggggtactcgaaggttatgcaacatcctgctgtttctcctttggttttcaccccatccgagctctgtccaaagaccttgttgtgtggtctggtggtggttcctgtgtccccaccccgacgttcagtgattgcagcttgttcttaaggaaggctcgttcctctcccagctttatttcatcattcgctcctgccagtgtggactcatgggtgctcatcctgtttgggggttatcatctaacactattgttactagttttgtttgagttataatctaacactaactattgttattaatgttgctcaaattgctccagctttggccacttcaggttggcttctgtgtcctttcagcaagatcctgttcttttttttttttttttttttcttttttcctgagccttttttctttccttctggcaccacaagatgcacctggcttatctttttgcccctgccccagccctagcatccaccacttcccaggagtctcacatcctctcggtggagaacagtatttggaatccaggacgccgggcttggcctcagctgcctctaggtcccctccctctgtagctgagtgtgtgcccctcttcacagtccatgtttgcacagacaccagctctagcccagcttcctcctggcctcccttcgtgtgccgcttctgggcctactgtgtagcacgctctgctgccgtgcgtctgccgtcatgcatctgacgtgattttggagctgccagcccacacctgtgtgagcaacagactcaccactcagggtgggacgctctgtgcatcctcctcaccctgggcatagcgttgccaggccatcgctcgggtgagcccttctggtgctgctggtctgggatgcagacaagtctgccggttccctctgtgctggtccgggatgcagacacgtctgccgcttccctctgtgctgggctccccaggtctgtgattgttgcttcttcaatctgcatgtggttgtgttctacaactcaagcaccaaacaggacagtccgtctcccccaaaaactccccagtctgctccccaaccctgggccaacattggtctgattttggtcctgatagtttaccatttctggagtgtcttataaacggaaataatcagtaggcttttcattctggcttcgttgacttggcacagtgcccttaagactcatcccagtgatctttcctttttttttttggagtggtgtattgttggacggacctggcggtcacaggcctacctgtctccttgggtgtctccagtcctttctggaggctcaggggggctcaagggaagactctgcttccctgcttgagttgcccgcattcctttgctcatgggctcttcatctaccttcacagccagccacgtccacgtctcgcttcatccttcacgtaccctatgcctgtggtcctttcttctgcctcctgtgtctgtccttccttcttccttcctgtatgtatttatctccttacctgtctacttatcagtctgtctagatggggtctcgctgtgttgcccagactgtactcaaattcctgggctcaagggatcctcctgcctctgcctcccacagacagatggagcacaggtgtagccagggccgctggtgtgtaccactgtgttcggcacccgctgggctgcaggagtaatccagggccctctccccatcttagggtcaactgattgccaaccttaattcccctttgtcaggtaaaggaacatgtttgaagtgggacacccttatctttgggagtgggtattattctgctgaagacaagggtggggacagatatgctgtgaccagggtagttgggcttatgactttgttgttgtttacgtggaggaactgaaagacctgggtgtgctgctggatgccccaaggatctggcaggaggaggcatccaggccctcagggcaggtagcgggtgggcctccgtggtgttgggaggtgctgggcccggaggtatcagcaggaactgcagggtccctaccgcaggctccccacacagtgacacctgtctgtccgtccgtctgtccacaggagcaggaggggctgggcggggaggacgcagggtctgtcggagcatagcagtggcccgtacgtgagggactttgttgttgccgtctccccagggtgcagagcgtggtggtttgtggccatccttgcagtgtgagtgagcaagtggccgaggggtagactttggatggctccaggcggaactcggggaaggaggccgtgtactcccatagctctgggctctgtttgtggctgtggccacacagggcagggcctcagggcagggaggccagtgcttttgggaagggcctcccccagccctcagaagcctcccaccctattccccttgggctccatccttctgttttttttctggctctggttcctggcgtctgtttgcaaggctggctggacactgcaaccacctgggcttgctgctgtggcctggacgctggggtctctctcggcccggtggtgagctgagaagcggccctgtggtagaagagggcctttccacgctgagaccacagattgtccctgcaataagcaaacatttctctaaaatgtgagataaacgctttatccactggtgatccgtggttgttagtaattaaaccaagtaaacggtagctcattcggtcaggccgcttgccgccgatgaggggtgcagagcttctgcagcatcctggggaggtcccggaacgtgggtctgggctgtgctgatgctggagcagccagcggggagagctgccaggccactcctgacagccccgcacccgctctggatggaagcttctcgctcccagccgatacgggcctgctgcctgctgctggggctggaggggcccctctgcttgagccttggggtaccccgtgcctacgtgccctcctggctttgcccatggttggtggccgtgttttgggctgcgttgatgtcgttgtggagcccgctctgggcctcggcacgtctgagcttgattggggtggaaaatgcacctggtggtttgtattatgttgtttctgttttatttaatttcatttgccattcttatttcaaaagatgcttcctatgtttatgctatattgttagtttaacttcctaccctttccatctatgaatttctgtttttattgtggttctcagtgaccacactctaggggtcctttctctctctctctgtctctcccccctctcccctcctcccttcctccctccctccctcctaggcagagcctgtgagacttgcaggcatttccccagaacccaggccctcttggccatctggctgctgccccacccaacctttggcctctcctggggctcctggatggttgggcgtcccaaatccccatcagcagagcacttggtcacaaggcccgagtcacatgccccagcttctccgaggaagtgcagagtccagccgcagggaggactttctcaaccggccctggggccagctgtcctgctcctccttgtttgctgtgggctcacctctgtgggctgctcactcagacccactcgcacccatgggaccttcccacctgtttctcctgcctccttcagtctgtgcccagcaccccgctgtcaagcccattcccccccagcccctgacgttggacatgctggaggagactgtggccctgtggcgtgttctgggccatctccagggcctggagcgggcacctgtgcccagcactggaggctgggggacaagtgctctctctgataaatgcccccgagtttcagttctgtggctgtagtttgtaggtctcctagctcagcatccccgagcccatgccctggggactcatggggccgaggagagaggagcgcagagaacatgaggatacgtgagccccttgcctgagaggtgtgctgtgaacctggagagcaaggccagtgggtctggggtgacagacagtgcgagatgcaggaaaacaggctcgagatgctgtgaatctggagaacaagtgggcctgggtctggggcaacagacagcgtgagacacaggagaacaggcgggatgctgtgaaaccggagagcaaggccagtgggtctgggtctgggtctggggcgacagacagtgcgagacacaggagaacagacgggatgtcatgtgcattgtggctggcagggccggcgcctcacacacacgccccggaagtcaggatgtggtgctgacggtgtccgcgctgccaggctggagcgggtgacggtgcctgcgctgccaggctggagcgggtgacggtgcccgccctaccgggctggagcggagcttgctctctctgcagtgggacctgctcacttttccttagctggatgtatctttcacatttagcttaacagcagagctggtgagaggacgcacacctggcgtcaccattgtcccccgtgcatgtccccggcgtccttcatgttgacgcgggccccgccccacggctcaggtctgtcaacttccctggaacaaggcagagcacttggcccctggaagacctggaaaccaggaacctcggaggcgctggcggccttggaggccgcttatctccgcgtgtctgaaattctgttttccaccttttccctttaggctggtaggaggcgcaatctctcaagccttccttagaaaggatgattgtcctccaccctgccccaaaccccctgtgttctgtgcaacgcctgatgagagcgttctgggttattcacagtaactgagctgggtgatctcacaagaggacataatgaagcccaaggagcctggtgggggccgggagaggccttgctctgagtgtggctcgcatgggggcagcgccttggcgtctgtgtgtggtgcggtggttttcctgccactctgtggaaggggcctctgccagacgccttgtcttcagggcctcaggtccctctgggcacggtgggtgttcatgtgtttctgcagggttaggctctgtgcatggcgtggtctgcaggacctggacagcccctgccccggggcatttgtgtcggccaccttggtttgcccccctgtccaaacgctgccagttctcgtcctccagggcactccgtttctgtcttttcattcactggacctccccacctcctgcgccgccccaccacagcaggccaggtgcgttctgcccccaggccctgtcctcgtggctctttgatcctgtgccctcggtgtgcaccgtctcgtggctctcgttagaaccagggtcggccacccccagctcccacatggcgtctggtgtcttgggggtcacatgtgtctgtctgcagtccctgggtgcctcaagctgtgtgttgcctgtggggcatgtctgaacctcaagtgggcctgagtcgtgagagaaaggctttctcatcgatactgtgtggtctgtactgttttgcagaatttctttttaattaatcctttctctttttcacagtgcactggtgattgctgcggtgtttgaccgagacataaactgcagaagagcagcctctgtaagttttctcattttgatatttcctttcctgaaggtggggggtgggcctggtctccctgatgctcctctgtgcactgctgcctggccagctcacccatccacagcaggagccgcgagggagctgctgagagtgccagctgcgggcaggccactggttcttactgtctctgggcgtcttcagcgtgtgaagggcggtcagggttaagcatccccagagctgcagccatcactgctgggggttgatgggtgatggaggcgagtgggaggtgcccgatgacaggtcttggtgcaggcagctgcacgctgaagacgcagaagagagtgggttctgcgagggtggccagaatgtggcggcgggacgggtcactcaccgggtggctttgagcctcgggaggggctgttgcgagcagtggtcagctctgcttcacccgccacactcgcctgggccttgctggatgtgggagctgcctgcaggaccgggtgcgtcttgaacacagatggctggtttcctctagagagagccctgtgacgtttggggtgaattctgggtgtgaggagctgtagcaactgctgctgcgctgagcagactacttcatttggctcagagctgggctggagtgaggcctgtgtctcttgggaccacagagagcggacagttgagacggtggaccagtctcaagataagagtctttatttcagatacagataagacgctgaacacgttttaagagggtaagaacagagaggcagccctttgagaaagatggaggggtgaggttggcttttggtgatggggtgggccccacagttcctcatgggctcgagctgctggaactctgtgtgcaggctcagcatagctggcttagtgggaacctgttgagggagccgttcacactccctgatactgtcagacttgggggccagtggaccaggtggaaggggtgctgggactggtgagggtttcctgtcagccctgcagtgtgtggcccctggtgagtgggaccaggcggaaggggtgctgggaccggtgatggtttcctgtcagccctgcagtgtgtggcccctggtgagtggggccgtgcaggtgcagtgttggttctctctctctctcaaatgcaggagctcagatgataccctgaagtctttctagctcaaaatgtctgtcatcttctatagcttctggtggtctgcctgctctctgtatcctgaagtagttagaagtctttctctgcctcaggtcctttaaaactagagagaattcaccaggagagctcagaagctcttctctgtccctgaagctgctcttattttgtcttcagcatcagtaaaaacctcataattttttggggaaatcatcacatttttgccctgctatttacccaaaggcagtaaatgtaagactttgaaatataatacaattttatgttaaatctgtacttaaattaagcttttagattttctttactgcaacctaagacatttcatgggaagcagtaataaaattaaagtacttaggcttctatgaaccctgaatatgaagtgaaataatataaatcatttttcacattaaaatccctttaaattggcaataaatcttttctgataaataccaccgagtgcacctagcttaccctgtagcttgcaaaattaaaacagccaaaggtaaaagacacctttttgaagcttagttggaaatgtgaggattgagggcctcataattgggaatcattttttggagctgctgctttcagataacaatgtctcggtctttctggctcagcttggcttcctgtttgacgctgtgtcactgggtgaggtcacccctgtgaggccctgaggcctcttcagcaccggccaggaggcagcagcaaaaggcgttgaagtcctgtccctccttggggctggacacggtcccttgcccctgaactctagacgccctgcattgccctggtgctcccatgtcaagactggccgcggtcgtccatcccatggtttgtgaccctcccagcaacgctgtgaggaaggtgctgcagctggttctcagcattggcaggagcatggcgactcaggcagtcagtgtgtgagtgagtttgtgaaaacagttccagctgtgttcgttgctgaatgctggtttttctgcatattggaaggaatctagcagacccccaaacgtgctgacattgcaagaagacatgtctcccggcggggaaggaatgggcagtagagatggggtgtggtcgtggcttcttgttcatcatgaggaagggagatggggccccgttcactcacagttaaagtaaaggcacttaaagcctacatttaactgagaagattttaaatctttttcttccagcatttcgtttgatacatagtgtctgacctctatttgtgactttttattttgggataattgagatttatatgcagttttctcccctcccctcccctcccctcccctcccctcccctcccctcccctcccctcccctcccctcccactctgtcacccaggctggagtgcagtggtgcgatcttggcttattgcaacctcggcctcccgggttcaagcagttctcctgcctcagcctcccgagtagctgggattacaggcgtgcaccaccatgcccggctactttttgtatttttagtagagacggggtttcaccatgttggccaggatggtctcgaactcctgacctgaagtgatctgcctgcctcggctcccaaagtgctgggattacagacgtgagccactgtgcctggcggagatttacatggagttttaaagactaatgcagggagagcccatgcgtgtttcaccattgcctccatgatgaaatctggcaaaaccgcaatggaacatcacagcctagaacattgagccaacccaccagtcttattccttcttccttggttttacctgtactctgtgtgtgtgtgtgtgtgtgtgtgtgtgtgtgtgtgtgcgcgcgcgcgcacgtgcgctcacgcgtttacttctgtgtgattgtatcacatacaaattcacgtatccaccaccacaatcaggatacacagcagccctgtcttcccgagaggcctgtgctactgctttgcccacagtccctgctgtttccctctcctgacccttggcagccaccggtcggctctccgttgcctattctattctgtcatctcgagaatgctgtgtaaatggactctgtggcctctaatgctgtagctttcttctctcggcacagctctctggagacccaccccgagcgtggtgggtggtgctggtttgctgcttctgttgctgagtggtgccgtggtttgtgtgaccattcatgtattacgacatcaggatggtttctagtctttaagctgctgtaaacattcgtgctcaggttttcgtgtgagtgtaacttccatttctctgggttaaatgccaggagtagtttctgggtcgtggtagttggacatttaaactgctttctagagcagctgcaccattcacgttcgcaccaccacctgcccgcagccctgcctttctctgtcctcgcttgtgtctgacatggccactgttttctgtgtcggcctttttgacaggcatgtggtgatacgtcgttgtggtctttacctgcgtttctgtcatgcctgatggtgtggagcatctttcacgggcttacttgccgtctgtacctcctctttggtgaaatgtctgctcaggtcttttactcatttctaagtggattgttttttgtagttcttgagtttagggcactctttacatatgtaggattctggtcctctgttggatttgcgtttggctttctcccagtctgtagctcatctttccgtcctcttcatagggcaagagtttttaattttttaattttgctggggtctcgatcagttttttgtttttgtggctcatgtttttagtgctttttaagacgtgaagactttcttaaggtctgggaactccacctcgcccggtcccggggatgctgtcccgtgttttctgttctgctggttggtctgcgtgtctgttctgccagcgcacactgtgtgacgggctgtgctgcgatgctgctgtgcatagtcagccttcgcactgggcagggagatgcctcccagcgtcttctttctcaggactgttttccctgttttagggcttgtgcttttccacataaatcttgaatttttaaaacatcttttagataccactggaatggtacatgtcttcctaatagtgtatgttaaattgatgttacagtatatctttgttgcattgccttttggcgggttttgtttcttactttcctaatgaatttatcacaaaagttacaaatttgcaaagcagcagtcaggcctcctcccagcctgctgtgaagcgcctgtttcctccaatctccagcccagcccaggggtctgccttggagccacccgcacgtctggtttctgtgtgattggccagaggtggtgggcgcgtctgctccttttccctggggggtgggggcacagaccctgggtggctgtgttcggctccttacttggtgcccgtctgtgtgtgctcctcccagcagccatcgctcaaccttgctctcaggaagcccccaggcgagtgttggcaggaatcctgccaggcgggaggtcgctcctccagagcgtggtccctgaagccgccagcctccctggcctcgccccttgctggtggtgtgtgtggtgtggccgtgggtgcactttgctgggtcttcctgggacactgaagtctcctgtgtctccagccctgagaactcggagcccgggtgcttttgggaaggacggggcaccagctggtgacacatgggaagggaggtgtggttgtcaccttgcccaggtaacctgctctgcctggtcggtgcgcctaaggggggcagggtgtttggggaggacatgagaggcctcctggaagcacttcatcctgttgaagttcacattttgaccttttcagcagcccttgctctgggcctgtgcccggccctgggactcggcctggagagcctattgacaccgtgccatgggtgcgggcagggcgccctccctggagggcggcacgtggtgccagttggtgaccatgagctgcctcactcctgaggaagagtgttcgggctctgggctttgatttaacctgcctgtctgtctctctgagttgacagccggggcctccgcgtgggtgctgctgggaggctcagtggtaaaggccacttttcaggatgtgtctgattttataaacttgaattcttaaattgtggttttaaagagcaccaggacgtaaaaacagagtgacgcaccttgaggctctgttcagccaacaatgagggcttttatttaaaaaataaagccgtgggtcattcacgttgtgctgtttgttctgaacttgcctctggtgttggcggaagctgacctcgctcacctgctgtgtttgttctttgctccgcaggccgccttccaggagaatgtggggagacaggtatggctgctttcaaacacctttattccaaaaacttcctgcgggtttataggtaggaatcttgagagctataaccctggtgtcttctcgcactgtgagatgtggtgtggctacatcaatgccagggtcatgagttcactataggacgcacatgttaaacagcgagtcctgtttcacagggaacctgcatgtacagtaatttacacacacaggccggaaagctgtgctttacacgttgccaagagccacataatgtggctctgcagggtggggcgggtccctgggaccagcctggccttgcggggacgcagacctgaccccgcctcatcccacacagagcaggagctggctctgttgacgtcagcttgtgcctcatccagaccatagacgggcccagaagtcagctcccagaagctacggaccccatgaccccacgaccccacatcatgctggggctgcttttgctgtgccctctgaccctgacatctggtcactggtcagcttcgcctgtgaatggggggccccaggttactcatgttgtgtgtgatgacgtcacatcttgggcgtgtggttgggtcttgcaggagagtgggacagaggccggagaggggaccggggtctgggctggacctgggcggggagcaaagttcccacgagaagtcagccgagaaggctctggagttcccggacagcaaagcaaatgcagccggggtctgggctgtggccaggtggtgtggggcggcatggggtggacgtgggcctgcggacccttctgacctgtggggagccctccaggcaaggtgtctgacctggagtggaagcattgaggccaaatgagtccacaggaaaagccggatgccagagtcagctggagaggcgggcggacgaggacttgcgcctgttattgaaatggttctggaggagcctggcgtgagtggtgtgggcggctttctgtagacggagcccaggaaggggcgtgactacttcttgctggcccgaggcagccgaggcccacccagcatccttggggtgccgtggggcctgcatgtgttcagagccctgagccctggtcggagccagttcactaggaagagacaccagccttgcaaggggagcctgggtgtgcagacagcaagagccgcccaggccaaggagaatgtgaacgaggtttggtcttttgagtggagagtgtggctgctgtgaggaagaaggagcttgttggaaaccacttagctgagcctagggacttgccagcttcctggaaagtgagagcccaggagaagaagtctccctgtccctgggcttccagcccctccagagcccccactggagaggggcgtgctgaggccagagcccggggtgacgaccgtgctgggtgggccctggggcgcactccgccatcactctgtgttccgggttcccagatgctgcttcctgggaggagcagcccagtcgcatagggagccacggggccctgcagctgagctgaccagcctccctgtgtgtgtggctggatttgagccacgttacctttatcggggcagctcaggttggggattgattgacagggaaaggaaaggcctttacacttggtctaaatttaggcaagcagccagaaaatgggatattcccgtgggtgcgggagtcttgcacctcagtcctgagcctgagcagtgtgagtctcagagcatcctgcacagtgaccagcatgcggacggcagcgggagcctcgtggaagaagcggcacagattttgaagagacacagactttgaaagaaatgcaagacgcgcaggtgcggagcgtctcccagccccgcacggccatgtcctgctgaggttggatagaaacatttgagaagaaggtcgagaacttggcaaggcaaagcaaacgggagtggacgtgtcgcatagcacacagggaagcagcctaaaaaccctcggatttggaggaggctgtttctaatacacagatttggaatgaagttgtaagaaatgcgttacagtggaggccgctgggtaacagcagcagggatggggggtggttggggagcggcctgggggacacagagggggctgggggcagagacgagggaccagcttctctgtccaggttcgtcttggctggagttggagactctggtcctgagtggtctctgccttctccctactgagcccaggggctcttgagcaggttgtgactaacccatgggcagcttccacgttcagggcctgtccgacattccagccctatgaccctgctcctaggcgagtgctgtccaggcccccgacaccatcaggcccttgtggtggcctgtccacacccaggccccccacttcccccctgcacaggtgaggaagttgaggctcagggcagctgagcccgcttttgtctgctcggagcctgttgttccagccctagcctggccagacagagccttggcccctgtgttggtcttgctttgttctcaccgtggggggatgctggacacagagtccccttgttcttgttctcggtgagacctggtcctgggccaccccggatgtttccctgggctcctgcctgctgtgatgtggggcatggagttgtaccccagtgggcgacatcccaggttgtggcacctgctgtctttctgcagagtgagccgcaacagctccacctgggtgcaggtttctcccctgttcacggttcagtgaaggatgctcatgctgtcactgattgcagcagcctcaggcagaagtttatggtatctccatcagcccaagctcccagtgtaacccttgggagagatttgctggaagaaagccgcatggtacctgctcattccggcctctcctggtgggaaggagggatgtggccccgggtgttctcaggagtgctggctgttcagttacgttgacttgcgaagctattacatgaaggtgtgaggttttaatggtcaagtgcagggtggtgatgaatgggttaaagacgtcaaggaaggatctgaatcccggcctcggaggtgggcaggcttgggagacctttgaaaaaccctgctgtggtttatagctgtaaggctttctatgtggggtttaaagtttgtcatttgtattttcttaggaaattatttatgttgtttccagaatttcacatcctggaacctgagagtggtatcagtaacaccatgtaggctgcggggctggagctggggctccactgggaggctgtcgtggcggggtgggaggaggtgccgcctctcccatgtcagagcctcggcggctgctggtcctcgatgcttctggggtcagctgtcaccacccccaagaaccggctgggccagctgcccccagtcaacgtcttgcctgcccgggactgctgagtgaggcctgggctctggtccaggctttgtagaccgtgcaggcggctgcatccccgacctgacccaggcctgctcgctctggtgtgcaccgacctgccagctttgtggcactttgtggcatggggctcaggccgatggaggtcagtggctgtaacactgttgagacctgaagaccgtttacggtgtatgttttcgggaaaggtctcttaccacgtaccgaagtggaaatgtttgagttgtttgaaaaagatgaaatacttgtgagtggtttcaatgatttagcgtggtgttgcctgggtagaccgtcaggaagtcagtgtgacgtggaagtcctcggcgagccatgtctgtggtgtgtggcttgctcaccacctgcctcagggctcggggttcatgagtgtaaatgtctgtggatgtgattattgaacttggtgaaatgcctttgttcattcaaattcttctttttcccccatttccactttcttattagggcactttccctcatggtattgatattttgaccacagctgactattttgccgtcggtaacagatccaactgtttcctggttataaggtaagtctttaatgtatatcacaaaaatagaatactctaaaatcagattggatgtcagaaatcagctaccaccattttcttttttcatcctgtaatgtccactcaatggaatgtagtttttgtgtgaaaaattaaaaatggaattgggaacagtgactgaaacttgtgtttcatgttgattggacacacctcatgctttactacgctagataggggacatttactcacgtgttaaagaggggctcagcttcaggagtgcggccttgccgtgagtgctgtctctgcttatgatttttctcctggtcgccccgttttacccgtgctggttctgtgtggggcttggagtttgagaggaagcagctgcaagcacggccacacctcctcctgatgcttccctactggatgtcctaaatgctttcccaccgtgaaatcttggattagaagggactgtttctttctgtttcggtaataggaagtgttttgaagttgaagttatctgtagattgtctatgaaatgagtaagaggtattttagaaatcaggttagaaacaaatgtttagcacctctaattgcagtttacagaattatatcaaactgttttagttgtgtaattaggtactggggaggttacttcagttatcttagttgatccattgcagcagaaatgtgaaaaagggtgtgactttatttatttatttttggagacagaatctagctctgttgcccaggctggagtgcagtggggtgtgactttatgaagtgatttatttgccttaaattaggaccagaagcatgcccgatgcatttttaacattaaccattaaataccctaaagatcgattccccaacagccctgctgtgtagaccgtgcagaaaggacgtttctccgtcaccagcctgggcagaattttgaaaatgtagcatttggcctctttcccaggaaggatctttgaacacacttatctgtatttttataccctttcaggtttcctcaacatttaatgtccttttttgccttatcagttctttcctattaatacttggccatatattttatgtggaaaatctactggcccgatgcagtggctcatgcctgtaatcccagcactctgggaggccaagacgggcagatcacctgaggtcaggagttggagaccagcctggtgaaaccccgtgaatactaaaaatacaaaaattagccaggcgtggtggcgggtgcctgtaatcccagctactcaggaggctgaggcaggagaatcacttgagcccgggaagcggaggctgcagtgagccgagatcgtgccactgcactccagcctgggtgacagagtgagactccatctaaagaaaaagacaatctaccaccttttcccgagtttcctgagtaacacacctgacagctatgggaagcttcagcatatttcccttgttgctgaggtttctaagccagcctaaaactcgcatgtaattagctgtgtgcgttttataaaaacatttgccaacccaagacctgggtccaggcatgtcttcccccagtgtgtttggcttcctcacgatgccaggccctgcgtgcagaccagatgccacttgtgaggacgcaccggcaggcaggcccctccaatcctgagggcggcatcacggggacctgcagtcatggctgcaccctagtaccgcggggcccccctgcacccgaggcagggtcctgctgtcagcctggaccttggggtgagggaggcagtggtcctgttcagcagagggcatgggactgagcacagcccatcagggaggagagttagcagggccctgggccctggcggggagctgctgggggcctttgagccatagtgaagagtgtggattgtcctgaggtcatggcactttgatggtcaggtctttgttttgaacatatccctgtggctgtatttggtgactggaaataaggagagggcttgagggctcttgggagacgggagagggctgggggcctggaggtgtgcccgctggaggaaggtgggagttgccagggcattacagagggtctcagagctgtgttggcatcactccgcaggtggagggcacagctgagggcgacagtgtcgttgagtgcgaggaggttggggcctcagcttgcacgtgctggcctgcgaggaagcatcagccgtgctgacatggagatgtttcctctgcaaattggagtttcggacacacagactggaattgaactaacgggcaccccaggaagactgtggggcgagacgaggaggatggggggaccagccgtcgccccactctcctgttcatcatcacagcctcgttggggtgtaaacgacccccagtaagctggtgcatgttcaataggtacatttttgtaaatgttaacatctgtaaattcgtacctatcaccacaatcaagacgagaaaaggcccaggtttcccctttcccattcggggtccctcccctcccacacccccttcttcaggcacccctggtctgttgctctcactgcagctgtgtctgcatttcccaaagctctgtgtgaatgggttcaggcagtgggcactctcctcactcacactggcttcctctgctccatgcttcctgcagactgtccgcctgtggggaccgtcccccgagcctccagggccaggggtgtggtacgtggcgtctgtctccactcacctggtgaggggcttctgggcagtgtcttgtctgggttgtcacaggtgcagctgcggtgaacatgtgtgtacacatctgtctttgggcctgcactcttgttctctggcatagatgcccagagctgggtggctgtgctgtcagttttttttttttttttttttttttccttttgagacagagccttgctctgtcacccaggctggagtgtggtggcgcaatcgcggctccctgcagcctcgacctcttgagttcaagcgatcctcccacctcagcctcccgagtagctgggactacaggcacacgccaccacgcccggctaatttttgtatttttctgtggagatgacaaatcatgttgcccagggtggtcttgaacccctggtctcaagtgatccacctgccttggcctcccaaaatgctggccttgcaggtgtgagccaccacaccctgcctgtagctttttctgaaatggccacatggctttcggcgtgatggtgccacgcgcccccggtgctggatgagctcggggtccgggatctggggtccttgccggcgctgggggtgttggtctttcaagctcggggtccgggatctggggtccgtgctggtgctggggtgttggtctttcaagcttggccattgtcatgggggtgtgggagcagctgactaactcgtgttctagtgactgatgatgcagtttcagtcatcatccatttcaggggcgtgtttaacacatctttcgcccatttacttattaggttagtcgttttcttcctgttgagaatttgagaattcttcatgaattctgcatacaattcctttttcagatgcttccttgctacatatttcctcctgctccgtggctttccctttcagtatcctgtatattcctaagtcaaagcctttttaaaaaaaaatcagctttgggccgggtgcggtggctcacacctgtaatgccagcactttgggagacccaggcaggcagatcacgaggtcaagagatcgagaccatcctggccaacatggtgaaaccccgtctctaccaaaaatgcaaaaattagtcgggcatggtggcgcacccctgtaatcccagctactcgggaggctgaggcaggagaatcacttgatcccgggaggcggaggttacagtgagccgaaatcgcgccactgcactccagcctgggcagcagaatgagactccgtctcaaaaaaaaaaaaaaaaatcagctttatctttgtacatctactttattacatatagtttacatatagtaaaattgccagttttcaatatgggtttaagtgtggcagcgggtttggcagatgtgagctgttgaatgaccaccactgtggtcagtgtggtgcacatgaccctccctccaggaggcgccatcctgactgacctcctgtcgctggggctcccccgttttagaatccgtgcaggtagcttccttcatctgctgcctgcctcatcagctgcctgtgtttcagggttcctcagtggttctcactgtgtggacgccccacatttgaggggctttgagcccccgtgggttttgatgtgagcacacggcacagctctgttctccccggctggttttctgttggagtgagcattgagcccccgtgggttttggtgtgagcacacgtcacggctctgttctccccgatggttttctgtttttcatgagcattgagcccctgtgggttttggtgtgagcacacggcatggctctgggttttggtgtgagcacatggcatggctctgggttttggtgtgagcacacggcatggctctgttctccccggctggttttctggttttcgtgagcattgagcccccgtgggttttggtgggagcacacggcacggctctgggttttggtgggagcacacggcacggctctgggttttggtgggagcacacggcacggctctgggttttggtgggagcacacggcacggctctgggttttggtgggagcacacggcacggctctgggttttggtgggagcacacggcacggctctgggttttggtgggagcacacggcacggctctgggttttggtgggagcacacggctgcttcccacagctctgctgcagaccctggggcttgggccgttggacagctgagcagaggcttcgttttcttttcctatgtgcaggaggctgaacaccgcttcaagtggttgaagtgtgtgtgtattttctgtaaactttttgatgatatttctgctacactattttttttttattgattcagaagaactggtttattttagggaagcctcctgttggtaagatcagttgcggttgttttttcagatttgttgtttgacttttgactttgtttttggtgttttcctggtagactttgttcggcatatgtgttggtagggatcgatttcttctgtggctctgggtttcgagtcataattagaaaggcatatcctacttagagattattgtttaaaagtcttccgtgttgttttcacaagatgtaacttttatttttgagacataatttacacgctttcagctgcccctgtatggagtggacggttgtggaggggctgacagtgtgtccacctgcgtcacctgcatcttccttgggagtggagctcccaccacttccacggccaacactccttccccccagcctgtgtgctgctgccctgccctcgacgcggagcagggctgcccctcggggaaggtcgtatccatggaaccagagggaacacactcctgtgtgtcaggttctttgctcagcgtagtgcgcctggggaccgtccgcagcgcgtgtgtcctcagtgcatgtgtcctccgctagtgtcctcagcgtgtccgcagtgcgcgcgtcctcggctcgtgtcctcagcgcgtgtccgcagtgcgtcctcagcatgtgtcctcagcgcatgtcctcagcgcacgtgtcctcagcgtgcgtgtcctcagcgcgtgtgtcctcagtgcgtgtgtcctccgctcacgtgtcctcagcgcgcgcgtcctcagctcgtgtcctcagtgcgtgtccgcagtgcgtcctcagcgcacgtgtcctcagcacgcgtgtcctcagctgcttttcgttggtgagtctttgctcagcatcgtgcgcctggggcccgtcctcagcgtgtgtgtccgcagcgcgtgtgtctgcacctccttttggttggtgagttgtgtgcactgttctgtggctatacaatttttctgtgagtttgcctgacatttaggttattttgaatttttggctctgatgaataaagcagttgtatatatttatttagaaatcatcttcatgtggatgtgtattttcatttctttcagataaagagttagaatttttatatatttaactttatgagaaactgccaaactgttttgcaaagtggctgtataatcttgtactttcaccagaacgtatgcagcctctggttttcccacatctgtgccaacgcttggtatttaccagtcttttaaaatttacccattcgagtgggggtaacgatttaacaattagcattcctggctgaatactgatgttggacatcttttcatgtgtttattggccttttatttattttcttttgtgatgtttatgtacaaattttgtatcaattttttgtttggggtttatctttatatattctgttacaagtcggtttgccttttgattttcttaaaagtttttaacagctttgccgaggtataatgggcatatgttagctgtatatggagtgcagggctttactgaagtgcagctggcacacactaaccagagcgcacagcttcctgtgtgtgacggaggcctgagcacagccatcaccctggagcccccccatgtctgctccttgtaattcccgcctcggtcctcccccaccctgaggcccctgatctgcctctgtgggtgtagatgagttttttgcacgtccttgaattttgtgtgaatgaaacaaagctgtgtgcactcattttgtcagtcttctttggcttagggtagttgagattcagattgtgtgtgttgttgctgagtattcgattgtgtggatcaaccacggtttgttttccccgtggatgatgtcagggtggtttccagatttcgccgttacacatgaagctgtgtgcacgtttgtgtaaagcccgtgtgtgcacagatgctcttttcttttgggtaactgctcaggagggaatggctggatcacgtggtagatttgaagaaatgggcaaactggttttgaaagtaactgtgctgaattcccacccacaggcagtgagttctcgttcttccgcgtctcaccacctctccatgctgtcttttccagtgtgtttattgccggctttcctgagtacacgcagccaatgatagaccacctggttaccatgaagatcagccactgggatgggtaggttttctgtttttgtttttctaagagctttttttccccccaaaggagagattcagttgagcttataagccttgagtgtattttctcactgtggatgtcgtattttaaaataacttctgagaagtaatatgaattccagtcttcatgccggatgtgttgagtcatggtctgtctccagttccacttctggagcgcctggtccagtgtgtccgacgtggcggtgtacccgtgcaaatgtccacgctggcgtgttgtggagtgccgctgccgtccgagggggcgcgggcgtagcttggaggcggactctgcgttgtctccctcagcagtgcttcccgctgactctgctccatgtggctccacaggtggtttctgcgctgtctcctgggagcccagcagttcttagtggccgttttcatcattacagtagcagcttcagggtttccttgcatttcataggcagttaaatgtgtctcagaaaggaaaagtgaagtgcggtctggagcataaacagcgcgttagtgctgtgaccgccgccctgaggaggtcagagggtcccctcctaggacagtgccgtgctgtggcactcctcacggagcctcgaggagcggtaggtgcctgtgggtggaggtggctttgtgagggtgcgagtccagaatctcagtttcagagttggtgtgatgtggagggggtcctttctgatccatgggggatgcgtttgctgctgcctggggagcggcccggctgcctgccgtggtcctgctgcctggggagcggcccggctgcctactgtggtcctgctgcctactattggtcctgcttcctggggagcggcccggctacctgcggtggtcctgctgcctggggagcggcccagctgcctactgtggtcctgcttcctggggagcggcccggctacctgccgtggtcctgctgcctggggagcggcccggctgcctactgtggtccaggcagggccctcaggactgggagcctctgggaaaggaactcctgggtagcactcgggctgccgggggaagaccctcccttcattcgcttacagagaggggtgtgaattcctgagactcggggtgtccctgcaaatgttacaccaaaactctctccattaggtacaaggtcccctaaaccgaacctagggaaaattaattaatttgtcagttgtatcagccgattagtcaataacgtctttaaaaccaaagttacagatatatgcccgtagcgtcggagctgtgggactctccagctggtacatatgcccgtggcgtcggagctgtgggactctccagctgttgctgtctgtctctgcctcagttctgtcggcctttccttcacgtgttttgggcggggtcacttattggaggcagatacactttcgctttttgtctcttcctaatgtattgaccctttatctttgcggaacggccctcattgtctcgtgtgagatttcttgccttaaagtaactgatgactggtgtagtacctgagttggcaagccttttctttgaggggctggataaacgtggtagatctctgttccatacgctttgctttagtttattttatttagtttatgtaacccttgaaaaatgtgaaaaccattcttagctgagggccgtccttacgcgaagaggcctcgggctgggcttgcggctgcagactgcattgcctccgcttctcaggtgctttgtcttttctgttccctcagagttgcaggcgatggtcttctagacagcatgcagttgggtgtcgctcagggtgtggagtcctggcacatgagacgccacctgcctcgaagagctctttgtttaccgttagaagtggaccctgagcagggccctcggccgacaccagaggggctgtggcaggtggtcctgccagcgcgggcgtctgccattgtgcctggtttcactgtggtgctgtgggtttggtgtttttaaataattagaggacagacacccgccttctgcatgttttcaccttcacattttgcttctttgttgttacatggtcgccctcatgatgattttaagtcaggaccacttgctgctccagctgggtctggaggggctggggcatgagctctgcgggtcgctcccagcttgaccatctgcctctgcatggagctctggaaggaggggtgggctcaggaggggctccagcctcttgagccggtcctgggtcagcctttcgcggtccgcatgttcaaccatgggtgctttcagtgtgtgtctgatgaggcagttattggatatgtgccccagatttggtgggtgagcctcaggaaattccttctgttcaccccttgtaatcgtggaggggtggtttcacgtggctctatctcacactcacaacctcagagtagcgtgggggtggggaggccggacacccaattgccacctggccctgagaaggaaaggcagctgtgtcccaagaagaaccgtggttagccgtgtgacctcgctgttgtagactgtccttgtcgtctgttggagtcggaggttcttgtactggttcgtgtgagtgagtgagtgagcctctgctaagtggccggttgaggactcgtgtgttgtctccctcactttctttttatgaattgaataaagctagaatcataaaatgaaggcacttacgacattctctcctcactctcagggtcatccgagagttggctgcgagggcgctgcacaacctggcccagcaggcacccgagttcagcgccacgcaaggtgggtgtgtgtcccggccggcctgcgggcaccatgcatgcactgcagaaaggcctgggttgctggtttcaaaggctgggggctgaaaataaggttgtgcttctgtcttggtgagaagcatctgaggaaagagctgtggacttgatcagtggataggctgtgaggacggatgcggtgagtgtgtccgcctgcagggcagggagccgctgaactgtgttacgtacaccggagcccgtgatggtcccgccggatgcctgacatgcagtgctgcttccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctggttggcatgcacctgccacacgacactccttggtctctaggtggcttccatctgccacacgacactccctggtctctggttggcatgcacctgccacacgacactccttggtctctaggtggcttgcacctgccacatgacactccttggtctctaggtggcttccatctgccacacgacactccctggtctctaggtggcttgcacctgccacacgacactccttggtctctaggtggcttccatctgccacacgacgctccctggtctctaggtggcttgcacctgccacacgtgaatgcactttggaattgggcagcgtgtatagaaagaaaaggcctgaatgggagactcaaagtctgcccaggactaacatcaccttggaatggctcagctaagtctgcacttcttacacttcatcagtgaagagagaaatcctgtttgttctgtcttgtttttttctacttggaataaataatcatctgacttaaatgtggggaagaatacacacatttctcaatgtgtgtaccgtcactcccccgacatttattacaggggctacactggaggctggattgtggctcttcagtggagttactgatgtgacgcctgtgttgaacatcctgtgggggctcgttcattcctaagggatctttcagcttcgtgatctgttaatgaggcatccacgtcacgggtttagtgtggcgctcccctacttttcagtgataattaacccttgctgacactgagggggctcagctttgtcctccacccggttgaagagcacggacacccagaacaggactgtgaccttttgtagatttctctgattctcgaaaatccgatcacccccagccgccacatcttagcctctctgattctcaaaccatcgcaagcctggcagcacttggggaggcttaggctcggggagcttggtttccccacgcaggtgtggcagagccgcctccctctgcgtccgtgagggttctgaggagtctgtgctttctgagcaaactcagagtagaggcaccacccctgggggcagccctgcctctgtcctgctccgccccctccaccgcccaggcagccaggcagagctcctgccaggaccagaggccaccctacaccgacagggaaggcctggggagtgtgtcgtcctcctccatgctccctctcctgtctgagttacccaccccgtctggggcacttgggagcgggccatgtccagcacaccgcagcctccgtcctgttgcccttggtgtctcaggggccatctgcatcaccacgggtgccgtcctgggcactggggtgatgaccctgagggatgccagtgtgggcgggtgcgtgtgggcgtcccacaggtcgtccgtgtgtgcacgccgtcgcctgccctcccggccctgtgtgggtgcgtgtgggcttcccacaggtcgtccgtgtgtgcacgccgtcacctgccctcccggccctgtgtgggtgcgtgtgggcttcccacaggtcgtccgtgtgtgcacgccgtcgcctgccctcccggccctgtgtgggtgcgtgtgggcttcccacaggtcgtccgtgtgtgcacgccgtcgcctgccctcccggccctgtgtgggtgcgtgtgggcttcccacaggtcgtccgtgtgtgcacgccgtcgcctgccctcccggccctgtgtgggtgcgtgtgggcttcccacaggccgtccgtgtgtgcacgccgtcgcctgccctcccggccctgtgtgggtgcgtgtgggcttcccacaggccgtccacatgtacacaccctcacctgccctctcggccctgtctcttgcagtcttcccgaggctgctgtccatgacactgagtccagatcttcacatgaggcatgggtcgattctcgcctgcgcagaagttgcttacgccttgtacaaacttgcagcccaagagaacaggtaggaagagtgggtctcgaggagacacagggctctgtccctgatcccctcaccatgtaatcacagtgctctccagttcgagactctctcatcccttctcatttttgtttatctgcaccagtgtcacagtcgataggccccaggttgtattgatggagtgtgtaagtggccctctctcctgacggtcatgccgtgggtggaccacccacctcttcagcggggcgggtgcagcacccggatgggccgggcatctccccacggctgtcctgcccctgctgcctccttgtgcacctcctggtctcagaggtgacaagcgaggtcataacagcaaaggtcctttttccaagacggcattgagcgacttgcatgttcagtatcctttcttcatcacgttccatagtttaaaatgccagagaatatacacgtttcttttgaatttttcagttggctatgtttgtacaaataataataaagcatgaaaaacatggggtcactgggaagttgtgtgcaggaggctgtaaggcatcgactgtcgtcttacgtttcttcccagtcgagtcttcctcaagagtaagaactcccggacttaccatagtgacggcaacctgcttctcggactccagtttaagaaacgtttttaagttcatgccctgtgctggagacagttccctgggaacgggttgagagcagggtatgggcccacctcccgcccaagcctgaggaagctctggtcggccccgagctcagatgcagagtgcagctccttcagggacgctcgctcgtgtgggtgcagctgatgcccgtgcaagacctggcctttatggcgctgctctgtggttgtggaagaaggcacatggggtggggtctggggagaaccaggcgggagctcccagggtcctccagtcgggtcccacagggcctgtgtcattcccccagcagtgagatgtgaccacacctgtgaggtgtctatcagggaagcacatttgagcctcagtgcccaggctagactggggtctggccacgtgggcacctccgcctggcacgaaacaaaattccagacccccagcaggaaagcaggtgccagcgtaaagcacacggtttgcgcagattgagccagtgagggggcctcatgaggcagggcttggtccaggcccccgcatgccagcccaggtctgatctcgccagggaccttcccttggatgtcagtggacatgagctgtcgtctcagcctcacctggacctgtctgttttccaaggtggtcacattggcaggggtcacagctttaaggggatgccctaacatcctcttcctttgaccaggcactgcttcatctaaaatcacaaatgggccaggcatagtggctcacgcctgtaatcccagctatttaggaggcggaggtggggggattgttagggcccaggagtttgagaccagcctgggcaacatagtgagaccccatctctaaaataacaaaagaatgcaatgtaaaacaatacagtagaatacaaaaataatcggaggtatgtcctgcagaggtctctgggacccactgggacctgaacaagaatgagaccttgctgagcctatgctcctccgagtgtacttggggttagggtcttggggagtgtggcctcagctcctccgagtgtactcggggttagggtcttggggagtgtgacttcagctctgtgtttgaacttctgcaggcccgtcacggaccatctggacgagcaggcagtgcagggcctgaagcagattcaccagcaggtttgtgtgcagcctctgggtgtaccctcaggaggcatcacaggacctgcccccttagggcctcccaccctccccaggcagggtctgcagtcctggtggccactgtgctccatcagtcctgggctcagtgggggacctgcggtgtgatcactctgggaacaggctctctgctggcgtcatgcttgtgaacagccaccttggagggttgccctgggaggggaagagactcctaggaaatgagtgcagactttctgtgcacgtagccagcatgtccttggtctctgaggaaggcttatgaagctagtgcagtcggtggaggtttcggctgcagctggagtgtggtttccctccggggcgcgcggctgcggtcccacgatggagcgtgcagccaactctgggtgggggcattgggccccgtgctctcctggtggagttgggggcacacagaacgagcacagaagcctctggtttccagccgtgcatctgcagctggggtctgatgtctcctgaaagtaaagcagaattttgtgtgtgcgtctgtcggatttctctggggagacagtgtgttcatctttctgggctttgagagattctcaaaggcttctgtgacccagaggtaaagtatgaactatggatcttggtgttacaggagaatataaaaattgttcacgagggattacgtggtttacttgtctgttgtccagatagctttatattctttaagattcagctcggattcttatcctatttttgccattaactttcattatgattttggcaaagccattttgtttgcttacatttttcacttttaatgtggtgtctggcctccccctctgaccgagacaagcatggctgcagagtgcagacggggaggtggccccgggcagcagccatgaacgtggcctccccactgacgctgagccatggctcccttttttcagtaaaatataagcagtaatagagccgatctccttgagtttttgtgagaattaaagaatacattttaaagaattgaggagaatttttgggacagtgtgagcattcagtaaattttagttgtagtggccatcacaacgtggcttttaagctctcttacaaaaaaagaaacatcagcatcctgtttggcacagttacttttctgcacaagaggctgcctgggtgggttctacgtcggtctctggggccagaatgcaggtggctccagctccctactctggccctctcctccctctctctgtgcctcagtttccccttcaagggagctctgggcctgtctggaggttaaacaaggccatctgcgtcagtaggtgggcctccgtcctcagccccctaggcggctctcctggctggcatggcatcttctgccattttctctttgttcttgtttttgacagttgttaacgtatacgtattattttaaaatttaaatcattaaataactttcagttttttattttcagctctatgatcgtcagttatacaggtgagctttacaaaaccaaagttcttatatctgtgtcctaatgaagaactgcgctgtcaggagcaggcggggcgggtgtgttcgcttccctctctgcctatgtgtgtttgggttgagcgggtgggtgtcacccggcccgctgtgggaggcgcatgagggtctgacctggttgtgtgattgggttgagtgggtgtcacctggcccactgtgggaggtgcatgagggtctgacctggttgtgtgtttgggttgagcgggtgggtgtcacccggcccgctgtgggaggcgcatgagggtctgacctggttgtgtgattgggttgagtgggtgtcacccggcccgctgtgggaggcgcgtgagggtctgacctggttgtgtgattgggttgagcgggtgtcacccggcccgctgtgggaggcgcgtgaggttctgacctggttaggttttcagctctgcaggtgtcatcgcgtttcctcgttcccaggacttgctggtcataggcaggggtgtggcctccccaaccccgagatctggccgggtgcctccctgagggtttccctctgtgcctttgcagcccaggcagcctgtctgctctgacagattgctttgctttttctagaatttgctaccgagggtgtcacacagtaggaagcctttgggtgtggtttcttccccgacgtgtctttgagatacctgtgttgctgtgtgttccgtggtgtgcatgtacggcgccgtgttatccactcaccagcccaggctcatctgggtttccagcctttggctattgtagggaagctgctgtgcacatctagacgtacaagtcttggtacgtttcacgtttcctggctgactaccaggagcagcatcgcagggtgtggggcacatgtgtgacttctcagcagccgagccaacttcccagaccctgctgctgcacgtccccatccacaagtgaccccttggtgtggtcggctctgaacgtgggccctctgggtgagtagaggcctctcgctgctgctggagtctgcctctccccagggctcctggtgctgagcctctttccctgtgctgacgaagcattcctgggtctttcgtgaagttttttgctcattaaaaagttcagactttttgctcattaaaaattttatcgtctgtcttattgagctgttagaactcttcatatattccagatgccagctctttgtcacacacaggatctgccagtgctttctccagctctgtggttcacttttcttttctcttagtgactttttttttttggagaagcagtctcactctgtcgcccaggctggagtgcagtggcagcatgtcggctcactgcaagctcacctcccacgttcaagcgactctcctgtctcagcctcccgggtagctgggactacaggtgccccccatcatgcccacctaatttttgtatttttaggagagacggggtttcaccatgttggccaggctggtcttgcactcctgacctgaagcgatccgcccgcctcggccttccacagtgctgggattacaggctgagccaccgcgcccagcctcctagtggctttttactgggacttgtgtggggtagtgaacctcgtgctgttctcctttaccttcgaggggtgaagcctccctttctgcctcctagtccttccaggctgctcccaagaggtcccttggctgctcccaccagtttctggccacctcctcagtcagcagggcgggtggccctgtttgggctccaccccacacactgggcctggagggctccttcaggtgctccttggggtactggaggacccctgccttgggcctcagtcctgtactcttcacctcctggtgttggagccagcatttcatatgttgcattctgtccagttttctacttgcaggaggggacatccaaccctgccactctgtgtgggccagaaaccagggtctcaggagtgaatattttgccctccccagggcagcgcgcctgcccttgtgcaccagggtcccgctgtcagcgccagggctggggcaggtgtcccagatgggcagagcagcccggagctccgcctagcttcgctcatggtagaaccgcagtgcactgcttctctaggctggatagggggctctttctggcatctgagattagtttctataaagtaagagctgagcgctgcttggaattagttctgtgatgggataccagtcaggactagaatgtccagtaaaaattaaaaatcagcatcaccccagctaggatgggagacctctggaagatggctgtaccacgttttttcctttcttttcataaaaggttgctcatgctcagtaacacattcaactagttctcattttaatgctttttggagcctgaggttacattggcaagcatatttcatggtgttttatacgtcaagaggttcttctaattctgatgttttcattccttttcaggggtctgggaggacagctcatgagacaagcaggtaagtctgaaggcctttgcagccctctgcagccctttgccgcagccatcgttgagggaggtgtgctcgtggcgtgcagggcggcccattagcccccagggtgaagggctgggtgtgtttcttctgtggaggcggcatctgtgatgtgcttggtttgtccagtggttcctacgagggagagattgagagattgagattgagagagagaaagaggaagttgtgagctgggaggggttgcacccaggagccactggttctggaaatttctcaggaagcagaggcagctggggcagtggggccagtgcttgcctgtggacccagtggacattgcagatccctccgagcacggccccagcgtggacagagcagccctggtcgtgccctgtggactgagcagcgcagggaccaagagccgttttgggcgagcacaggaagctcaggcgggggcaagaggaaagctgagcagaggcgaagctccttacacacccgagtccaggcgaacctctgcgcctgattcccaagcctctgataccccccgggggttaggacagtcgggcattttttctttgctgattcttttttagcatgtgaggaggagggaagcgtagaacacattttagactgttccacagagtattaaaggaaaagcctgatttcatagacattcctgatggcagcagccgaccccaaggtccagggagctggattccccgacacagctcctggggccctgctgttgtggacagcccatcccacgccaccctcagcccctcgctgtgggactgtgagtgtgagtgtggaggcacagctggtgaggaagcttggaaaaatcgcggttgtgtgcagacttttgctgaggtctgcgtggtctgagcagaggagagcaggctgggattcggggaacccacggccggatgtcagggctgtaccagcctcttgtgctttctgtccacacctcccagccctgacctgatagggacctgcccgaggcctgcagccatctatctccagccaggctggccgggcttctgtactgagagcagccagcttgcatttctgctggtgttagctcagtgttctcatgagtctgatggacgtcacgggaaagtcaatcctagaaacgtgagccagtttctgtcagctgacgtcagaggcatgggactgccagttctgcaggtggtccctgttggctaagaccggtgtgtcatgttttggatgtagacttggtcattgtccctcagatgcctccagagcacacggtgcaggggtgtcacctttccgacgtacccatgggtgcccggagttgcctccttagtgggatcaagaccatcccccacatgtcatggacagctggtgacctgtaagccgtttctggatctaggagtttggcttgggatggagtggggtgtcgagtgctctcagaagggttcaatgtcccccacttcccacccacgacacgggtcgtgccctggagatggcagttggaggcagtcctacgaccttcacacgaccttcacgtgctccccgtgtgctgcggggtctgcttttagggtcgctcttggtgtttgagcagtaagtctgcacaggagccactgcccaccatgaaaggggggagttaaaggcgttccgaatccctttggccaacgacggagttgaaggtgttccgagtccccgtggccggcggcgacagagttgaaggcgtttggagtccccgtggctggcggtgatggagttgaaggcgttccgaatccccgtggccggtggtgacggagttgaaggcgttccgagtccctgtagctggcggcgatggagttgaatgcgttccgagtccccaggacgccattttggctgaatttcctttaccctcctgctccgtgaagcggggcccattggggaggtgctgctctgtaatctgctcttcttcttgaatgtgtggttagggcagccacattgatgtcccccaggctccagagtgaccgccccttaggggtcctgctgggcgttggccgctgttggccgcagggcaccgttggcctgtgcattgctgccacctacccatgatgggcagaattgtcacgagctcaggaggaaaccatggaaaaaccgcaggtcctggagcctccgtgtggttgtcgtgggcagctttccacgcgacgtgccctccctgggcgtgaggctgcatttgcacttagcggggagagggggaatgttgtgggttctagttgggctttttgatgatgatatttggaaagacttgagacaaagtagccaccctgtcctgtcccttcctcacccaccacacccactgctccccgctggcaggcactgcaggctgcacaagtaaccgtggaacctaaacactgatgtgcttcgtccgggttttaaaaaggcgcccttaccgcggtttcggtgtttggcgtcttcacgccatccgggttctcggtgctctgctctgaaggatggtggagggctgtggtctgttgttgggggtgctgggtgcagggtggtttctgtctgcctctctctacccccaactccagctttcccaccctgccctctgctctggggcacgtgtgctgttgggatgcatccctcagggttcacggcagggtgtggattgctggggggcatcgtggagaagggcatctttatgggaggcatccctgctctgggccccctgccggcctccagctgtgtctgcaccatgagtgtgtttgctggagtgcggtgtttgcactccctcacaccgctgagtgcaaacgcggcactcctgcacatgtcgcctcgcaccgtggcgggcgtgtcccgtggaaagctgcccatgctgcccacgccctccctgggggccccttggctgcctgcactccccagccgtgacctcagctcccggcgccggccctccttgtgcagctccttcccctccatggcctttgctggccccaggagactctggcctgcaggctctgaagccggctgtgtccctggtgatcctgactgagccttggtgtcaactcaggtttttttctcctcctcgttcatttttacacttcgtaggaaattattttccctttcagctttcaagtaggaatagttcagaaggggaaatagttctgcatagcgtctgtggtcttggccccgcatctcccagtcccacatttttatttttccaaaggcaaccctttcagttttttagctgtctgttttccttgcttctgtatttctgagttctgtatgtacgcagctgtttcctgatatccttagttttagatgtgttctttcaagtgagacaagactccaagctcttgtcggggtgagaaatctgcgggttcacgggctacatgtgggagacggggaggggctgctggtcactttctcacccaggccagaggatggcgcccttacccccgaggacgccggcatgtcggtgacatgccgcccgcaggagcatcaggtgcgccctggccgcaggtgccccggaggtgtcgaaccgcagatttcttcagacgttttttgcacattttgtgggaaaagtggctcaacccttgggagtcgtctgcgtccccatatcaaagaaatgtcatacaggttggcctttgtcgtgaatattcacgagaggagatgaacatcctggatgtcctcagcgtggcctgaactgagctgcttcccccggtgccaggaagatgagcgtccccttgtctccgtcttagtctcagtggctcttgcatttcatgctttagaatcaaaggaaagaaacaggaactctgtttagtgaagcagcgatgaaggaggggtttgtcagtcagggtggactgcgttttgctcttgaaacaatccccaagtttcagtgtcttaaaaccacaggtgtttttttatcctgctcacatgtggatcaccgagggcaggggccgggaggaagggggtcatctggctcacagccttgcaccagaggcgtcacgagaatcaggaaaagttctcctctcatgccgaagacgggagggaaaccagagggactggtgagccttgagtcggccacaggtgtgtggaggatcgtgacttagcaagccggggacacgctgttaatggacttcctgctgtgggggtgagggctccgtgctccatctctgatgccctgtacacacctgccacctcccctgtcccctcagcagagacatggccggtgctgtcgtgcctttcgcttttacctgtatcttaaatcacacaggagttcattcggatttacctgtacagataccctgttctctttcttgttccgtgggaattcactgggatttacccacacagccacctgctgcttctccttcttgttctgtcctgcatttctcaccttctaagaggaccattttctctttgcctggagaacactctagtgttttccatagtgtgtgtctgctggtggcaccctctcgtttgtttataccaaaatggctttttccactttttttttttgagacggagtctcattcactcttgttgctcaggctggagtcacagtggcgcgatctcggctcactgcagcctccatctcccaggttcaagtgtttctcccgcctcagcctcccgagtagctgggattacaggcatgcgccaccgtggcaggctaatttttgtatttttagtggagatggggttccaccatgtgggccaggctggtcttgaactcctgacctcaggtgatccacccacctcggcctcccaaaggtgctgtttttttttttttccccactttgattcttaaaggttatttttgctaagaatgaaactttagtttgcatttattcattcgtttgtgttttggcactttaaagataatagtctcttgtcttctggagaggttagctgccagtctacttattactgtattggagacaatcttttaagtttcgctggcttcttttgagatttttatctttatttggttttcagcacttttaccgtgatattcctagaacaagttccctttgtgtttatctgacttggggctctagggttcatacttgttccataatctgtattttctgtcgatgttttgttcactttagaaaaattcctagccatgatctctttgaacattgctcactggcctctcctctccttttgggactcttattacccacgtcttgtctggatcaccgcacttaattctttacgcctccttacactccctcctctggttttgtcttattcagtttggacttttttttttcttttcttttcttttttttttttttgagttggagtcttgctctgtcaccaggctggagtgcggtggcacaatctcagctcactgcaacctccgcctcccgggattaagcgattttcctgcttcagcctcctgagtagctgggactacaggcatgcgccaccacacccagctaatttttgtattttttgtagagatggggtttcaccacgttggccaggctggtctcgatctcttgaccttgtgatctgctcaccttggcctcccaaagtgctgggattacaggaacattttctttgatttaaatttcattgtcacaaattctttcaggtgtgccttatctgccgttaaacgcatccttgaatttttttatttttcagaacttattttttatagttttcatttttttcacatcctggaacatattaagcatggtttaaaatctttgtttaatgtcatcatctggagcctctgtggctgtttctgaaggacggtatatcatacatgaaaagcatctccaccaagctgcaggaacaagacatgacagaaatgctttgaggtctgcaatgttctcctctcccagagagacttgatgttggctcttgacgggaggcgggtgcttgctgtcggggtcacctccattgggttttgggacgtaggaggggtccgtgctgggctggcccacgttttacacctatttctaggtgtggtcctctgggttcagagcctgtggtgagggctctaccgcttctccctttggtcatcctggactcccgttctcctgctagctggagatgctcctggatgcactgttgggggtttctggttcttgtggcgccccctggagtcagccgtgagccggggagagttggcccccgccgctctgtccctctcaggtcttcgtgagctctctggtaactgcaggcacttcctgtgtgttttcattttgtctggcttttaaaaatgtcttagtggagggttggtctgcgttatctagtctgttagtttttaaaaaatattcttcatttcgaaataattatagacttacaggaagttatgagattagtaatagagcctggctgtgcttcccatgcttcctccgcggtgactccgggtatgacagtgttggagccgggactgcggtgtcgaggccctgcctctaactggactgcaggcctgtgcggtttcgtggcttcatgtgtgtgtggagtggccatgtgtgtctagtttcgtgcagattgatgccctgtgtagatttctgtaactaactccacactcaaatcagaaacctgcatccttcccacagagacagcccctgccctttgcattctcaccctgcccccctgccaccagtctgtcccttctagaatatgccatgatcgactcgtatggtcgtggcatttcgaggtgggcattttctgtgagcgtggtgccgagaccccatccagctgtccatgtgttcacagtttgtgccttcctagcccacggttgggttttaccagagtgtgttcgaccagcactcagtagagtacactggggctatttctatctgttgctgttgtgaacaaggttgccaggaatattcctgtgcgagatgtgggtacaagccttttcatgtctaccactgagtcccgtgtgccgtttcgtgagaggctgaggcaccgcttcattccaccgctgagccccgcgtgccgtttcgtgagaggctgaggcaccgctgagccgcgcgtgccgtttttaacttgattataaaatacatttaaagttcacatgcaggtgcatctccaagaaaattattttaaaaactagttaagactttcatttcccagtcctcaacacacatcagagcagtactctgttcagagctgaaaggattcgcgctgggacaaaggcgtgtcacttgagtgagtgatggtgtcacaggtgcccacgtggaagaaggtaaagtcgtatctaaaactaaatgtgagagtaactaataacttacgcataaaaactaccatcataaaaatcctcgaagaaattttaggagacgttgtaggacagtgtcagtctctgaagaaaacttcttagtttagaaattttcaaatctgcgcagaagtaaagagaagtagtttacggggggggcccagagtctcgcccggcgcttcctttctcctcccctcctctgagtttaaagaagaccctgaatgtcaggtcccagcagcccctcgctgggtttttctaacttgtggtaagaactggttttctggggttttttgtttctttttgtttcccccctcttggcatgtaatccccagctaacagattttatcataataattccacaaggtagaaacaaaaggagataattatgttgggccttatattgaagaatagaccatgtgtaggttggtagggaaaacggagattgagaataaacgtctgttctacagtcgaaaaggtaaaaagttaattagtgtacaaagactaaattgtaaaactgcctgtgacgaggtaaaggatccagtatgaaatggggcagagcagacgtgtgggcatttcatgcagaagaggagcagactcacgtggccgtggacggtgagggtgccggcctcacctcggaggcatggaagtaccaggttacttcacatcgagaggaccgttttcctctttccagtcggctgcggttggcactgaagaatcttggtgctgacagacacagagcagggtctctcgtggaacaggagttgtctggtctgttcagtttgatgagtggcagtatctgtgacgatgggaagtgtgtgtgtggtccctgtcctgtgtgcagggacgccaggtggaccgacggcctccgcatctgtagcacggtcaggcctccttgttcacggtgacaaaaaatggaaggagagtttagtccctcaggagaaatagcaaataccatgaacaagtgtgcagcaggcgtctgcgagtgggttccgttgttaggtagagacggtgggagctagagcagtgtgtggccgtgggagctgctgatgctgtccagtcgtctctgtctcgtgcgtcctggccccctcgtggctggtcagggccacgtttctggtcatggagagtgtgagtgacgagctatgtggggaagtgacaggcatgacctgtggtctggagcattgcaggtgatggctgtctgtcgcttgggtcctgagtgacaggtctaggagcagaagccgctatgcttcccgtacagcctgtcacagggacgtctgcagctccctgacaggccggcccggcttctctgaagtgcacgtgggctcacacatgggccttctgccacgtggctgggtctgcagcactttcttcaggctgctcagcggaggaggcgtcttgggcttctcatggtggttctgaaatggttctgggatgtttccagccctggcagcagggtaggttgggcgggtgaggggcaggagctggccgcacacaactcagaatgtggcaaaggcaagccgctgtggcaggcgcttttagaaaagtaacattgcgtctatcctttttttttttttttccagtgtgtgttttaatagaaaagttgtcactttccaaaatgccctttagaggtgacaccgtaattggtaagtgcttttgtttttaataatagcattttcttacagaatgacttcagattaaaaggtaaaaatgaacctgttaggatgggggcgataaacgattatagcttaaaggttcaagatattaatcggatacgttgccttgaagttgttacaagaacctgcttaaataatgggtacccaccgccctctccccccaacacaggagggcccttccccgccgtcacctcagtacccccacctcctcgcttccatgcccagggcccggcactctgggtcagttcttctcccaggcagacagtcgggagctgcagccacccaggccctcgtggaccaggagcgtgccggccgccgacaccacggaccctgtgggcagaggcggctccagttcctcagcagccccccacactgggctgccagagcacagtgaagggagcccccagggctgtggtgtcccggggctgtctcagcagcctcagaagttaggactttttttttgttaattgaatagccttcacatttgttgcttgtgcaggatctaattgagttaaagatttgggtttatattggtgggagccgggggagaccgtttgaaggaaaagatttaggggtaacaaaagaataaaagtttcccaaaatgtgatgtataaaaatttacagaatgctggtatttccctcaataagagcttacacaatttaacagccatgagaggaaggggccttagacttaacacaacgtggagaatgttcactttggcttttccacagattcctctcaaaggttaccatcgactttaagattagtattaatagaagctgtttttgctgttgtttttgatttcatggtgtttttgattgcctgggtacgctaacttgattttttgacagatggttggcaatggctgataaatgacactttgagacatctccatctcatctcaagtcactcccgccagcagatgaaggtacagtgagcatgggcgttcccggccggcgctgtggcggtgttagtgtgttagtcacggatggtgtttgtgttggcgactgtgcatcatgaggctgtccctgcagtagcctgataactgacaaatgggggcataattctatttggaatcccggatggtagcgtctacacggtttataaccagaaaatccaatacagccattggaatccgaatgtttaattttttattgcttctggctgttttaattatagttacctttgaaatactttttctgcatcaatagtaactgtgctctgttgagttccgtgtcctgtaggatctgaggtttggaaactccctttatgatgctcctgtgcagatgagaaaacagcaccccaggacctctgctcgcacacattgacctggtcatgttgtgtgggtgccagtgtgtgtgtgtgtccccggccacctgccctcccctcccgtcctgggggttacaggtggactttggactcacagagctgtaacgctgatctcattgcatagataagaaaccatgggcccggcgcagtggcgggtggatcacttgaggtcaggagttcgaggccagcctggccaacatggtgaaaccccatctctactaaaaatacaaaaattagcggggcgaggtggcgcgtgcctgtaatcccagctactcaagaggctgaggcaggagaattgcttgaacttgggaggcgaaggttgcagtgaaccgagatcacgccattgcactccagcctgggtgacaagagcaagaccctgcctcaaaaacaaaaacaaaaacaaaaacaaaaaaaaccatggttaccaacgttgactaggttttgatattgaggatgaagaatggaagtacatttaggtgtcttgtaattctctgacttcctccatgcttagcatttctttttccttagcatcttcaattttcttattttttttttcttaaggaacttgaacattctgtaggatccaagtaccgttctactaattgaatttgaatgcatcatgatcagtgcctcaaaattttatttcaaaagtccatgattaattcacactggccatgatgctggtgcactttgcccctgggattggcacaggtggtgactcgtggaatgcagcaccctgtagacgacgcacctcctctgctcatggcccccacctgccccgcccccagtgcctctccaaggctgctctgttggcctcggctcctgggcttcgggggagcggtggaaagaacacgtgggtttggtgtttgccacttgctggctgtgtggtcacgagaggctcctccgtaggtggcagaggtgggggttcgaggagacagtggcactgagccccgcacgcggcgggactggtgactctctgcccgctcctgctctgtgcagcaattgccgtccctcccaccacggttcctggtggccttgggatgggttcccgggggtctcctgctgtccggccccaactcctgttcccagtgcgcccccggagccctgtctctctaaatgaggctgacgtggcttggcctgaaggccctgccccgttactctgggtgcatagtgtatgcctttttcttcataactatttctgggaaagaaaaatatgctccattttattattgttccatattagaagacagacattgtggaaggaataatcaggttatccattcagtttcttagttgtagtggtagtaaagtgatgcgtgtatctgacagatgatggtgagcaggcgtgctggaaaggagtagcatgacttaggggttcttttggtttggttcgaaagtcattgctgtgccgagatctcagggtgacccgctgtgtccctggtcaggtccttctctgacctcaagggtgacctgctgtgtccttggccgggtgcttctccaacctcagggcgacccgctgggtccctggtcaggcaggggctgctctgacctcagggtgaccacggtgtccctggtcaggtgcttctccgacttcagagtgacctgctctgtccctggccgggggcttctccgagcagagctgctgtgcgctcaccgtgctgcctttgttttaggatgcagcagtctcggccctggctgctctatgcagtgaatattacatgaaggagccgggggaggcagatcccgcaattcagggtgagtggggagcccttttcttgaagactccaggggcttccagcaggaagctgctggggagtgtctgggcacggaggaggcctcggttgtgcagtggagcagagccaccacgatcatggctggagtgggactgttcgggtctcaggttcccagccgaggagctgtgggcaggtcctgcagctgcccaggatgttgcatcagctctgaacaggtggctcagcagggacgcgtctctgttgacggcaccctcttgctccatcacccaggctggagtggtgtggcgtgattcggctcactgcaacctctgcctcctgagttcaagcaattcttgtgcctcagcctcctgagtaggtgggactacaggtgcctgccaccatacccggctaatttttgtatttttagtagagacggggttttactgcattggccaggctggaatcgaactcctgacctcaggtgatccacctgcctcagcctcccaaagttctgggattacaggtgtgagccactgcactcggtcagtgtttttagaatttttgtatgcaccgtgacatttttctgctgtgtgtttcactcgttaatacattttgctgttttttccttctttatgaaagtagcattaggctggctttacgccgtgtcccgtgcgtagctgctgtgccgcctcactgtacatcctgcacccccgtgctgaagttcaggcttgcttctcgcacatcatgttcgagggatctgcttcatgaatcgtacttttatttttaaagtgtcacatgcacatatgttggcccacagtgttcctttatgtcatatgatagaacatgcattattaatcacgtcaaaagtgtgtgaatcaccacttaaaattattataagtatataaaaatcatgcattagcttggcatggtggcacacacctgtaatcccagctacttgggaggctgagtgtggggttgaggctgcagcgagctaagcttgcaccacggcactccagcctgggtgacagaatgagactctctcaaaaaaaaaattctctttctgattcctattttgaggtaggccactttggaaacgtgtctgctttgggaacctcaggcggctcctcctttgttcactgtggctttgctcctgtttggggcacacgtcgggtgtggctgtacacgatgggcagcagagggcctctcttcacactcgttgcttcctttcagaggagctgatcacgcagtacctggctgagcttcggaaccccgaggagatgactcgctgtggcttctcgttggccttgggcgcccttccaggcttccttctgaaaggccggctccagcaggtgaggctggccacgcgcagtggacggggcctagggcgagggtgtgggagcctcgtgtgttggggcatgaggtaggcccagccgttaataaacccatcagtgcttgtagctgggagggggttcctggaaaccggcacctgtggccaggaggaagggggcagagggcacccaaggtctgtggccccttagggccctggcgaaccctttgctgtcagaggacagacttgaaaaagctgaattctgggagggaggagaaggtgttgtttgtagaagcagctgccgagagtgaggagaacacagttgcctttgtgcgttgtggagccgggtcctgttttggttgcggccgtgcatcctgcatccaggtcggggcagaggtggttccacgtcctcccagaggtcagccccacgctggcctcagtgacctgctctctcacgctttcctgtggtgctggtcccactgaccaacctgccgggaactcctgcttgtctcccctccggccacctggcgtctgaagctggaataggccctggccactgggttccccacgcccttccctccccatgggatccagccttggcacttcaggatctgcagctccagacggactcctgcctgtgtggcgggtgggcctcgcagccgccatgccatctaaaactcgcatgtgggggtttatccagttgaaacacagataaatgtgaaacaggatcacttggagatatgacagatgaggttgtcgggacccagcagcttcctttgtcaataccccaggtctcagcgtaggacaaaagggggggacctcaggtagggtgtggccagacccccagtgacaccctggggtgggggctggccgtggagaggctggaggtgacctctccccgggtgtccttcctgggttgtactgggggccgtggagaggctggaggtgacctctccccgggtgtccttcctgggttgtactgggggccgtggagaggctggaggtgacctctccccgggtgtccttcctgggttgtactgggggccgtggagaggctggaggtgacctctccccgggtgtccttcctgggttgtaccgggggccgtggagaggctggaggtgactcctccccgggtgtccttcctgggttgtactgggggccgtggagaggctggaggtgacctctccccgggtgtccttcctgggttgtaccaggggccatggatggccgtgaggaaggtggtgccaggagctgcctatctcatggtgtggggtctgtggctccgggccaacattgccacctccctaaagagtgcactttgttatagcttatggttcttctgtgattctttattgctttccaggttctcacaggtttaagagcagttacccacacttcccccgaggacgtaagttttgctgagtccaggagagacggcttgaaggccattgcgaggtgagtcccaacagttcctccctaaagtcgtaagtctctgaaaggccagcagatgaacgctaagggggatgtttttgctcagaggcaggacttatgattcttcacttcctaggtttcctctcttccagaggatcgtcagtcccagctgctggaggctctttcattctcttgctgtcatagtcgtagtgaatgttaaacttctttagggacactgggccccttggagaattggagaatgtgtcctggcccaaggttggcaaagaggagctgaccctgccagccagtgtttggaatgatctctgcactcgttgacagacacgcacctggggccacgccatatgccctctcctccctgcaggcacacaagaggagcagtcccgcgggggccacgcacgcccccttctctcctatgccagcatccgttccctctagtcagggtgggaagtgggagggaccagccgcagggggcgtccccatccacctttcaaccggagagacggcagagcgtgacctcggggaagcacgtcccacgttccatacatgtggaaggagctctgtgtttctgatctacccgagggtcctggactgttctgagcgtgtcttctcaggatcaggaacacacatcagccctctgcgatgtggaagatgaggctcaccgatgtttgtttgttagctcacacattttaaatttcaggatttgccagactgttggtgtgaaagcaggagccccagacgaagctgtgtgcggagagaatgtttcccagatttactgtgcgctgctgggctgcatggacgactacaccacggacagcagaggggacgtgggcacctggtacgtacgtagcagtgggtgagcgcttcttctgagaagcccatctattccgtggaaactcggaggccccgggcttttctgcagggagaaatctttgtagatttgtgccgtgttttgcgttttaaaggctctggggaagatgacctgttctctgctcccgggtgagcctgcgtggcagggctttgcaggtgcttgtccagcccgtcctcaggtgttgggcctgtgtcgtcctcgttgacagggtgtgagggaggacgcgtcttcaatgaaaggctgccggctgcttacattgggttttgccaacatttcttgctgtagtgggattgataacccctgaaacgcctgtgtgtgtaggatgcctcggggccccggtgtgtgtggctgtgggtggctccctgcacacgtccctgtagcgcacagggaacctctgcaggccccgtgactccctggcagcgtgcctgggctctgtgtggggttagtcacgggtgtcgaattcacacaggctgccggcgtggtgggcagaaccagggttggaacccccctctcaagctgggtgtctctgcctctccttgtcccatcagggtccgcaaggccgccatgaccagtctgatggatctgacacttctgctggctcggagccagcctgagctgatcgaggcccatacgtgagtgtcacgtcgcagctcttctgcatcctagagggcagccccgagcttggggaggctggcggggcgggcggtcctggtgctcagtggcatttgcactgctgggcacacaccctcctcccagagagcctctctggtccctgaccccaggtttgtgcaggcccctcctcctgcccccatagccatggcgtgagctggggcccatcctcctctgcccagtgcccccaggacgaggctctgctccccagcctgggcctccaacggtgctctggccagtttgatgacagccagcttcccggggtagggccgggcaggaggtggggacttctcagcttaggaccctgaacctgggggtctgctcctgccaggaccagctgagccatcactcagttccctgcacctgaggctgccattggggcctgcccttgctgtgtgtctctgtcgggggcacggggttgtgggtacccccaggccctgccctttctgtcggtctctctgtcgggggcactgagtcatggaggtccaggccctgcccttgcggatctctgtcaggggcactcagtcagggggtccaggccctgcccttgcgggtctctgtcgggggcactgagtcatgggggtccaggccctgcccttgctgtcagtctctctgtcagggacactcggccgtggggatcccagggcctgatttccttagttctcacctctttctctttccccctccccatctcttccccagccccagcttctctctccccatccccggcctctctgtccccatcactcttctccacccgctcctgtaatcctatttgttgtccctgcttcaaccctaagacctcatcagcacgcatgtaacacgtagcacatgtgtaacaagtacgtagcatgtatttgctgcgcacctgtagggttgggctcctgggatgtgaaggtaacggagtgtggttcttccgagccagtgtcctggtgtcagctgccaactcagccaccatgtcccgaggagcccgcatgtcctcgtggtgcttgggctggagtcacggctcggaccgcctgtgctcagtttaccgcccgctcttaatttaccgcccgcccttggtttacctcctgctctcggtttgcagctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtactgtcggggtgtaggccccccgtgctggccccgcagccatggcgagatcattggcagcccggccttgtctcactcactctcttgcaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacggtgaggaggcgtcgggctggctggggcaggaggtggctccaggagtgcctggtgcttccctgtctcttgggagcatgtatggagctgggccttttcttccattgctttctatctctctcgggcatatttggttagggggtcaggggcccagtgtcttcctcatgacccaggaggcttagggcctgtgggatggttgagtctgatgaaggtgggacagggccagcgccactctcttcctgcggccgcagccttggagctcccagcgtcccctcggggttcaatcctccaggacctgtgtctgatgcctgcatgtgggtacctgggctccatcaggttctagatcggcctccgccctccactttcagggctccaggcccagcttctcatgtctgtggggagggtctccagagccttggtctgtggctgagctgtggaacttgaaggcctctctgcatcttgtcactcgtggcccctgcaccttgggtcatgacctgctttatgtggcaaccctgtgacagctgctaagtcctagaaaacacgtaacaggacgtgaggtgccctctgcgccgtgtgggcgcgtgcggggagacccgggccccaggacgtgaggtgccctctgcgccgtgcgggcgcgtgcggggagacccgggccacatgcgagcggggccccgagacattctgcactcgggaattgcggggattatcaaatcccgcttcagtgggaaacgtgagcgaaacccaaggtgagtggccgcagcctttcgtcacgtgctctcccgcatgtcctaagtgagggctcaggctgagctgccgttgccgagagccttgtgtctgcttcgggtgtctgcactgtgagtggctccgtgctggcgtccgcaccagccgcttggggccagaccttcgcgtctctgcagctcggagcagttctgctcttcagcagatgcttgaccggctgtagccaagcctgaggggtggcaggctcgggggtcccactgccttctgaggtgtctccgtgttgcagatccggcactccacccagagcctctttgagtacatgaagggcattcagagcgacccgcaggccctgggcagcttcagcgggacccttctgcagatctttgaggacaaccttctgaatgagaggtgagtggtgtctcttggggcctcagaggcgtgagtggtgctggtgcctctcaccacgttcccacagattcccggggtctcgcagggtctgtctggggtctgaagggagaagcgagacacacgctgtaccagttggtggctcagcgaggaagatgtgcctgcagcatatggttctccgggcggccaggcctcagcccctgcgcctcctcttctagcctccacatgaggcagggaaatgaccgttgtgtgtacaatggacgtaaaggtagtatgagtacaaggtggtccctgtgtgtaggaaggcgttgtgggagctcctccagcttggtgctcccacggacgtgcttgcggacgctcatcagccacccggcaagtgagagctctgtgttcctgaggatggaatgtcaagtgagaaacatcgctgctttctagaagtttctggctttacatggaggcagagtatagaccctgtgggccttgacctcagaattgggaacatcctctggaagggttgttcccagcatgtgcgaggacgaggacacgggcctggtgtcccctcgggcggggcctcggcagcctctcccatgagagcacagatgccgctctcggcaaacaggaactcggcccagccatgttttcttttctcgttacgactataatcagctgcacataaaggggcagttcgatcgattttgataggtgtccacccttaaaatcttccccagtcaggacggtgggctccagcccaaggtttcctcccagcccttcgagtccgtgcccctgacctgcgtcaccatagcctcagcccatggtcacttgaggcgctgggccgcgtgccggtcgctcattcctccgtgccggtcgctcattccgccttgccgttcgctcattcctccttgctgaccagtcgtgtctgttggtggaggcaccacagtgcatctgtctgtgggcattttggttgttgccgcatcggggctgttgctggtagagctgcaggcagtctgtgtgtgcgagcctgtgggtaggtgtgcacagctgggcctccctctctgtgggctgcggagcccagctctcctgtgtgttagtcggcctgtgctaaagctctcctgatgctcctgtcgcccagaggggacctccccagcctccttttctgtggggtaaataccgaggcgccgcaggctggctcacacagaggcgaatgtctagctttggaaagctgctggagggtttccagaacgcccacgtgtcatgtctttctgctgatgctgtctgaggtcactctcactggcgcgttgctgttttatattctctttggagaagtgtcttcatttttttctgttctccttccctgactgttgtggtctgatcctcccttgtcacacatgtgacttgagggtgttttctccctgcctgtcctttcacgcaccgagcgggggcctcacactttcctcacgtcccagcatctccccttgttctctgaggcacagatttttctggtgtgtctaagacagcttgcctaatccgtggtcactgagattttctgttttgtcctagaagatttatagttttgggttgtgtatttagacctgggacgcgtcttgagtgaggtttcttacatggtatagcgtcggcacaggcaccttgacgcccagcggtgcccaccccaattgctgggagggctcccctctccgctgcattgccgttgcagctttgtaagaaactgtgggtttactttggactctcctgtgcccgacgtgtttgcttcactttgcaccagggccgtgctgtttctatcccttccactttaccatcattttcgaagttcagcgtcagcctccagccttgtttcttctttccacagttgttttgtcttttcctgaagctttgcgtttccacgtaaattataaagggggcttgtcgctttccactgggatcctgctgactctcagccattcagggagttgggcgtccttgttgctggtgtccagggtctcacagctccttctcccctcagggtgtccgtgccgctgctgaagacgctggaccacgtgctcacccacggctgcttcgacatcttcaccacggaggaggagtgaggctctgcttttcatgacttcctttccgattaagcctaagtagctcatgtattaaagaaaaagtcatcagacacagagatcagaattccaggaaatgatcttccagtgcgttctgggtcagttatggtgactgtaaataccgtcatcacagctggccctcaaaataacgcaataataacatatttacataatgacatattatgactgtaagtgcagtcagccccatctggggctgaggcgggggccctgctgtgcactctccccccagctatcccaccgggccaggggtgggcctcagggttgtgctgggagccgcagggcctgaaggggcctcggctgtacggggatgagactcgcaggggagagggcagaggccggtgacctggcgaggacttgcccaggagattggagctccttgcttctgcgccacgcggatgccccaggctggtctcagctgggttgttggctctgagtggtcatctcgttgctgccatattttcttgcttcattgaatttcaccgtgttgggccagtctttttttttttttttttttgagacagggtctagctctgtttcccaggctggagtgcagtggcacaatcacagctcactgcagcctctacctcagcctcccaagtatctgggactacaggcatgcgctgtagtctaatgtacggctaatgtttgtatttttagtagagacaggatttcactatgtttcccaggctggtcttgaactcctggccccaagtgcctgccttggcctcctaaagtgctaggattacaggtgtgagccactgcgtctggcctggatatatttgtatctggggcacgttgggtcatccggagacagcgtggtctgtttttgggggcactgctttttttttgtttgttttgagatggagtcttgctctgttgcccagggtgtagtgcagtggctcgatttcagctcaccgcaaccccgtcccgggttcaagcagttctctcgcagacttctgagtagctgagattacagctgtgcaccatcacacctggctgattgtttgtattgttagtagatacagggtttcaccacattggtcaggctggtctcgaactcctgacctcaagtgacctgcccacctcggcctcccaaagtgctgggattacaggcgtgagccactgagcctggcttgggcgctactcttaagctgtcaggtggacccagagctgtgctggtctccagggttttctgcccctttaaggtctctgctccctggcgcttcccttcccaccgctgctggggcagtgccggggcttctggccatcttttgggtggttcgtccccagccttggacagcgtcctcgtactcaggtactggctgacccaggcccaggttagtcctcagcggcccccaggaagccccctctggtgctcagaacctgagcgagctctgcagacttggaatttcccgcttctcaccacgggcttcccgctggagtctgccacctgctggacttggctctgccttaaccttcgggcgggaggcagatctggtctctgttgctccatctttgctggacgctgcacatgtttttaaatctaacagcattgaagggtttccccttttaatttcttaatggggcatcactgactgaccttcttacacctgctgttggaacagcctccatgttcacaggtgcacccagctcggttgtggcgtattatcctttaatacaatgctaaatactccatttaaattttttttttgagatggagttttgctgttgttgcccagactggagtgaattggtgcgatctcagctcactgcaacctctgcctcctgggttcaagtgattctcctgcctcagcctccctagtagctgggattacaggcatgtgctaccatgcccaggtaattttgtatttttagtagagatggggtttcaccatgttggtcaggctggtctcgaactcccgacctgaggtgatctgcccacttctgcctcccaaagtgctgggattataggcgtgagccaccgtacctggcctaaaatattgacatatatttttctggcttaaaaatttcaaaataagcctgggcgccatggctcacgcctgtaatcccagcactttgggaggccaaggcgagtggatcacttgagctccggagtttgagaccagcctggccaacttggtgaaaccccatctctacaaaaaatacaaaaacattagccgggtgtggtggtgcctgtacggcttgggcctgggaggcgaaggttgccgtgagctgagattgagccactgtgctccagcctgggcaacacagccagactctgtttcaaaaaaaaaattttttttccaagataggatggtagagaaaatacctcctgccatgtcctgctatgaatacagctttgtatttctctctacagttttgtcagttttggcttttcagattttgaagcgtgtttgtgggctgaatcttgcccttatcacccatttctaggatgctttttgctccactcattctttgtcttgcttcacttgactttgaactgtatacttttttccatcgttttactttcagtatcttcatacatgtatgtttttgtacgcctctcttagaacagtgtatggttttgtaaaaattcagcctgtagcttttacctgcctccttcatgacctttataatccccttggttctcagcctgccactcacaggacttttccctgtgctgcgttcccagtgccccctccccgcccccacctgtgctttttgttggattagtagaattgcttttgtcattccattgttttcatatatttgtttgggacattttacttttttctgttaacgcttaccctagaaattagaaatgacaccacgtattcttagcgaagtccagttttcagcattttgtccttattggacaatagcaaggatattagaacgtgttggttccgcgtgcttccgtcttgagttatgtgctgctattgtcggatattttgtcttagatgtacgtactttcctgttcattgtggtatgtgtaatttgcgttactttgaattttccacgtttttactttctttgtctctcatcacttactgcttttgggaccccccccatcggggttcacattccctctccctagagcacactcccttggatttcctcgagtggggtctgctgcggtgaagctttcccattttatgtgcagattattttcagagggtatatagaattcaggcagctgtttcgttgtagcacattaaaaatattttcccacttcctccttgcttctgttgttgcttttgagtgttacctctgagtctgcctgtgctccctggaaacggcccgggtttcccaccccctgcccaggtttgctccttccctggtttttctgtcattatcacgctcacgtgtttccctcggtcaccccctctgcaattttcacacgtcttttccctctctctttgcttcattacctttggcccgcctgccagctgctgattctctctgaagatgtctctaaatgacttttaactgtgatttgtggaattcttattgtggagttttgcgtcttttcaggtgtaggttttttgtctcgcgtgtttccacgtctgcttgtagcgctttccgcttcgccgttccctgcggcccttccttccgtgcccggtgttcatcctcttgaatgctcttttcctgcctgtttggctgggtgtgtctgagttgcaacctgagcgggtttctttgtcttcttacttgtctggtattgtgttctctcgggacgttgcgtttgaggggtcgcacctcagagcaagccgaggtctgggctaagcctgtgctttggcaggcaggaccttagtttgccttttctgggcacctgaggagagggtagcagcagcctggggtctccttgactcacggtcagcagtgagggtttcctggcctgttgggtggctggagcttggctgcattccccactgagagagggaggtgcgcaccttctcctccctggagtggccttccaggtgccctctcagagctgctcatcagggctgtgcctttgtcagcaccaagcctcagcccttgtccctgctgccactgaaggctcaaaacaacactgcacagccttgtgtgtcctctgtgtgtcggcagtttcccccggctctgcagcagcccaggccaggtagcctctggagggagtggtggaggagcacgggcatcctggccgccgctgtgttggggacagaccctggggcctggaaagggaggtggggccccgtgggggctgctgcaccacaggcaagagagcaagagacagcagaggccggccaggtggtggcacagccgctagggaccaggccggcctgtggaggtattgggatggggaccagcggacttgctggcagaggggcctcagggctgcaggcttcttggactgagccactgggaggacggagttgaccttctttgagacagaaaaagtgtgcatcccggggctgcctgtgaaagctcatctctaaagtgtgtgttgttcttccagccacccctttgctgtgaagttgcttgcgctctgtaagaaagaaatcaagaattcaaaagatatccagaagctcctgtcaggcatcgcagtgtgagtttcaagtgctgctggccttagacggaatggcagggcgcagcctcccttggctgagggcaggagtccacggctccaggcgggagaggagcagttagtgttactcctcaagctaacctaagatcgtgcattccaatgttcaaagcagtcgcaatgggaggtgaggcagcccaggtgctggtggagggagttcccgcgggaacaggcgagctctgcctctgctgccctcgcgctctgccctggcgggaggggaggctccggaaaggagctgcgtggtcaggggctgcctccccgattctcctgtgtgccctgggggtcgctgttgagtgccttgctctgcggcgctcaggtggacactgggcaggtgcgccagccagcgataggcaccttggctgctctgtggctccttgaggtgggggtcctcatggcagggcgagcggccctgcaggagatcctctgtgaggcgtcctcacttcccacagtgactttccaagtgcgacactcgtgtgtgtaggcacagtgcagatgtacgcacacacacacctccggcttggggccccaggcccgcactgtgctcacggatctgctctgcccaggtctctgcatgggcctttgggtccggggtttgctggggttggcctgcgcggggtggggctcacctggagccatgtgctgctcccggcaggttctgcgagatggtgcagttccccggcgacgtgaggaggcaggccctcctgcagctgtgtctgctcctctgccaccgtttcccgctggtgagtgcctgcccctgctcacgtgtgtttgccgtgtggacacaagcccctcagtgacaagaaggccttcgctggcactgttgtgttggtgtgctttccagccgagcccctctcgttaacgcgcctgggtgacgacgcgtcacaggcacgcggctgccaaggggctctggacgccactgttctggctttaaggacgggctgtccggctggcgtttctatggacatacattgaggggtgacctggcggtgggatctggctcaggagcttccagaaggacccaggctgaagtggttcagccacacctaggggcagtgcccttcatccccagcactccccggctattagatttctaggatttcttttctcctggctgcaaaaaaaacctcagatgatacaaaggtgacattttcctaaaaggcaaaagtaacttcatgttgtatggtggttctcgaagtggggtgccggaccctcaggcttggcacctctggggcttcagcagtgcagctcttgggccctgtgctgccgactcagcacctccagggtgggcccggggctcagaccaccagcgcagtgagacatgatgaccagggcaccactcaaaaagagagcaggcgagattgcttccctgatgaaaagagagcaggcgagattgcttccctgatgaaaagagagcaggcgagattgcttccctggtgaaaagagagcaggtgagattgcttctctggtgagggagcaggttggttaatagatagcgggcgagattgcttctctggtgaggtagcaggttggttaatagagagcaggtgagagtgcttctctgatgaaaagagagcaggcgagattgcttctctggtgagggagcaggttggttaatagcaggcgagattgcttctctggtgagggagcaggttagttaatagagagcaggcgagattgcttctctggtgagggagcaggttggttaataaagcatttaaacaagaatgatgtcatcttcactgctgggatcctgcagctagctgtgtgtctgtggagggaggaggtggttaatgggcctggaaggcacctcctcttggttgcagccctgctgtggctgggatgggatgcagggtcagcgtcctcctcctgacgccttccactgacggggctccctggcctgggtcctgtcgtctctccggggtggggcggtggcgcttccctccggcaaatgcactgcatccctgtcccagatccggaagaccacggccagccaggtgtacgagacattgctcacctacagtgacgtcgtgggcgcggatgtgctggacgaggtggtgactgtgctcagtgacactgcgtggtgagtgaaggcccttcctgcacggccacctgggcctggcaccgcccctcttcctgtccccaccgtgtctactcgtctctcccaaaaccctctgataggaggaggaaagagggttcccaggtctccacatcctctgcttaggttttacaaggcagccgtgctgctgtagccgaaacctcttctcaaccgccctgtccccaaacagtgtcaggtgtcaggaacacagcaaagccatccatcccaccaggggagcgggcacctgtaccacaaggctgtgtctggtggcctgtggagcagagggcactgaaggcctggcaggtgctgctgccccagacctctctaaagttctcttggaataggccgtgtgagcacctgttggaaatcaagaggcacaggcggaaataagaaaagctctccccacgcctctgctctgatgtccacccccttcctcagggccatgaggccctcaggaggccatagtgccactctccacgtttactttggcaggcacagtttctgcaacatgggctggcttctttaccatgggtggagtagaatggcggttttgaaagatgtgtgtattgagttgggggtgggagggtctgaatgagagcagagtggggaaagtgcaggctcaggtgtcctgggccaaccggtatgttcctgggaacagcagtgatggtgtcttacacatatgggcatgggcacccatgctggctcacacacatgctcacttgcacgcgcgcacacacacacacacacacacacacttctaaaaggggagcagtctcgtcaccccgtgttggagatcaggactgaagcaaccagaggctgtgtgggtgtccacatggcatacccggggtggtggagtcccaggtgtcctgcctgtggatgctgctctgttttgagtgccgactgtgagggcctccgtgctgatcccggtgcgttgctacaggtctgtggggtccacgccccttgttgaatccagcaaggacgtaggtgacgttccctaggtgtctcctcggaacagtgaccttccaacagggctgggttcccatagagctcacgcaccaggcagccgctgtggcctcggaggacagaggtggcctctccagggcttccgcgaggttttctggtttggggaggagtgtgtgtctgctcctaaacaaacacgtggtcccaggagaggaaccgggagcagctgggctgtcttctcaacatgcgttgagagaatggccatcttaactactgctctggagacccgtttttacaatgatttttttaaaaaaaaacaccaaggtgcattctggaccagattctaaaataattggctttaggactgaagaagccaggtgtcccgagcggggcgaggcctcctccagcgaggctgggtcggggtggcctcctttcctcacatcagggagggaggaactagcagggtgggcctgggggcttctcctatcgtttaatcccctttctgttaaaaaaaaaaatccttagaatttaaagagaatattttaaattagaaacgaaaaacatgccccagatatctccacagcattgctagaatttttatttcgcatcaacagctaaattaaaacctggaaaacccttgtcagcccctccttggcctcgcttggtctgtcctcccgcagtccctgcgctgggcgtggtccttcccgaggggcaccccttgttgggaaggaaccgtcctcctgcgattccggaaagggctcaggctcgaggctctgctggagaacgtgctcctgtgacgtcttttctgccctcagcctggctatggatgtcgggggtgaggtctcctttccctgactgcggccatggaagcttgacgcgggacctccgcacacctgaggttctccggtgggcactcgagagactcacggctctccctctcctcacagggacgcggagcttgcagtggtgagagagcagcgcaaccgtctgtgtgaccttctgggcgtacccaggccccagctggtgccccaggtaaccctgtcaccttcacagcatgaggtgcctgtgcttccctgagctctggaatgttctggggccagcggctgtgcttagcttctgccagcacgtccacacggcccgttccctcgtctcatgtcaggacccctgggattacgggaccagcagagctgccttctctggccactgcccacacctgtgggcccctgtggcatccaggccacttgctctggggcgtttggggggccggggagtgggtggagctggcaccagcttgatccaggctcctcatgcctggccctggggtctgtttgtgctccaagtgccaagagtgccaccctacccctcctcatctgcttcccatgagtggggccggggctgggtgagaggcccccagaagctgcccctgtgcacctcaccagcccgtcactcttctaaagtaacaaaaacaagtacctcagttctctcgggggctggggcccagggttgctgtgctgtctctctagttaccagggttggctccttcctctcagcctccttccggcaggaggttatatctgagagggaggaggagaaccatgtctagatacatgggggcagtggggatgggctgagcatcaggacacagcctcccccatttctgtgtgtgtaaaggctgaactcaacagcagactttggaattaaatgtgctttttacatttttattaggaaaaatttcaaacgtgtgaatgcaggttaagagcagtgcagtgaacctcccttcccgctccccagatggggtgcccttccgaggacacgttagtcatgagcacctgtcagccacatagctcaggctgccgggtgtgtgggaaacggcacaaatggtttcctgcaggaaccgtgtcagtccccacacagggcccagaggggtgagggtcccctggctgggaatggtgtgtgttggagctgaccagcctgagcttgtcttgtctcttcttcagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagttcctgccttttgtctctgagcctgatgtgtgtaggggtgatggaaaggctcactgcccaggggtcagccagaggggaggtgggctgcactcctcctgcctggagaccaggcccccttcttgcctggtgctgtccctgctgtgggagacgtctggccacaggcagtgccccacccagtcttggagagagatgaatgttaaatcagaggttcaaatgctagagaactgagaagccctggtggcaggcatggtctggagtgctgggcagatgctgtttctgggcccgtctgcctggtgggggtgctgtcctcccccctgtgcacacgtgagcatcgtgcatgtggcccctctgcagtgcaggagtcactgattgatgggtgtgccgaccagcagcttcacaaatgtctgctgcaaggggaatcgtcagagtccaatgtgtgcctctacagtaatgtcggaaataaataccattcttgaaataattacactgtcttaggagagcctgggcagagtccacacttgggtttttaggcaaagggcaggaggctacctttgtctctgtgtctgagctcgtgctgatccatcccaaagctggtgaggggaacgtgtataaaaatttcactgtggtagcaacccacacccatctctgggacctgtgctgtgctcatagggcttgaggtgcagaaccacggccagcagcaccaaagcagccccaggtgtggccactcagaggcccaagggcttgggtgagcaaccctttccctatgtgaggagcccaggggtgccatgtgcgtggtgtagattagggtggctccctggcctgctctcaggtggggatggggcctggacacaggaacatgggcaggccgagaactgggaggtgccaccgcatctgtgaggcttgtgaggtcaccaggaccacaagaccaggactgtgacagtccgtgctgtgtgtttagcagacagctcttcacgggatgtgtgtgacgacctggccacacaggagtgtggggttaacacactactgttgttgtgtttgacctggtggccaatggtctttataccctaaaagagccttgggttacatttttacgagatttaaatattttattccaacctgtgtaataggggtctcctcctccttgaactgtcccgattggctggggtcacgtggtgagggtcctgggtgaccaggcctagccttggccacatgagtccacacagtggaaaaggcttggctcctgtggtcggcacacacgagactctggttgcgcctgctgggtgtggaacaggcgcaccatcgccatgcctgcagctcacaaagctcctgctggcctgggatgcactgaggatggaaggaacaagtggcttctgagaaaaacatgatgaactgttcttagtgcaattaaaagaagattccagataaatggcattttaagacatggaggcaggtcgattacccacccagacccatcagtgacactatgtggcaaagcagttcttcttttaatgtcggtctaacttagcaacccgaggaaagtggatcactccactggccactgcctctttcccactggatcccatccatcactggggcacttgtgctcaccagacacctggtggcctggaaagccctctttcagcagccgtttctggagcccaccagggtccaggtgatagagtttggcaaggaaccccttgctcacatgatagctggggcagacaatagcaaatgaacaagcaagcaccatcaaggcaggcaacactgagtgctatgaacaaagataaagtgggcaatggaatggcatgttgggtgttgactccgagaaggtgttcagaaaacctctctgaaggggcagcatttgggcagaggtccagactgtgtccaatggcagaaaagagaatgcttgtggtcccagaagtggagcaagctttgtgagtttagagagcagcaagaagccagtatccctgggaccggggagctgatgtgggatttgtgtacccacaaacacgttctaggtgctaaccagaaaccctccatgtgagagcagagaccttggagatcctgagggtttctgctgagccctggaatctagtcacgctattttgatagcagaatggatgagagaatttaaggcccagggccagatctaatggaccactatataaagctgggaccctaaataagtctttttcaaaggaacagcagcaagactcttatctcaatctatctcccctgaagtggcctgaattaatactacctgtatgatccccaaaactcctaaagtggaaaatttgattgacttggccctgaccagtggtattcccagacaagggcagaagatgcaaatacaaaacctctctggtagaatgtaggctataatatgagtacatttttgaaaagggctagaaatgatcaagaagagattagaaaaaaacagagcccctagaaatgtaagaagtgaaatgaaaagctcaatggatagcttagacacagctgaagagagaattagaaaactggaagatctgaaaacattatccagagaactggaagatatgacagcaacatcaagagacattgaagaatgtctaacctttgggtaattggggtctcagaatgaaatgaaatgatgcagatattccatactgacatgcaacagtccccagatacagaagcctaacagtctcacatttagacctgccacagtgaaactgcagaactgtaagaaggacagagtgatataaacgactaccaatttcccagcagcagcactggagttgagcagtgagtagaccaaggtcttcattatgctgagagaaaatagctgtcaagttgcttgaattgtgcccacagcataacattaaagaagagaacaaaattaagtcatttagataaaaatatgccattcttatctgtttggttttttaatcttggcttaatatttggggttgagtcatttgttttgagagctgtcctgtttattgcagggtgttcagcaacatcccagatggaagcagcatccccctacccagctgtgacaaaaagaaaaaaaaatgtctccagacactgccaaatatcttctgggggtgcccctggttgagaaccactgctttagtggataaactttaggcaggagggaaatgatcgcagttggatagttggaggaatgtggagcaagggaagcaataaactgtgaccataaaaacatagaaagatggcttatatgtggatttttttttaaagcacgtagaattgcttaaaatggacaacagcagcatataaatcagtggcagagttggtggctgaatttagagcatcttaagtctatgttctcctggaacagagtgcagataattcagttatcagcttggctaggtgcatgttgaagtatttagtcacacacaaacagttaatgtatggggaagataacttctatactagtaggagagaaatggaacaagaataaaaaatacactatcaaaatatgcaagaatggcaagaggaaaaggcagaacaagctgcaaaacacacacacaattagaaataaatattttgggacacaataaatgtgaatggattaaaacctctgttaatgacaaagttctccagttaaaggaaggcaaatagtgttattaggaatagattactatatgatgattaaaggctcagttcaacaggaagatgattgatagaactttcctacatttgtaacacagtcttagaagatactaaagcaaacattcaagaagaaattgatcacctactaccatagtgtattttattgaattggtacatttcaataaagtgtcataaggcacggttgaaggagaaaaacttgacccaatggacagttacagaacccaagtgtgtgtgtgtgtgtacacagaaattttaaaaatgtttttaaaaacatctctttaaaagaaataatgaaaattataaaatatataatgaaagataaaagttaatcaaaacagatagagttcacctaaagtggtgcttaagcgattctgaagtcgtgaattatacattacagaagaaaggctggaaattaatgagctgaacataagcagaggactaactgtaaagaaaattagaataagagcagaatgaaaaggaaatgaaacataataaagaaacaaacccagatggttcttcggtgaaaagacccacctgggagcagctgccatgggtccgtcagctgaagtgaaggaagtcctggccctcctgcaagtgcagtgacctcaggttgtcctcaaaggcgccccctgtgaggtcctgtcaggagcagcagattcagctcagtccggtctcctggctctaggaggccactgtggagcctcctccagggccaggggttgggggtggcctgtgtccacctgtcaagtgttctgctcctctgctaatagcggagaggctggaaggagacaaaggccagagagggcagcagccggcactgcttgtaccacaggccctgttggtcaccagaggggaggccccccctgccttctggccttgcctctctacataaggtggctgactctccctgggggcactcggaatggaatgagactaacaggcaatgcctctgctgtttgaccagggcagacccaccttccctccacacacccacccctctgcacaggccaggagtgggaggaggcccctcagacagaaactgcatctcagaaccatcaacagctgcccctgtctgatctcctctggcctctgtcatccccacccctgcaatggagtgagggctgtgaccccgggtccctggatgcttaatcttgtcctgtgtgctggccttggccaggtcacctactctcctgtatgaggccacagcaggtgtccagaaatgcctttcagacgtgccctgcaccccagcacctcctgaacaagttcctgaagacagcccggcagagtggtggacacaagtctctggcctctggcaggacagaggagggactatgcattcctgtcacagtccttggtccttgggcccagcaggaggaatcggagcttggctgcgccccttacccccaccacatcagaatccattacaccacctaccactgctgtcactcaaatgatgctgtcactcaaagccatccttcctggaaaacatttccacacactctgccgctatctgtccttcctcccttgtctctctgctctagagtttgcaaaggaaacacacctgagttcagggaccaggccagcccagtgcgtgttgacaccgtcttaaacaagactctgttaaaactagatgcttctgtaaagcaacatgttccattaggagaatgaaaaggcaaaccacaaaatggaggaagacatttgcaaaacattaaaccaacaaagtcgagcagccagaggtgtaggggactcctacaggtcaggagagacgcagcgtgcagtaggccggtggggaaccctgatgagaaacaccgccagagaggaaggaactccagtgtccagcgggcacggggggttgttggtcagactcacacctgaaaccaccatgagaacacactccccaaacggctggcgaccaagtgcccagcccagtgtgagggagccgagcagctgggccctctggctctgggcatgttcctgggcatcatccagagaagctgaggatgcagccacacccacgacctgccttccactcccaggattagacccgaggcagggatgctcacgcaggaggacacagcgtccttgcaagggcaaaccgggaaccactgcccacaggcctgggtcctggcgtggcctctgggtggggtggcgtttgcacacgggacgtggagaaagtccacaccatgcacagcgatacgcacacaccccaaacacgtggagtgaaaaccagatgcgagaacacagacactggattctgctcacatgaactacaaaaataggataaattagactatggtttagggatgtgttcacgcacacgccatgagggttggccctgccaggtgccaaatgcacgttcacaaccaacatagacggcatttcgttcctggaaaagcagtgatgtaaacgatgttgggacaattatccaaatagaaaaattggcatctgtaatcaaaagaaattccagttgtatcaaagatgtaattaaaaactagaaatcccagaagcaaaatgggacaatgttgttttttaaatttcacaaccaggagtgattgtcttagaatgaatcagactccataaatgaaagtcacttaatttgattatatcacaatggcaaaaatacaaaaatatcaaatggcaggaaaatttgcagcatgtcggagagttttccttatgaaaaatactgaccaatagaaaaatgggctaatgaaaataataatttactgaaggggaaataaagcagtttataaatatgtgagaagatgctttccctccctttaagggcacgaggcaggtgctccatcgctggtgggttgggttggcacagcagctgcgggtggtgaacagccagactgggattgaatgtgtgtgctctttgacccagaaatttttagaatttattccacacagagccacttgagcgaaattatgtatatatacaaatactgcagcagcattttaaacagcagatgattaaaaatggccaaaaggtacatcagtaagtaactgtatcacaaatgcatgaaacatccatataatcgaagagcgggtgttttagtgacaaacgtgaaccttgggtttctctttactcttccagctaacggtggaggaaggcacaacaacagtgccaccgaggtgccctgagacccgcaagctgctcccgccaaacggaattgcaggggagcctgatgcggcctcggtctgaccacctctcaaaaggatggagcagaacacgcaaaaccacagggaaccggtcggcagagtgcaggatacacaagcccattcttcagctgaactaagaaaagagcgtcggcgtcagggagacagaaaggtcatgtcgtaaaggtcacacggacgctgccgggttccagcaagcaaacttaaaacatgaagcaatttataaggcaattaggaagatttgaacatcgatgggatatttggaattctgtggtgggatggtggttttatggtccttttaacagtttttatctccttgagatagggaaataataatggatgaaattaggctagaatgagtgccacaacaccagcgtggggatttggaggtgtggaggacacataagatggacacgcttgctccagggatgggtacatagggctggtttcctgtcactttgctaatatggctcaaataagctggaaatttccctgaatagaaaagtcacagcaacagtagagcccgggggctccagcggcttcacacggaataacctccaatctacacacgtgaaaagagcaagagatggaacaagcatgtgctgtgaggccacactgccagctgcccctggaagaacaagcaagagacaggtgaccgtgggggctctgggccctccaaggacacagcgtgtgcaggacaaggaggaacctcttttcccatgctcagccggctccctgggaagggttttcaccaagtgccttggggttcatatgagtgccccaagatagtagtgacaccacaggtcaccataacacatacgataacagtttgacatattgcgagaattaccacaaggagacgtggagtgggcatgctgctggaagagcggcactgacggggttggagagggggtccctgagaagtagatcctgaagaggctgtttctgaaaaactaaaccagattcgtgtagaatttgcattttataactgcttctcggagcctcccgtttactcacctaaatgtccccggtaacttggacaacggttattcaaaggttttcattactttgctcagatccatcagagcaatcactatctttggcggctacggccttagaaaacgtctttctccaataagactggaaagttggaatgactcctggacccacggtctgcagaacggatgctgtgtcagcacaaaaacacgaacccctcgtacatcagcctcagagctcctgggtgaccaggtgcaccgtcaatgagcagtcgtattttgaaaggaatctccttttctgagcactgggcctaacggtgggcttacactattccatcaaccgtgctgtgcacagatgtgctgccacctgggccttgccgttccatttctagagccacaggcagagcagatttagcctcattcctaagaatcctaggattctcagaatggcgaccactgccttcaacttaacccatttatggctgaggttgcaatttttcgaatttttgcaatcagatcttggcagtgaccttaagcagaatataaacttgcacatgcttagcgttccaataatggaacactaggcatagatgggttttaaagtcacggcaaagagtcagactgtcttttgaagctctgaagccaggcattgacttctccctacctatgaaaggcctgcatggtgtcttcttccagttcaaggttgcttcctctacactgaagatctgtggttgagtgcggccacctccattgtgaccgtagcatgatcttctggagagcctgctgcctcacctcacactcatattacggagacggcttctttccttaagccttgtgggccaacctctgctagcttcaaacttatgttcacagcttcctcacatcattcagccttcacagaattgaagagagttgggacctcgctctgtattaggctttggcttaagggaatgttgtggctggtttgatctgtcagaccactaacactttctccctatccgcactatcatttgtgtgttcactggaggaccacttttaatttccttcaataacttttcctttgcattcacaacttggctaaccgttaggctgaaagctgggcctctcctgccagtcgtggctttcgacatgccttcctcactaagcttaaacatttctagcttttgatttaaagcgagagacgtgcgactcttcctttcacttgaacacttagagtccactgtggggttattagttaacctaatttcaatgttgtgcctcagggaatagggaggcctgaggaggggtggggtgggggggagcggggaggcgacagctgctgtcagaacattcgcattttatcaatcaagttcactgattcatatgggcgccccgagatagtagtgacaccacaggtcaccgtaacacatacagtaacagtttgacatattgcgagaattaacacgtggagatggggagacgtggagacgtggagtgggcgtgctgctggaagaggggcactgatggggttgctctcgtggggctgccacacgcctgtaatttataaaatgcacaatgaagtgcaataaaatgaggtgcgccagtagttgccagaaagctgtgcccaagaggctctgctcacgttgttctgcctggacttgacttggattagttgtgtgacagctcatcacaggccgggcagtgtagaccaacacacgctggcctcacggcttctgcggggcaggaaccgtgacccgccctggtgtggcgtgcttctagctgtcacaggtgcccatgtctgtgtgtcccccacaaccccccaacagtaccgcttggggcctggctcactctatcaaccactcacccgtggttatttaccaagaaaatgcaaagcaaaaaaagcaggggttgcaatcctagtctctgataaaacagactttaaaccaatgaagattaaaaaagacaaaaaagggcattacctaatggtaaagggatcaatgcaacaagaagagctaactatcctaaatatacacacacctaatacaggagcacccagattcataaaacaagttcttagagacctacagagagacttaggcaaccacacaataataatgggagactttaacaccccactgtcaatatttgagacagaaaattaacaaggatattcaggacttgaacgcagctctggaccaagcggacctaatagacatctacagaactctccaccctaaatcaacagaatatacattcttctcagcaccacacagcacttactctaaaattaaccacataattggaagtgaaacactcctcagcaaatgcaaaagaacagaaatcctaacagtctttcagaacacagtgcaatcgaattagaactcaggattaagaaacccaaaatcgcagaactacatggaaactgaacaacctgctcctgaatgactactgggtaaataacaaaattaaggcagaaataacgaagttctttgaaaccaatgagaacagagagacaacgtaccagaatccctgggacacagctaaagcagtgttaagagggaaatttatagtgctaaatgcccacatcagaaagcaggaaagatctaaaatcgacaccctgacatcacaattaaaagaactagagaagcaagagcaaacaaattcaaaagctagcaaaagacaagcaagatcagagcagaactgaaggagatagagacacaaaaatcccttcaaaaaaatcaatgactggttttttgaaaagattaacaaaatagaccactagccaggcaaagaaaagaagaatcaagtagacacaataaaaaaagataaaggggctgtcaccactgatcccacagagatacaagctaccatcagagaatactataaacacctctatgcaaataaactagaaaatctagacgaaatggataaattcctggacacatacaccctcccaagactaaaccaggaagaagtcgaatccctgaaaagaccaataacaagttctgaaattgaggcagtaattaataccctaccaaccaagaaaagctcaggaccagatggattcacagccgaattctaccagaggtacaaagaggagctggtaccattcattctgaaacttccaaacaatagaaaaaaagggactactaactcatgaggccagcatcatcctgattccaaaacctggcagagacacaacaaaaaaaatttcaggccaatacccctgatgaacactgatgtgaaaatcatcaataaaatactggcaaactgaatccagcagcacatcaaaaagcttatccaccatgatcaagtcagcttcatccctgggatgcaaggctggttcaatatacgcaaatcaataaacataatccatcacataaacagaaccaaagacgaagaccacatgattatctcaacagatgcagaaaaggccttcaataaaattcaacacccttagtgctaaaaactcccaatacactaggtattgatggaacgtatctcaaaataatagctatttatgacaaacccatagccagtatcatactgaatgggcaaaagctagaagcattccctttgaaaactggcacaagacaaggatggcctctcaccactcctattcaacatagtattggaagttctggccagggcaatcaggcaagagaaagaaataaagagtattcagatatgaagagaggaagtcaaattgtctctgtttgcagatgacatgattgtatatttagaaaaccccattgtctcagcccaaaaactccttaagctgataagcaacttcagcaaagtctcaggatacaaaatcgatgtgcaaaaatcacgagcattcctatacaccaataatagacaagcagagactgaaaccatgagtgaactctcacaattgctacaaagaaaataaaatacctaggaatacaacttataggggatgtgaaggacctcttcaagaaaaactataaaccactgctcagggaagtaggacacaaacaaatggaaaaaaaaaattccatgcccgtggataggaagaatcaatatcatgaaaatggccataaaataatttatagattcaatcccattcccatcaagctgccattgactttattcacagaaccagaaaaaactactttaaatttcatatgaaaccaaaagagagtctgtatagccaagacaatcctaggcaaaaagaacaaagctggaggcatcacgctacctgacttcaaactattctccaagtctacagtaaccaaaacagcatggtactggtaccaaaacagatacatagatcaatgcaacagaacagaggcctcagaaataacaccacacatctacaaccatctgatcttcgacaaacctaacaaaaacaagcaatggggaaaggattccctatttagtaaatggtgctgggaaaactggctagccacatgcagaaaacagaaactagaccccttccttacagcttatgaaaaattaactcaagatggattaaagacttaaacctaaaaccataaataccctacatgaaaacctaggcaataccattcaggacataggcatgggcaaggacttcatgactaaaacaccaaaagcaattgcaacagaagccaaaattgacaaatgggatctaattaaactaaggagcttctgctcagcaaaagaaactatcatcagagtgaacaggcagcctctggaatgggagaaaatttctgcaatctgtccatctgacaaaggtctaatatacaggatctacaagggacttaaatttacaagaaaaaacctcatcaaaaagtgggcgaaggacatgaacagacacttctcaaaagaagacatgtggccaagaaacatgaaaaaaagctcatcactggtcattagagaaatgcaaatcaaaaccacaatgagatatcactggtcgttagagaaatgcaaatcaaaaccatgatgagataccatctcacaccagtcagaatggcgatttctaaaaaatcaagaaacaacagatactggcaaggctgtggagaagtagggatgcttttacactgttggtgggaatgtaaattagttcaaccattgtggaagacagtgtggtgattcctcaaggatctagagccagaaatgccatttgacccagcaataccattattggtatatacccaaaaggaatacaaatcattctattataaagatacatgcacgcatatgtttactgcagcaccattcacaatagcaaagacatggaatcaacccaaatgcccatcaatgatacacgggataaagaaaacatggcacatatagcccatggaatactacgcagccatgaaaaggaatgagttcatgtcctttgcagggacatggatgaagctggaaaccatcatcctcagcaaactaacacaggaacagaaaaccaaacaccgcatgttctcactcataagtgggagttgaacagtgagaacacatggacacagggagggaaacatcacacactgggacctgttggagggtggggggcaaggggagggagggcattaggacaaacacctaatgcatgcggggcttaaaacctacatggcgggttgataggtgcagcaaaccaccatggcacatgtaaacctatgtaacaaatcttcatgttcagcacatgtatcccagaacttaaagtaaaattaaaaaaaaaaactactcacctcagccccccgcagccagcctggactccccacgcttggggaaaaaggctgcatttggagcccgaggcacccatcacctgcccaccccaggcaagggtcgttcacactcaggggctgaggacatccccgatgcagccacctcagtccacgggagctggaggtcctggccttggcccctcagacatggcaccgcagggcctcgtgctttgcaagtttctaacaaatgttggctttatgggtattttaagacagaagagagaccggaatccatcccccccacacccatgcaggccaccctctccagctgcctcctgcccccagggcagcggccaccaccccacagcctggtctgtggtgctgttgtggacggctgtggcacctgtccccatgcccaccatcggctggggtctcatcccaggccacacagtcattgcacagcagggcgggttgtccaggtggcagagcccgggatccccaagcccttccacggccaagggccccacactcaccagcttcacgcagatgacgaagggtggccgggcggctcggaagtgcaggatggggattcggggcttgggtctttcctgagagtgacagtggccatcagtcctgcccgagcctggagcttgt

SEQ ID NO: 37484 - DNA, 3611 bp, Homo sapiens; identical to SEQ ID NO: 35769

SEQ ID NO: 37485 - DNA, 3878 bp, Homo sapiens; identical to SEQ ID NO: 35933

SEQ ID NO: 37486 - DNA, 2678 bp, Homo sapiens
gggccgcggtgtgccgcggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgatgctcgagctgtagctgccaggcgaggatgtgtggagcgcaggcggcgcggggtaaatgagaggtctcgggccccaggacccccggggcccgggatgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcattttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggtttctgctttaatacaaaaacaaaatcttgtaaaaggtgtccaaatacatagtaatcttttccagttatgtctgattaagatttaaaactgaaggtttcattttgggagtagggttttaaagctcaatctgttatctgctaaaattgattattgttgatatgagagaagaggggaaattttatttaaattgcatttattaatctttttatctgaaactttgtacacttttccactttcaaaacctattttaagtacagcaaaatttatttaaaactgtcatagcagtaaaaagtattacgatgaaattgttagggtattaatggaacaaacccagtttcactctcttgacacacttattaggaagggattgcttcactggtttaataatttaaaagttatgtttgttaaacaccctgtcagaacagtcattttcagtattagattcctgtactattgtgttttgagtgtgttttggaaccttcatagaacacactttcttttggaatgtatttgattgataagaaagtttaaacattgttttcacctcaatgtagaaatacagtggttttgtttttttttttcttttagtgctgacaaaataaaatactcatttttgcataaaaaggttcctaatccttttgcagaataagttttgtttactctttataccaaaattcagtgaaggcattctacaagttttgagttagcattacattttaatatttactattgctacattgtataattgagtttgaa

SEQ ID NO: 37487 - DNA, 5536 bp, Homo sapiens; identical to SEQ ID NO: 36161

SEQ ID NO: 37488 - DNA, 20649 bp, Homo sapiens
atggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccagtaagtgtttggtgatgagccagggtctttgttgacggatctgaaaagtcctggtatctaaaacccagttgctaagccagccagtgttgcttacatgaactgttactgacttacctggttattgattcataacatgcattggttattcacattgttagccattgattccacctattatttattgagcaactactggttggtcattaggtaaaatgtcttactgctcattaggtgattattgaccaaatagttaagattggaaatatttttttttttcaagacaagagtttcactcttattgccgaggctggagtgcaatggcgtgatcctggctcactgcaacctctgcctcccaggttcaaacaattctcctgcctcagcctcttgagtagctgggattacaggcacccaccaccatgcccggctaattttttttttttttttagaagagacagcattttaccatgttggccaggctggtctagaactcctgacctcaagtgatccacccgcctcggcctcccaaagtgctgggattataggcatgagccaccatgcctggtcttggaaattctctgtttttttcacagacaagatctcgctatgttgcccaggctggtcttaaactcctgggctcaagcaattctcctgcctcagccttccaaagtgctgggattacaggcatgagctactgtgcccctgaccataagacttttttttcgagacagggtctctcatcactcaggctggagtgtggtggcgcagtcacaactcactgcaccctccatcttctgggctcaagcaatcctcccaccttagcctgctgaatagctgggactacagacgtgcaccaccatgcctggctaacaagatctcgctatgttgcccaggctggtctccaactcctgagctcaaggatctgcccaccttggccttccagaattctgggattacagacatgagccactgtgcccggcccataaagtctttttgatgcacagataattaacagatatgaaggatcttaatcaattaatagttttgacctaatacagcttaacagcaacaagtgccaaaatttgaggtcttactatgtgcactttacctgaatcgatcctcacatcctatgaggtattattatccctgcttttcagatgaagaaactgaggtttacaaagctagtaagtggcagagccacgagatttaaaccaggtttgacaccagtgcccactctcttcaccactaccatttgggagtactgtccttccaggacaaggaaggatagtcctctgcttttcccagaattagcaaaggttctgattgacttgataaggtagtctcaattgatacggatgataggactttgaggagggaaaggtaataaagcttacacttggtcattttgcttgtttctgtttttctccttgtgtgtccaataccattattgcatacaaaaataagtaaggggtgggcagtagggttgagggaatatgggtttgtgggagggggagatgaagcaaggaagggaaaagaatatagatgtggttgtaatttccctttttctctatttttttttcttacgcagatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaagaacctcagtcactgttctgtagggataagcaaactgaatgggtggtggaattggcagaatggataccagttcctacattcctgaccccactaccataaaacaggatgtttcctgttgcaaagctaatgagaccccacccttcttgtctcagagcaggcaggagctcatctgtcttgttctgccttcctaattaccctggaagggccagaacgaagaacacctgagaatactgaaagtgcctaaaaacccctgctcctacgttgttttcccatttaaagcagactcttcagccagggggcagtgggacctggtcttcagacaaaactccctgagtctaatgtgtgtctaggactagggcacagaaatagagcttaaaatttggggaggataaggagtgtatctactgcttctctctcccctttccccaatcctaccataccctgttcatatctctacactgcaggaaccacttctccagagggcaagaatggaggagggggacctgtccatcatagcaacatgcaaacacaagcaaaacactgaataaagaattgtttggagattatgtgcagccctactgagcctcatttatatgggctcctagttgatccatggctcgggcttaagatgagtaagatgatgagggtagcgtgccaagcagaaatcacttcagagaaaaatatcttgactttagagttgtggttctcaaatggaggcgattttgccccctaggagaaatctggcaatgtatagagacatttttggttgtcataactagagtgggccagggttgctgctaaatatcctgtaatgcacaaaataggaaacaggttttccttacaaagaacacttcagcccaaaatgtcaaaggcatctcggttgtgaaaccttgttctagagcctctccctgctcccgtgctgtgaggatcttaagactcctaaactcacagatgattgttttcaacctatttatctcaccatcctcaatgatcagaagtccaccttgagatggacttactcctagttctgccgcattctgggtttctttccagacccctcttcctcctctcacctgggccagcagggaggttggcagagggcaggaaagatgccccaaaacttaaatggaatgtcatcaggtgaagagctacctcttaccttaactcttattcggtgggaaacaaggttcctaatagggatagagttaagggcggaggcaacagcaggatgaggataattaagagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgttaggcagatagggaaaagaggggtccttagatcactggttcaaggagggatctggtaggggcagcatttcttctgggctggaaacagaatgggggtttcaagatggcagaacctgaaataaaaaaaaagtttttcttaaagaagattagcctcaaagaaaaccaaggctttaggaagaaggcactacctagtgcagactttaagctatttccacagtgtgttctttacttctgtctgcacaacaccctctcagtctttctatatcctacattctttttttttttgagatggaatctcactctgttgcccaggctggagtgcagtggcgcaatctagactcactgcaacctccacctcccgagttcaagtgattcttcggcctcagccgcctgagtaactgggattacaggcgtgtgccatcatgcctggctaatttttgtacttttagtagagacaggggttcaccatgttggccaggctggtctcaaactcctgacctcaagtcatctgctgacctcggcctcccaaagtgctgggattataggcgttagccaccatgcccggcctagatcctacattcttgaatcttcccttctaattcctccctatctcccattctttttttatattttgagatagagtcttgctctatcacacaggctggagtgcagtggcgcgatctcagctcactgtaacctccgcctcccaggttcaagtgattctcatgcctcagcctcccaggtagatgggactacaggagcacgccactgtgcccggctaatttttgtattttttggtagagacagggttttgcctcgttggccaggctggtcttgaactcctggcctcaagtgatccacccatctcggcctcctaaagtgctgggattacaggcataagccaccatgcccggccacacctccctttcttgcataagatcagggttctgagtcagggtatcaggttgtgctgttatgggggctgaggtgttagatgggtttctctaatcactcaccattccattattggagctataagcccctagaattgctccatggcctatctcggtttcccttggatctcatctgctcctgaactgcacctgtctgtaaaaaaacagatgcgagacaccttcgtaagtcttcatatcctacagtaagaactctactttgtgccttccagggaagaggctgacgccatctccttgacaatagcagccatctgctaaccaccattcctcctaggggagtctcaatgcctcttttcacactggccttcatgaggatgaggtaaaatgggtcttttactaataatattccctcacaatggattctcccctatatatctgagtttcaggatctgagaaaagactatctctagacccatttcccttattttgggaacagaagtgcatcttagacattatttaggatgaaggtactcagcttttttcctgtcccaacactcctaaatatatgatttactgtggcactgagatagcagttcttaattaggagaagggagagttataagtttttggaaaaagccctccaactattaagatatatataccccctaccccagtgaagaacaatctgctaagttgtaaagatgagagaacctaggcccagacacctaaaatgccaggtctcgggtttccacaactggtgaccaggactagaatcccaggtttttacttccccattgagtattttcatatgtccctagcttgaactttcaaaaagagggaacggttatagacctcacccctgtatcaacctctccccatttccttgttaccatggcaagtccatctccggcccccatctcccctgagccaatgtgagtcaggtgaacaaaattcattggttccccaatcatggtccggtcaatccgtcttctcttcttcttctgcttggagaagataaggagtcatgtcttaaggcccctcctccagtcagcacggaggaagggaaaagagtcttcaaaaccactgaaaagctaagggcctggtgggaagaggggatgtggcattttaacagggaaatcactagggcatgaaaggcaaagctggaacaacaaaagcacacagaagacatgaaccagagtagtgagggcagtggcctgcagagtgaacactggacaaagaaaggacatgtcaaagtcacctctgactgatgatgaaataatggggaaaactgacaggtatgcagctccacctacaaaccccacccagctcagaatggacaggaacaggaggtaatagctaggactattcacttcttccatcacccagtcccctttgttccacatatacagctgcctgaccatagaagctcctgacacagagggaggcaagaagtgtgcttttttagatggcagatcctagatggtgtggctacctcacagcacacagtaactgactgctctttgggttaggatggggggtggggagactcaccggctggggtttctctaccacacagcagcccagtttgtgccaaaattcactcatgttccctgatggttccagcttcactccgctgtctgaggccccaaagggctctttccctggtgtttggacaacccactcctcactctccccagatacaccaccaccctgggttcactcagctggatgggtccagacaaagtggaatccctggaacctttaactgagcagtgaaggtcagtgtctcagagcctgagagatgaacaggaccagagagagaggtgggcaggcaggcacaaggttatgtcttcctcagactcggaaccctggattagaagaaagtaaaaagaaagatcagtgagaaatctccccctcccccaatccttgagaaacctcctgatgagcctatatcttcccagtcctccctgagaggccctagacctgtacaccaacactcattcccaaacactatgaacctcagtttgactctaaaaaaaaggaacagaaccaaaaggacaccaaggggttaaggagcagtggctggtggtaccaagggagaggaagggggctagaagcacttagagttaagaggatgggcgaggaccaaaggatagtggcagaaattagcaaagtttggggtgatacaagctccagctcccttctctctgagtttagggcagaaggggaggggcatttaagtgactctgaagaggaaatagtggttttttgttctcacaaacaaggtctccaccctgtccctgccttttttcttaccttgccctgaacgcctagagtttctttaagaacaggagagccctggaccactgaggtcctaggagactaactggcaggttggccctcaggaaagactttctacaataaggaatttcttccctctctgtttgctgccctattcctcctgatttccctccagtgaaatccaatccctcccagaagccagtcagcagcagttcctttattacctgaccttgagatccttcctgaaggctgtgtacattctgtttatctgtgtcctgtatcactgcactcctgtgtgtacacctctgtttgcacatgcgtggcatggccatatctccacgtgtgtccagtacagatcatctgtgtacaggttgtgggtacatgtgccaggtatcttctgtcccatgaggaatattttccccaccgtccacatgtcctatctgccactctgctctgcctcacaccctatagggcccaggctcccctccagctgtgacctgttctcccctccctcctcaccaattctatcctcaagcttcatcagtgaaccagacataaggaactttccaatagtactagtgtccaaggaagaacttcctcccttctcactactgccagccagggtaggacacatctgggtttcttcttagactcacttgcatttccccagtcctatagtacagacaacctcaaagattccaaaaagggcagtttcataaatatgacactttaacatgaacaggaatctccctttcttgcaggccgggaaccctgatgctttggcaccctagactgatttaaaaacaagagataggccgggcgtggtggctcacgcctgtaatcccagcactttgggaggccaaggtgggcggatcacctgaggtcaggagttccagaccagcctggccaacatggtgaaaccccatctctgctaaaaatacaaaagattagctgggcgtggtggcggatgcctgtaatcccagctacttgggaggctgaggcaggagaatcgcttgaaccggagattgcagtgagccgagatcgccactgcactccagcctgggcaacaagagcgaaactccgcctcaaaaaaaacacacacaaaaaaacgagatagcagggtgtggtagcatgtgcctgtcatcccagctactggggaggctgaggcaggaggatcacttgagcccaagagttgcggctacagtgagccatgtttgcacccctgcactccagcctgggtgacaggacaagaccctgtctcaaatacaaaacacacacacacacacacacacacacacacacacacacacacagaggttttttttttttttaacagccttgagatgagatcacacaaacactcaaatgtagcttctaggggaggggagaacccaggaggctgggctttctcttctcttctcaccactggaagggaggagtaaccagaaggagcggaagctaaaacacgctgtccagagaggggagctgtggtcagtgggacgtcagtgagtcagtcatagggtttgtcctgatggtggtggtggcaggtggtaagggttggggaaaaatgaagaattagaggaaacccccaacaccagcaggcaggctgtactgtgactggactctccctcaacatcccccactctgctcaaagctgagggacagaggtggatagtgctgggagggaagagaagagagggggaggagaaggagagagggaaaggggcagtggagagaacaaggccatttctgtttcttttccagggacctgaccagagctgggtggagggaaagcgtgtgtgtgggacttggcatgaaatgaccaatgatgacgagaagtgaccaggaaattccattccctaggacattagggtctctgaaacttgagggtggggtcagagtgtgaagaagacaggtcagggtgaatgtgatggtagcgcagggcagtgggggatgggaacaaagccagaaaaggaagtaagagccactggcggccactcttctttaaagcagccagaagagagtgggttgaggaaaaatgaagtcctgagctggtcagcccaggcggaagagccacccgaatccaaccccacagtgaatagggaaggggctgagaaaacaacaggagggatgaggattagacctcataaggccacgtcctgagagccaagtggtgctcagaactcgacctctctgagttccaaatggcaagagtgaaatatggaaccgggaaagccaccccccgcccccaccaagatcatactaggacttgagggtctcagagctgttgggaggtgagcagaagggatgggaaagaggtgccagggaggaaggatgtacaggctagttctctggtcctgttcgggccccaaaccggttctcccggtcccaccgcctctggccctaaggcctccaacccgcggcctgacaagccctcacatgaagcagctggagagaaagaaagaatcgagagaatggcatgggcaattctggctagaagcccggggcagcagctggtccctgtgtggagaccccgagacatggagggctgctgagggactctggagaagcggtgtggactccatatttcagccaagtgacaggcccaacaccaaccttcccttccccaggaaaggtcttctgggggcttaagaggaaagagggctaggccctaagcctcccctccccaaatatattcaatcacacagattccgtatctgtctccccccactacacaactctacctagaagttctctgctgttctcaacccttaaccggactgggacctctctgggaatctttcggaccctctccctcccacctcccccaacattccagttccttcttttccttctactcttcagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagcccggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggtaaaccaaactgagggagggggcagggggctgcaaagatagaagagcggctgcttatggttagattgaaagaccccacatgaggtgggggacagctgaagaggagagaagggggcgctatgaacaatgggtagttatttcttcacagcatccatgccttgttaccttatacagaccattaatctctaacaatttacttgtagttatttctcagcacctacctcatttcaagtatccttttctgtaatttattgtcctgtgtatttaatatcttcagtctacttatcttccttttcaaaccataatttgttttaccagctgtttaatttttagtcctactgtatctctctgtcctctacttccctatacttgcaatttttttctgtagtgttctatgtttctctgtaggagggagtttgggagggggttatatgggataatgttgggtgtaatcctgacctttctttggataatctctttcattccacctcgaatctttgctccaaagaaagaggcagcctagggtaggaaaggtgggggcctctgtgttggagaactgcctgattccatagtgaaatcagtatagcccacaggagctaggtatggggacagattctggaaaagaatgatttgcagctcagtggaattggtggaggaatgctagtaggaaaatccaagctctgactgaggcacacattatgagatgtcagagaggttctgctcccctctaccaccaccaccaccttgtccttcccccttccccatggtggcagcatgacacagcaaggccctgttgagtaggccttggatgcccacaaagggtctggacaaaggatatttgggcgtgtctgtgtggctccgagagtgtatctttctaatctatacatttgctaatcatgtatctctaagaacagagtgataattagatattgcctttgcctaaaatacccggataatttaaagtgaaggatagtgggaagcatttattgaacatatattgtggtacaaggcactgtcaaaaccctttaagtaaatgataccatttaagataatgaaagatgtaaagatagatgaagtagggctggagagcatttgtggaggggaaggggaagctagccaaaaaaggatcttttgcgaaatttggagtatttgataattaaatccatactatattaaatcaaaaatgtcattactacttacattagtgaatagcattttaacttcaattttctgtgtagtattactttatgttcttgacttgattttaatgccacgtatgtttgcatgcatgtctttcttgaatgtatttggtaccctgtgtacatgtctctgggtcaatgacatagagattttaggccttttgagttaatatttcataaaatttgctttagctttttaaattgcaagatagctctaccaaacactcagggactgtttgagcagttttttatacatactctggttgtaagaaaaggagtcagtttgtcgaagagcttttttttttttctcagattctagcttgctctactgccctttgcttttccccattcagatcacaattacaggaacaatcacctaaaccacggaaaatctattcttcagcaactaaaaattcttttaagttttgggaatactggtatagggttatataaagctgttggcaactatccatgtacaacacaaaaagggatcagattgggaattatgagatctggattctatacaaactggctggaagtcttcccaagtcattaatttctaagatgtcttctagttttaaaattctatgattttttccccccatgattctattttttttttttttttaagatggagtctcgctctgttgcccaggctggagtgcagtggtgcaatcttggctcactgcaacctccacctccccagttcaagcgattctcctgcctcagcctcccgagtagctgggattataggcgcctgccaccacacctggctaatttttgtatttttagtaaagacggggtttcactatcttggccaggctggtctcgaattcctgaccttgtgatccacctgcctcggcctcccaaagtgctgagattacaggcgtgtgccaccgcgcctggccccatgattctattttttaaagagcctataatgtggcctgcattatactaagctcattctggagaagacttgtcaggtaggatagagaaaagaacccagctagctgtgaaaataactggtaacagtaagaatccctgtagccacaagtccataacagtattgactcctaggtatgcttcttagaatctctatagtcccagatttaagcagtgggtggttggttaatggatacaaccattttttgtagctctctttctgcacacgtctctgcaaagtactatggagattatcagagttgagtatcataggatgatgacctcacctttccaacatgctccccgaccctgctgcaatcccggcatcaccctccttctaagcagcttctctgctgagtaatgctcagttcccagggtttattttggaacttaaactaagaaaaagaacaactcagaattcactttcaacattaaaaacatcctagcctacccactcaccattcctgaagcccccacactctcacacatcactgtgttctagattaacactttctttttctgccttagtacagtcatttcacattatactggagcattttggaacctatttaaggccattatttaggagtctctggcctggtgagacccaatagggtgtgttggagaaaggccttttgaaacttggggttctgtttttggaggtgatagaatgttctttctgctcctttgggaacatttcaactaatgcttctttttttaatttttatttatttattattattattattgagacggagtcttgctctttcgcccaggctggagtgcagtggcgctatctcagctcaccgcaagctccgcctcccaggttcgcgccattctcctgcctcagcctcccaagtagctgggactacaggcgcccaccaccgcgcccggcttaatatttgtacttttagtagagacggggtttcaccgtgttagccaggatggtctcgatctcctgacctcgtgatccacccgcctcggcctcccaaagtgctgggattacaggcgtaagccaccacgcccgaccacaactaatgcttcttgacccttggctagtaagtagcagggtggaggctgtaggcagctctaatagtcctaaaatatcaggcagggcttgggtagaatgagtagagaaagtgatagatccattaacgcatggaagagtatctgattctgttaaaataccttcttccaatctgaactttactttaaatccaaatggatttccaatccatttgctctcattatcatcagtatactcgagcactgggatcagagaaaagagatccctgttacagcataggaaagttatttatttatttatttattattactttttttgagatggagtttcgctcttgttgcccaggctggagtgcaatggcgagatctcggctcactgcaacctccacctcccaggttcaagcaattttcctgcctcagcctcccaaataactgggattacaggcatgcgccacctcgcctggctaattttgtatttttaatagagacaggatttcaccatgttggttgggctggtcttgaactcctcacctcctgatctgcctgcctcggcctcccaaagtgctgggattataggcgtaagccactgcacctggctaggaaagttcttttagcacctaggttttgttctgaaggagaggtaggctagagagaaatggattgttaaggcttacctgtgggctaatataagggaatggcaaggtattaattaaatagtgagggaaagttaatcagcagccttgaatggctttgtgtacaaagcccaccacttgtgtacagagaaagtagattggtctttacccttggggaaactcctaggtatggggacagattctggaaaagaatgattatttgcaattcagtggaactggtgagggaatgctaataggaaaatccaagctctgactgaggcacgcatggtgagatgccagagagcttctgctcccctctaccaccaccttgtcctccccctttccccatggtggcagcatgacacagcaaggccctgttgagtaggccttggatgcccacaaagggtctggacaaaggatgtttgggcgtgtctgtgtggctccgagagagtgtatctttctaatctacatatttgctaatcatgtatctctaagaacagagtgataattagatattgcctttgcctaaaatacctggataatttaaaatgaaggataatgggaagcatttattgaatatatattgtggtacaaggcactgtcaaccctttaagtaaatgataccgtttaagataatgatagatgtaaagatagatgaagtaggggtggagagcatttgtggaggggaaggggaagctagccaaaaaaggggtcttttgcaaaatttggagtatttgataattaaatccatactatattaaatcaaaaatttcattactatttacattagtgaatagcactttaacttcaattttctgtgtagtcttattttatgttcttgacttgattttaatgccacatatgcttgcatgcatgtgtttcttgaatgtatttggtaccctgtgtacatgtctctgggtcaatgacatagaggttttaggccttctgagttaatatttcataacatttgctttagctttttaaattgcaagatagctctgccaaaccctcagggactatttgagcagttttttattcatactctggttttaagacaaggggtcaatttgtcaaagagctttttgtttttctcagattctagcttgctctctactgccctttgcttttccccattcagaaggcaataaggccatccctatacataaaatacattaacagtgatctgtaatcccaaactgatggagttaggtaaaactctacagggtgttgggggagatgctggaggaaatagagtagatgaagctgagtaaaagtttaaggaagtcatctgcaagaggtgagtttatagtaggatttagaaggcaagaaggaaaatagaaagcagaaaagtcacggaaggtcttttcacacataccatgagctattaaaccaaagtcaggaggaagtcaagtatttttaagtataataggagtttgggctaggggaacgggggttcctctatagacttggagttttttgtttgttttgttttgtctttttgttttttgagacagggtctcactctattccccaggctggagtgcagcggcacaatctcagcccactggaacctctgcttcctaggctcaagtgattctcccactcagcctcccaagtagctgggactacaggcgtgcaccaccaggcccagctaattttttgtattttttgtagacggagttttgccatgttgcccaggcaggtctggaactcctagtctcaagtcatccgcctgccttagcctcccaaagtgctgggaatacaggtgtgagccactgagctcttgaatggagtcctgaaatgtggaaagtcttttttttaagacagaatcttgctctgttgcccaggttggaaggctcactgcaacctcaccctgctggattccagcaattctcgtgcctcagcctccctagtagctgggaccacaggcacaaaccaccatgcctggctaacattttgtatttttagtagaggcagggtttccccatgttggacaggctggtctcaaactcctggcctcaagtgatccacccactctgcctcccaaacttctgagatcacaggcatgagccaccacacctggctgaaatgcggaaagtattttaaggtggagaatggagagagttaagcaagacaggaatgagcataactgtaacagaggatataccactgctgggaagaatgggctagattttggaaggccttgaaaatcagacccaagatcaatttgatgcaatagatggtaaataagtcattccaagatgggaagtttagaaaatagtagaaattcggccgggcgcggtggctcacacctgtaatcccagcactttgggaggccgaagcaggcagatcacgaggtcaggagatcgagaccatcctggctaacatggtgaaaccccgtctctactaaaaaatacaaaacattggccgggcgtggtggtgggcacctgtagtcccagatactcgggaggctgaggcaggagaatggtgtgagcccaggaggtggagcttgcagtgagccaagatcgtgccactgcactccagcctgggcgacagagcaagactccgtctcattgagagaaaaaaaaaaaaaaagtagaaattcataataaagggtttctgaagcttgtccaagggaacttggattctctccagaggcaattggggatggtgagtttcttttttttcctccccaaattcctttttactggtgggattggaggatatacaattttctttctttaatagaaaaaaaaaaaaaaaagaaattcctttttaccagtatgtggagtatctaagcaaggaaaggccatgggccacaaagaagttgctgtagcatgaagactgacaagtggtttctttctaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacgaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccagg

SEQ ID NO: 37489 - DNA, 3611 bp, Homo sapiens; identical to SEQ ID NO: 35769

SEQ ID NO: 37490 - DNA, 894593 bp, Homo sapiens; identical to SEQ ID NO: 36625
  misc_feature (112862)..(113361): n is a, c, g, or t
  misc_feature (135376)..(136707): n is a, c, g, or t

SEQ ID NO: 37491 - DNA, 22616 bp, Homo sapiens
taacgctccctaaactgccacttgctcagctccgcgcctaaggtgtctattagtacgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagtgagtgattcggccctgggcgggtgggctggtcttctgccctgcccctgggtacagccctcggtgctctattcccgttccagtctgttgcgagttcaggtctattcaggattctggattacatcctaacgtgggcgagtttctgttgaacgtgattgcacgtatcaagatgtgtgctcttagatttgttttcaatccagataatttcagaaatacattgtttagtacctcaattggaagtctgaatttttttctgatttcacaatgaactgtggaagtggatcgcttgttttactacacctgagcaaagcacaacagaaatttaatttatcgcgtttattacttatttgtaggatcgaagcagctcaatgtccagatgttgtggtagctcaaattgacccaaagaagttgaaaaggaagcaaagtgtgaatatttctgtgagttttattaaccgtctggagattacccccaaccccccaattaaaagactaacgctcttcctatagtatctgacagcatcaattatgacgtaagatttgactactccgtgcaaagttagacattcgcttgtactttttccttcagaaagacaattggcatttactgcctctaaagaggctttctgtaactctagcctttgtggagtgttgcccatcttacttcaggacattatccagtcctttcaaaggagtctttaaatgggttacttatgttatcttttattttttgcttgtttgtttgtttatagagagggagtctctgttgccagctggtctggaactcctggcctcaagtgatcctccctcctctgccacccaaagcgttgggatcacaggcgtgagccacctcacctggcccctttattttttaaggaactttttccagttattggattggtgtttaatcttagtgtgctttgcatgttctgaatttgaccaagtttcactttttttaagaatagaaacccagatgtcttacactttttttttttttttttttgagacagtttcactcttgttgcccaggctgcagtgcagtggtgcgatctcagctcactgcaacctctgccttccggtttcaagcgattaccgtgcctcagcctcccgagtagctgggattacaggcgcccaccaccacacccggctaatttttgtatttttagtagagacggggtttcaccatgttgtccagtctggtcttgaactcctgacctcgtgatgcgcccacctctgcctcccaaactgctgggattacaggtgtgagccaccatacccggccttacacttttatagctacttgcacactctggacattttcatttatttatttatccagcacatctttaattaagcaactaggttgtgccgggcattgggaattcaacagagggtaagacaaaaaaggttcctacccttgtagagtttacataccctcctgaggaagacagagagtaaacaagcaaacaaataattacatattgtgattattgctatgaagaaaataagcatgtataataatcaataaatgacagaactactgtagaggaatcatagaagggctctctttttcccccttttttttttgcgtctcaatttttcgcccaggctggagtgcagtggcacaatctcagctcatcacaacctctgcctctcaggttcaagagcttctcttgcctcagccccctgagtagctaggattacaggcgtgtgccaccacacctgactaatttttgtatttttagtagagacgtggttttaccatgttggccaggctggtctcaaactcctgacctgaagtgatctgcctgcctctgcctcctaaagtgctgggattacagatgtgagccaccacgcctggccagcaaaggtctctctaaggaggtgctatttaacctaagctcaaaggagggtggcattttattttatttctttttcttttttttttttttttgagatggagtctcagagtctcgctctgtcgcccaggctggagtgcagtggcgcgatctcggctcactgcaacctctgcctcccgggttcacaccattctcctgcctcagcctcccgagtagctgggactacaggcgcctgggagagtggcattttaaatagttgatagtaatttccttttcatgctcaaagtagtttctctgatacttgtaatcaggaaattttaattcagacactgtaatttttcctataattcctcttcagggttttttagttgatggacatttaatggaacagaatgtcttaatatacctaatttgatggattgattgattgattgattgagacagggtctcgctttgttgcacaggccagagtacagtgccacgatcatagctcactgcagcctcgagttcttgggctcaagccatcctcccacctcagtctccccagtagctgagatgacaagcatgtgccaccgtgcccagctaattgtattttttgtagcgacggggtcttgatatgttgctcaggctgtatgtgctcttttagaaaacagaagtatggctgggcttagtggctcacacctgtaatcccagcactttgggaggccaagtcaggcggatcacctgaggtggggagttcaagaccagcccgaccaacatggagaaaccccatctctactaaaaatacaaaattagccgggtgtggtggcacatgcctgtaatcccagctactcgggaggctgaggcaggagaattgcttgaacccgggagacggagattgcagtgagctgagatggccattgcactccagcctgagcaacaggagcgaaactccgtctcaaaaaaaaaaaaaaagaaaacagaagtagacaatttaaagttaagcgtctttaagtacattttgcccataccaaagttcttatttttaattttattgatacataataatcataatttcatgctttatcacgcaggcacaataataattgtacatatttatggagtatatgtgatattttgatacatgcatacaatgtataataatcagtaattaggatagccatcacctcatttatcatttctttcttttgggaacattcaaatcttctagctgttttgaaatatacaataaattattgttaactgtagtcactctactgtgctattgaatgctagaactcattccttctaactgtatttcataccagaattctttatttgtggtatatctctctttttgtttctgttttgctattctagaaaggcaggtagggctagatcatattctccaggctcatgtcatttagatttcatagaaactccaactataaacctttccagatttctctgattaaggtgactaaggctctttccctaatatttttaactgagatataaataataaagtgaaatgcctacttttttacatctgcaaaaatattttattttcttgtataatctttattttattatacactttatcttggttttacttttgctttgcagaggcatgagattctagttttgacactaatgttgatcctaatatttgtgaacttgatctctagctttcaggatgccaacccgcccctgaaggttattccccaacacttcaatggcaacagcaacaagtggcacagttttcaactgttcgacaggtaagtgtcatatttaatctaattaagcccctgttggatttatttctgttcttagactgtagctggaaaaataaaatttatgatcctaaagtatacagaatattcatgaattaattaccaaattatttttataatcattagacatgatacagtttgaaatattttctaagttttgtttatttttatttgtttgtttatttatttcaatagttttggggaacaggtggtttttggttacatggataagttctttagtggtgatttctgagattttggtgcacttgtcacccaagtagtgtactctgtacccaatacatggtcttttacatctcaccccctcccacctttcccatttttcaagttttagatggttacaattttgtgcagaaactgatttcagttatccattttttgaagagtaccatctaatgtctaagttttcttcctttagaatgtgaacaaacatagaagtcactggaaatcacaacagttggatagtaatgtgacaatggtatgtaagtttctcagttttaagatgtacaatgtatacctgattgaaagagtctatatttacttccagtcgttaaagattcacttgcctagtcagtgttactttcattctcttcaatataccattaatagtaacaattcattacattagtagcctggaaagtatagattttcatgacaaattttttttttttttttttttgagacagggtcttgctctgtctcccaggctagagtgcagtcatggctcactgcagccttgacctcctgggctcaagtgatcctcccaccaccgccttccaagtagctcgaacttaaggcatataccaccatgcccagctaattgttaaaattttttgtagagacaaggtctccctgtgttacccaggctggtctcttactcctgggctcaagtgatcctcctgccctagcctccccgagtgctggattacaggcatgagctactgtacccagcctttcatgtcaattttaattcacaatatcttgggggactttggataggtgactgtgaaacttccacaagtttttaaggattcttctagacatttactttctaggaaataaatacattttcaatatttacaaaaaaaattgaataaagccttaatggattttcctgatgaggtgatggtgccatgcagtaaactcacatgtttacagaacttgtgaatggattctgcttctgcttaatgtgatgagtctgtgtcacaattccagtgacatataagtgaaacctgtcatgtatattgtcatgcatatgtcctatattttatcagtttagatataactttaagccctttagtagatatatcaggactaccaaatgaaaaaaggagttggaaagatgatacattgtctcaggacagtagtttttaaccttttaggggacttcatattctttcgtagaatctaatgaaagctatttatcttcagagggaaaaaaaatgcacctatgcacaacattttagtttcaggtagttcatagattttagattttagaagcttcctttaggcagtgcttcctgatatcttttacatggtgacacattagaataaatgactgcttgcatattcttcctgaaaccagccgaaagctgagagattcagtatatggcatctctgtatgcttctgcataccatttggaagctctgctccaggaaaagcgtgaagggaagtaacttatcacttgccaatggtcatttaacttgtaaaaggtatagctagtccttctatcaaagaagcatgcgcacataaacacacaaaaggtatgcttaaggttcaaacccaagttggtctgtctctaaagcctgtgtgcctttgactatgcaatggtgccttcctagtaccaaggatgtatgtatgtagtagggacagggctaggtaggtaaatatattttttttcttacttagcggaaggccttttgggtgcatgcccactaactaaaaaagaagccacatcagtaacattatgacttgataaaattttgtcaaaaatggaaatgacctaacataattgattcaataaactatggtccatcagaacagtggaatattatgtagcaattttaagtgtttgtcatggcaaatgcaaacatcatataagtaataaaatgaaaatgttttaaagtacactctgagccaggcacagtggctcatgcctataatcccagcactttgggaggctgaggtgggcagatcacctgagctcaggagttcgagaccagcctgggcaacatggcaaaaccctgtctctatttaaattatttaaaaaataaagtacactgtgatggcaactgtgtgaaaacataaacatttgtttattaattgatccaataatttaagcatgtgctatatttaataatcaggatattcagtactaactgaaacagaaacagcttctgacctaatagagtgttaggaaaaggtagataaccttattccaagacaatagggtttaactttgtagtggtctcatgttcatcgtgaggttttattttattttattttattttatttatttttttgagatggagttttgctcttgttgcccagtctggagtgcagtggcacaatcttggctcactgcaacctctgtctcttggattcaagcaattctcctgcctcagcctcccaagtagctgggattacaggtgcctgccaccacacccagctaatttttgtatttttagtagagacggggtttcaccatatttccaggctagtctcgaactcctgacctcaggtgattcatcctaaggatttaatgaaagctacttatccctagggggaaaatgcacctatgcaaagtaatatacaaggtgatatgtacaaacaaaggttattttgttaaggaggttatattgagctgaatgcttctcccaaatagtcctgcgtcctgctttttctgtctggcagcatgagtagatctgtttcttctttgactggacaacccttcaaatatgtgaaatatgtaatcatgtctctttacatgggataaatatccttcattctattaagtgttcttggtgcattttttcccccatacttatttctgtctttatcatcctcttttggacacaccattgtctgtcagtgtccactaaagtcttgtccaaactaaacacatcttggctgggcacagtggctcacacttgtaatcccagcactttgggaagccaaagcagaagaattgcttgaggccaggagtttgagaccagcctgggcaacatagtgagacaactatctctacaaaaaaaatttaaaaattatcaggcatggtggcacatgcctgtagtcccagctactcaagaggctgaggtggcagaattatttgagcccgagattcaggctgcaatgaactgtaatcacacctctgcactccaacttgggcgacagagcaagaccctgtctcaaaaaatgtaataataaggaaaaacaacatgtcccacatattgtgtagccacttaggcactatgtttgtcagggctgccataacagactaggtggattaaacaacagaaatgtatttattttctcagtcttgaaggctgaaagtcaaagaacaaggtggcagcaaggttggtctctttttgtttgtttgtttgttttttgaggcagagtttcgctcttgttgcccaggctagagtgcaatgacgcaatctctgctcactgcagcctccgcctcccaggctcgagtgattctcctgcctcagcctctgggtagctgggattacaggtgtgcaccaccacatccggctaattttttttttttttgtatttttagtagaggtggggttttgccatgttggccaggctggtcttgaactcctgacttcatgtgatcgcctgcctcggcctcccaaagtgctgggattacaggcgtgaaccaccgcacccggcctaaggttggtctcttctgaggcttttctccttggcttgcatagggccaccttctccctgttttctcacgtggtctttcctctgtgtgtgggagtccctggtgtctctttgtgaatccaaatttcctcttataaggacactagtaagattggattacggctcaccctaatggcctcaatttaaattaatcacttctttaaaggccctgtctccaaatacagtcacattctgaggtactggagtttaaggttttaacatacaaatttgggggcagagattctccccataactggctccgtatctttgggttgcggtaatgggaatatggaaggacttaacttctttttttttactgttcagtgtaaaaattaatacacaggaataaatcagtttttttttttttcttttagccaaaatctgaagatgaagaaggctggaagaaattttgtctgggtgaaaagttatgtgctgacggggctgttggaccagccacaaatgaaagtcctggaatagattatgtacaagtaagggctgtgtggataaacagaacaaaaagcattttaattttggtgcaccacttaatataaggggtcagcaaactctaccctgggccaagtccagttcatggccttttttatatccatgagctaaggattgtttttaggttttgaaagagtaaaaaagaaacaaataatatgtggctgagactttatgtggcctgcaaagcctaaaatatttgctgtctgactcttgatagaaaatgtttgccaacccagacttagtttattagctcttcaacctaacaaaacagcttagtttctgaaacaatttactgtgactttttttagtttggcttcatatcccttatgtttggcttggtaatcattttatgagttggataagattcatagtttttttaaatgatgaggcatcaggcaaacagtgttatgagtagccagggaaaaaatggaaatcgacacaattagatgctttaaaatgcataatcacatctatcacttcatgggcctgtaaaaaataaatcacatattctaaagatgaaatgttgaggatatctttaaaattcatgtggctgtaatcataagttatgtagacaactccttgtccttcaggatttacctgcccccaagtttgcaggtgttccttgagaatccagtgcatgcctctgcattagcgcttactccctatagcatgtagttcttttcagttcaacaggtatttattatttgctatatggtgccacattgtgtttttcacatttaaaactaatttttcctaaaaatgtaaaaagccccaagaatcaataaaaagaccaagaatcacccctcccctgcccaagaaaaaatagccaaaggatatagatacctcacagaaaggaaataaaattattcttatatgacaagatgccaaaaatcacttgtaatagaagtataacataactatgccaaggtgctatttttcaggtaacatattggccaagaaagtttgatacaccatattgacaagagctggggaaacaagcactcttagacgtggtacaggagtataaatagactcaaatcttagggaagttaatttggtactctttctatataaccaattgatcttttggatgatatccttaacatatgctacatttcaaaaatagctatatatatatatatatatatattttttttttttttttttttttttttttttgagacagggtcttcttccgtcatccaggctggagtgcagtagtgcactcatagctcattacagcttcaacctcctgggctcaagcaatcctcccacgtcagccttcaacataccaggggcagcaggcacccaccaccacacccagctaatttttaaattttttgtagcgataagttttttaattttttaaaaaaatttttttgtagagagaagttttcaccatgttgcaaggttggcctgaaactcctgggctcaggcaatcctcctgctgggattataggcatgagctatcatggctagccaaaaatggtttttaatttataaagaattaaaacttacttatttagcttattttcagagaatacatacaagtaaaatacaccatgttaaaaaaaacccttaaggaagtaagcgtttaatgtatatcctcttaagtttctcacaaatcagtggtattttcataattagcaatcacagcctcagactccaaagtagacttttaaaaattgaatcaaattaggttttaaaaatgtcattctaattcaagtgtccttaattcttgaaaatattagctttagctgaagattttgaaatggtgtatacaacatattaatgtcatcttatcaatgttacagttttattggatatacttaataagttagttttttcaagtactatcatgtaaaaaatttttagtctttaacattttacttactaaaatcatactttatttaaaaatttacaaattcagaccaggtgaggtggctcatgcctgtaatcacagcactttgggaggctctggcaggtagatcacttgagctcaggagttccagaccaacctgggcaacatggcaaaacctcatctctaccaaaaatacaaaaaaattagctgggcgtgttgacatgcacctgtggtcctagctactcgtgaggctgaggtgggagcatcacctgagcccaggaagcagaggttgcagtgagccaagatcgcgccactacactccagcctgggtgacagagtgagaccccatctaaaaaaaaaattacatattcaaaatttaaggcgttattttcttccgcattacaaacatagtagtttccggaatgtctcattgttatggacaatgaaagaattttcttttatttgttctttgtttctaaacaacagtgtggcaagaaattcaccagtttgaaaaaaaaaaatgaagcttataataccatttagtaaaattcagtctcattttttctttcagattggttttcctcccttgcttagtattgttagcagaatgaatcaggtaaaattaataatagagatatatgcattcttttgtttgcattgtgtgtgaaagtatttgaattgttaatacatatactgaattcttacagtatgcaagactttgtcctaagctctttaatggttcttatttaatccttactacaaccctctatggagagttattattgataactactttttatagatgaggaaacagcatttgaggttaagtaacttgcaggtggtttttcagcaagtaaatggcagtactgagattcagtgccaggtagatctaactccagagctcatgctctgtcttaatcatggtgctagagtattcatttctgtagctttcagttataagtcttagattctggggtttgaattaaatacaaggtccctgacttacaatggttcagtttaggattccttttttcccaccatgcctggctaatttttgtattttcagtagagagaggattttgtcatgttggccacgttggtctcgaactcctggcctcaactgatccacccaccttggcctcccaaagtgctggaattacaggcatgagccaccatgcccagccattttaggaattttcaactttacaatgtgtttatcagcacataaccccattgcaagttcaggggcatctgtactaaggttagattgctatttctagttctagatgtcctatacattctattaagattgaaatatgggccgggcgcggtggcttatgcctgtaatcccggcactttgggaggtcaaggcaggtggatcacaaggtcaggagttcgagaccagcctggccaacatggtaaaaccccatctctactaaaaatacaaaaattagctggatgtggaggtgtgcacttgtaatcccagctatttgggaggctgaggcaggagaatcgcttgaacctgggaggcagaggttgcagtgagccgagatcgtgccattgcactccagcctgggcgacagggcgagactctgtctcaaaaaaaaaaaaaagaaagattgaaatatatgatttcttggatcaaaagggaagaattatggagtttggttcttcagttttttaggagtaaggactcttattcatttaaaaagcaaataaaaatttaattttatcttcacatagcattgggtacctttggaagcctttttttttttttttggcagggtctcattctcttgcccatgctggagtacagtgatgtgatcttggctcactgcagtcttgtactttggggctcaggcaatcctcccacctcagcctcctggtagctgggaccacaggcatgtgctaccatgcctggctaattttgtttatttttggtagagacaaggtctcactgtgttgtccaggctggtctggaactcctgagctcaagcgatcctcccacctcagcctcccaaagtgctgggaatacaggtgtgaaccactgggcccagccaacaattttttttgtgggtgatattctcttggaaataatacacaagctgacagtgttacttaatcatttgcattaagatattgtagcagtcatactaaattccatcagtgtcatttttgttgtaaccatcaactgtatttgaataaaccagagattattttcaagagtttgataaatccatctgtatagtttaagaacagatttttctccacctaaatttttattcagatttgtactttgatttaatttgaatttagaaataaactgatggtttttttgttttgttttgttttgttttgttttttgagagggagtctcgctctgtcgccaggctggagtgcagtggcacaatcttggctcactgcaacctccacctcccaggttcaagcaattcccctgcctcagcctccctagtagctaggactacaggcgcacaccatcacacccagctaattttttgtattttagcagggatggggtttaccgtgttggccaggatggtctttgtctcccgaccttgtgatccacccgcctcagcctcccaaagtgctgggattataggcatgagcccaccgcgcctggccaactgatggtatttttacaaatacatctttttttttttttttttttgagacagagtttcgccttttgcccaggctgtactgaagcggcaggatctcagctcactgcaacctctgcctcctgggttcaagcagttctcctgtctcagcctcccgagtagctaggattacagaccccgccaccatgcctggctaatttttgtatttttagtagagacggggttttgccgtgttggccaggctggtctcaaactcctgacctcaggtgtgccattgttttttttttttttttttttttttgagacagagtctcactctgttgcccaggctggagtgcagtggcaaaatcctggctcactgcaacctctgcctcccaggttcaagggattccccggcctcagcctccctagtagctgggactgcattcactcaccaccatgcccggctaatttttgtatttttagtagagatggggtttcaccatgttggcctggctggtctcaaactgacatcaagtgatccacctgcctcggcctcccaaagtgctgagattactggcaagagccactgagcctggccacaaatacattttcttttaaccttgtgaagtctttcaagtagttacaaactaaattattaatagttacaaactaaatcctaggatttaaaccaaggtgttagttgatatttgaaagtgtgaaaatatttgttttaaaagcctcactggggctaggcgcggtgcctcacacctgtgatcgcagcactttgggaggccgaggagggcggatcacctgaggtcgagagttcgaccagcctgaccaacatgcagaaaccctgtctctactaaaaatacaaaaattagccggacgtggtggtgcacgcatgtaatctcagctactcagggggctgaggcaggagaattgcttgaacccgggaggcggaggttgcagtgagccaagatcgcaccagtgcgctccagcctgggcaacagagtgagactctatctcaaaaaaaaaaaaaaaaaaaaaaaaaagcctcattggataagccgcctaatcaaactaattagagtcaaacaaattagctttctttgaaagtttaaagaatgaggccatttttaacatcagagttgctttctaaataaacttaatgaaactcatgttgaattcatgttttattattaatacaactcttctccaccccctctttttttttttaggcaacagtaactagtgtcttggaatatctgagtaattggtttggagaaagagactttactccagaattggtagtattgcatgtttttcttttcataatgtaggcaaaaattagacgttttgggtcaactgtgggccacatatacaatggtgctcctataggattataatactgtatttttactgcacattttctttttttcttttctttttttttttttttttttttttgagacaaggtctcgctctgttacccaggctggggtgcagtattacaatcatagctcactgcaaccttgatctccccagctcaagcaatcctcctgcctcaatctcctgagtagctgggactacaggcgcatgcagccacgcccagttttttttgttttttgttttttgttttttttattagagacaaggtctcactgtgttgtccaggctggtcttgaactgagtccaaatgatcctgcctcctcaccctcccaaaatgctgggaattacaggcatgagccaccatgtgtgcggccttttgtgttttttaaatagagacgaggtctcaccatgttccccaggctgatctcagactcctaggctcaagtgttcttcccaccttggcctcccaaactgtttggattacaagcatgagccactgagcccggctcctttccagtatttaaatatgtttagatctggccaggcacagtggctcatgcctgtaatcccaactactagggagggctgaggcaggaggatcacctaaggccagggaggttgaggctgcagtgagccatgattgtgccactgcactgcactctagcctgagtgacagagtgagaccctatcttaagaaataaatatatggtttttttggatgcacaaatgtttaccattatgttacagttgcctacagtattcagtatagtaatgtgctatataggtttgtagcctaggagcaattggctatgcaatatagtctaggtatagtagactataccatctaggtttgtgtaagtatactctatgatgttcatccagggtcaaaaatcacctaacaatgcatttctcagaatatatctcccttcattaagtgatgcatgactgtacttgatgtgatgctacggtatttatttattttttatttatttgtttgttttgacatggaatctccctctgttgcccaggctggagtgcagtagcgcgatctcggctcactgcagcctccacctcctggtttcaagtgattctcctgcctcagcctcccaagtagctgggattacaggcacctgccaccacacccagctaatttttgtatttttgtagagacaggctttctccatgttggccagactggtcttgaactcatgacctcaggtgatctgcccgcctccacctctcaaagtgttggaattacaggcgtgagccactgcacccagccagtatttatatttatatttatatttgtatatgtgtgtgtgtgtgtatatacatatgtataatctgaactatacttgtttgtagtcaaataagaaacactagaatgtaaatcaacatactacttccttcattgagaaagtcttggagaaaaaaagtcaatgaaagagttgatgtatatcctggtacaaggtacaaactccttatctcattgcagacaagtttgttttttttttttttttttttttttgagatggagtctcactctgtcacccaggctgcagtgcagtggtgccatctcggctcactgcaacctctgcctcccaagttcaagcaatcctcctgcctcagcctcctgagtagctgggacaagtgtagagaatatttaatttaaattaaatatttaatttaaatgctagctttacatagtaaatgtatcccttaaaatttgagtcaagttgaaacatataatttttttttatagaaaaagaattccacaatttgtaaaagaaacctggatttgaatctttttctgtaagaaaaagtcttaactattgatttgagtttgcctgaggaacccatttagtgtgttgtataaattgctatttaaattttgtcctaatattttttaggtttccccgaagtgatatgttgcttagaataaacaaagttgtatatactactggtggaaatacaaatttggtataacctttccaggatacaatctggtgatcatatctgaaaaaccttgatgaatatacataccctttgtcaccattttacttgcaatacttaataaactttccccatgttgttaaatgagattaaacaagggaatgttattaaatactctaaacaagacacttaacattcccttgttaatcccatttaactacaagggatggctgagtggggtggctcactcctgtaatcccagcacttagggaggccgaggtgggcggatcacttgaggtcaggagttcgacaccagcctggccaacatggtgaaacccccatctctactaaaaatacaaaaattagctgagcatggtggcgggcgcctgttgtcccagctactcaggaggctgaggcaggaggattgcttgaacctgggaggcagaggttgcagtgagccgagatggcaccactgcactccagcctggatgacagaacgagactccatctcgaaaaaaaaaagaaaaaggacaaaaacaacatggtaaacattttattatgtattataaataaaaaagatggctacaagatgatattacaactgatgaaattgtattgaaaaaaggttgtacagccgggcatggtggctcacgcctgtaatctcaccactttgggaggctaaggcaggcagatcacttgaggtcaggagttcgagaccagcctgaacaacatggtgaaacccggtctctattaaaaatacaaaattagccgggtgtggtggtacatgcctgtaattccaggtactcaggatgctgagacaggagaattgcttgaacccgggaggcagaggttgcagtgagccgagatcgcgccattgcactccagcctgggcaacaagagtgaaactctgtctcaaaaaaaaagaaagttgtacatacgaataggaaaaacaagaacatttttaaagtgaatcaaagtttgatctggaatgttgggactgcaggttttttcttgtgcttgtggtattcttcacagtttttctgcatcaaatatgtattcattttgtagctgaaaaccccattttaaaagggagtggggatacattgagcctgtcaaagtatttataaaagtgtcaaaagattatttcatctgtagtatagtttctttgtatgtccccagaggacaaaattatacaattataaaatgatttctatatctgtccatacagaacaaagaaaaaaatgtatcttaattttttccagtatttatattcatcttaatgtagtgttctgcttacaaatgagaacttcctatcataagaatatctgaaacaaactctttggagatcagggaatattttgaggtatccaatgtcctgtgtctgtaattataggatacaagagataacacctggctctccaaatgaggctttcttgtctatacccaaacataatatagttaaatgttctatgaatttattcatagcagataatcaggcataacattggacatttaaaaaataaacttctggttcagtatttgtctaaatattaattttttgaatttttttttagggaagatggctttatgctttattggcttgtcttgaaaagcctttgttacctgaggctcattcactgattcggcagcttgcaagaaggtgctctgaagtgaggctcttagtggtaagttgcaacttactgtttaaaattaaaagcacccaccaatttatatggtggtaaagaaggagttcagtgaaataggaaaacacatggaatattttattggtggcaattagatttgtaaagcccaaaataatagtagcttaaataatatggaaatgttttctgagataaagaagtctgagccgggcgtggtggctcacacctataatcccagcactttgggaggctgaggcgggtggctcacctgaggtcaggagtttgagaccaacctggcccacatggtgaaaccccgtctctactaaaaatacaaaatttagctgggtgtggtggtgggtgcttgtcatcccagctactcaggaggctgaggcaggagaatcgttcgaacccaggaggcggaggttgcagtgagctgagattgcaccactgcactcctgcctgggcaacagagcaagactctgtctcaaaaaagaagtaggtaaaaaaattagatttttactaagatggcagtaacccacccacacctttgagttttgtcatatgtggctttcatcctcatgctcatcttatgatccaagatggctgctgtagcttcagccttttttttttttttttttttttcttttattgtgagatggagtctcgctctgtcaccgaggctggagtgcaatggtgcggtctcggctcactgcaacctccgcttcccaggttcaagcaattctcctgccttagcctccagagtagctgagattacaggtgcccgccaccatgcctggctaatttttgtatttttagtagagacagggtttcaccatgttggccagactggtctcaaactgctgacttcaagtgatccacctgcctcagcctcccaaagtgctgggattacaggcatgagctactgcacctggtgtgtgtgtgtgtgtgtgtgtgtgtatatatatgtgtgtgtgtgtgtgtgtatatatatatatctttatatatatatctttatataattcagtaatgaatatatataagaacagtaagaatcctgtgtcttgactgtacagtgattaatatatattatatatattcatatatattctatatatatcctcacatatattgtatgcattatatagaggaacaataagaatcctgtgtcttgactacagtgataaatatatttattcatatatgtatattaatatatatttattatatatgaatacatattcactacagttaagacacatatataatatatatgaatatatatatatatattcatcactgtacagttaagacacaggattcttattgttcctttagtaggaaccagggaaaaatttcccccaagttatcccccttagatccctctttatttttttttccctattcagaatctttatttaaaagatagtcttagatgtttctcaaggaatcattaactctacagttctctgctttttctttgagggctcctatttccacatgatgattactgtcatataataaagttttcatgtttcgtgttttacatcttaatagaaaatttatttcaaaagtaataggaacagacaatatttaaatttttctttttttttttttaggatagcaaagatgatgagagggttcctgctttgaatttattaatctgcttggttagcaggtatagttaatccttggcttctttattatttatcagtgaggtcagtgaggttagatcgtatttattacatttggtttttgtttggttggtttttttttgagtctcactctgttgctatagttagggtgcagtggcgcaatcacagctcactagagctttaacttcctgggctccagcaatcctcccacctcagcctcctgagtagctaggaccacaaccaagcaccaccacacctggctaattaaaaaaaattgttcgtagagacagggtctcactatgttgcccaggctggtctcaaaactcctgggctcaagcgatcctcccacctaagcctccgaaagtgcagggattacaggtgtaaagccactgcattcagcctgcatttttgtttaattgcctgtgtcctgcgttcattttcagttgtggcatatttttatttagtatctgttttatttcatttcttacatagaaattcttcttggaatttatttgaaaactttttttgttgttttgttttgagacagagtctcgctctgttgcccaggctggagtgcaatggcaccatctcggctcactacaaccttcacctcctgggttcaagcaattctcccccctcagcctcccaagtagctgggcttacaggcacctgccatcatgcccggctaatttttgtaattttgtggagacggagtttcaccattattggccaggcagtaaaacacacatatttattttaggtctcctcctggacatatttttgttccatagatcagtgtttttatttcattgccagtacctttttaaagctttataatatacttaaatattgggaaggcaagtaatcttgtttccatattttcacatattcaatatctagtttcttgatctacaataattatgctgctgatgataattaacatttactgggcaatttgtgccaagcatttttcttagtgaggaacccatttaatccttctaaggtgggtactgttaacagtttacagatgaggaaaccatggcagagagaggttaaataatattactaccatcacaaagctagtaagtgttagagtaatgatccaaacccaggcaactttgactccggagctaaacttttaactatgctgatcaaaaattaagctaatacctacctcatctgttggtagtagcagttaaatgagatgatatagcattgccctacttactttatgtatagtatctctactctttacaatagatcagagttgtgtttttgtttttgtttttgttttaataaattttttcctttcagctctgttggacttgatttttttccttttacagataatgacacagattcagaaaggttaagtaattggtagctcagcaaaccagtaattaatgaaacctcagacaagtatagtttctgactgcctcagttgagattttacagtattatgcaattatgaaagcaaaaacattcaagtgtattttttgccctcaaaaagttagataaaaatggaaaaagttctagactacaaaaggttctgaagctaacagctttacaatagaagacacaaagatttgaaagtttaggaaaaaaaggaccgggcatggtggctcatacctgtaatcccaccactttgggaggccaaggcgggtggatcaccttaagtcaggagttcaagactagcctggccaacatggtgaaacctcgcctctactaaaaataggaaaattagccgggcacggtggttcacgcctgtaatcccagctactcgggatggtgaggcaggagaatcacttgaacctgggaggtggaggttgcagtgagctgagatcgtgccattgcactccagcctgggcaacaagaacgaaactccatctcaaaaaaaaaagaaaaaagaaaaaaaaaaggaaagctgggcacagtgactcacacctgtaagcccagtgctttgggaggtcaaggtgggaggattgcttgagtccaggggttcaagaatgcagtgagccatgacaaaatctgattagtgattttcctttttatttaatcttataattacataaaatagttaccttgccaaagttaaaattataattcaaggtacatttggagtattttagcatccatctttatcctcattatcctcttttttcctttctcctctagttaaccattgtattactaatttttgtttcatcttttcattcattgtttctttttaaaagtataagtaggccgcatgtggtggctcaagcctgtaattccagcacttcgagagactgaggctggagaattgtttgagcccaggagttcaagaccagtctgggaaatgagccatgatcatgccactgcactccagcctgggtgacagagtgagaccttgtctcaaaaaggaaaagaaaaatataaacaaacacgtatattggcagtcctacacatactcacataaggtagcatacagaacaatctgttctgtacttcgttttttttcacttaataaatcctggaaatcatactttagcagtataaatacgttcctcatactttagcagtataaatatttccctcatttctctttttatggcttcataattttccactatgtagacatactatagcttatttaaccagtttcttattgatggacgtttgggttgcttatggtctttggctattaaaaatagtgctacagttaatatctttatacataaattttttgttttttttttactaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaat

SEQ ID NO: 37492 - DNA, 22116 bp, Homo sapiens
gctgtcagcgctgagcacagcgcccagggagagggacagacagccggctgcatgggacagcggaacccagagtgagaggggaggtggcaggacagacagacagcaggggcggacgcagagacagacagcggggacagggaggccgacacggacatcgacagcccatagattcctaacccagggagccccggcccctctcgccgcttcccaccccagacggagcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgaggtaccggacagaggcccgggggtaggacctgccccactggcagtgctgggaccccgtgtgggggaggcgctggggctttgggccgctgtacaggaggacgcggatggcacctcggtgctttaacggaaggggcccctaggcagacacgtggggagggttctaggaagaggccccaggcgcccggcgaggggcaggaaggaggaagagagagcctggcgtcctgctccttcggtggaagcgcgcgcggggcggggcccggctcgaccaggtgtgtcctcacgggtggacacacacctgccccccacctgcccgggcgtgcagacccacgtgtgcgcgctagaggggactgctgacggctccggggttcgaaacctggcttcactgctttcttgtatcttgggcaaggggcgtgcctctctgtttgggtttcccagctgtccaatgggcgaattacaggacctccctccaggggagagggtaaagcgattaaaatcgtgaccggggcccggtgcggtggctcacgcctgtaatcccagcactttgggaggccaaagcatgcagatcacctgaggtcaggagttcaagaccagcctggccaacatggcgaaaccccgtctctactaaaaatacaaaaattagccggatgtggtggtgggcacctgtaatcccagctacttgggaggctaagacaggagaattgcttgaacccgggaggttgcagtgagccgatatcgcgtcactgcactccagcctgggcgacagagcgagactcttgtctcaaaggaaaaaaaaatattgtggcagggcgcagtggctcacgcctgtaatcccagcactttgggaggccgaggtgggtggatcacgaggtcaggagttcaagaccagcctggctaacatggtgaaaccccgtctttactaaaaatacaaaaattagccgggcatggtcgcgcgcgcctgtaatcccagctactcaggaggctgaggcagaagaattgcttgaacctgggaggcggaggttgcagtgagccgagatcgtgccagtgcaccctagcctgggcgacagagcgagactccgtcccccctcccccccaaaaaaatcgtgacaggtatatcctaggcggccaacaccattggcccggggcactgtctacactgtgcgcttgcgggccacgtcggtgtctgctgagcggtggctgctccaggagcccgcgcccgtcaggcgcaagtgggagggcgcgtgcacacgcatggaccagtcctccaggtccacggggtacgcacaggcacgggatggcacctgtgcacgggtgtgtgcgtgcggcggggcccccacgtgcaagaatctggcgggcgcggttggcttccggagggaggggcccacctagagagcagaccagggacccgagaggcctcggctcctgggtaaggactgtccaggtgacctcgagtccctccttgcagtacctggagatgcgcttcagccgcgcagtgcggctctgcgggactttgcagtacattgtagccacggtgagtggcctcggccccgccctccgctcagggccccgagagcgtcagccttcactagcccggcccccaccattcaagaccccgcccagaccccgccccccatgctcccgttctgaccccgcccccatcagtcccctcccacaccacagccggcctgaccccgcctgcactctggaagacccggcctatctgccccgcccatattctgggaccacccttctgcctcctctccccatccccaactcgcccagacgccctccctgctcacccgccccacactctgtctacagatgctgtacaccggcatcgtaatctacgcaccggccctcatcctgaaccaaggtgtgactctgggagattagggaagcatgtctgggaagagaaagggagggagaggagaacccaagactaagtttgcgccccgcccaggggcctaacagggggacctctttttgcatagtgaccgggctggacatctgggcgtcgctcctgtccaccggaattatctgcaccttctacacggctgtggtgagtggccctgggaactcactccatacgggggatcgggcccactgtgtctcttgtggggagactctgggcttgcccctttctcctgaggaagcctctgtcccagctgggacccagtgtcctcatctttatagtgaaaaatgatctgaaaagcttattgctgagaatctagaggtatggtagcttcaggcatggctggatccaggcttccacctcttctggcttccagtccagcaggaagtgagctcctgcttcatcctggggctggctgaggtcccagggagggctacctttggctggctcaggtctgaccttgatggcgatattatcatcgtagtgataataatagtaatggcggccgggcgcggtggctcacgtctgtaatcccagcactttgggaagcagaggcaggcggatcacctaaggtcaggagttcgagaccagcctggccaacatgatgaaaccccgtctctactaagaatacaaaaattacctgggcgcagtggcacgcgcctgtaatcctagcctctcaggaggctgaggcaggagaatcgcttgaacccgggaggtggaggttgcggtgcgtggagattgcgccattgcactccagcctgggcgacagagcaagactccatctcaaaaaaatataataataataataataatagtaatggcagcaatcactcactgacactcgtatatgtcaagtcatattccaaatctttttcacttattaacttgtttaattctactgggcacagtggctcatacctgtaatcccagcactttgagaggccaaggtaggaggatcacttgaggccaggggttcgagaccagcctaggcaacatagtgagacccccccccgcccccatctctacaaaaaaaattttttttaaattagtcgggcatggtggcacctgctgtagctccagctactccggaggctgaggcaggaggatcacttgagcctaagagttccagtctgcagtgagctgtgatcacaccactgcactccagcctgggcaaaagacagaaaccttttctttaaaaataaaataactaacttaattcttacaacaacacagtaagaaggtattattattaatcccactttagagaggaggagactgaggcatagaagggcatcagtcctaggcaccactgaaggccaggtcccccatctaaccgcccctctccctctctctgtcccatgctgcagggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggagtgagtgaaaatgcagaggatactccagcaggatggggctgggaccagtgcggtggctcatgcctgtaatcccagcactttgggaggccgaggcgggcagatcacttgagctcaggagttcaagaccagcctgggcaacatggtgaaaacccatctctacaaaaatacaaaaattagctgggcgtggtggtgcacctgtggtcccaggtagttgagaggctgaggctggaggattgcttgagcccggtaggtggaggctgcagcaagctgagatcacactactgcactccagcctggatgacagagctagaccctgtctcaaaaaaaaaaaaaaaaagaggctgggtgcagtggttcatgcctgtaatcccagcactttgggaggccaaggcggggggatcacctgaggtcaggaatttgagaccagcatgaccgacatcgagaaaccccatctctactaaaaaatacaaaattaggctgggcgcggtggctcacgcctgtaatcccagcactttgggaggccaaggatggcagatcatgaggtcaagagattgagaccatcctggccaacttgatgaaagtccgtctttactaaaaatacaaaaattagctgggcatgctggcaggcgcctgtaatcccagctactcaggaggctgaggcaggagaattgcttgaacccaggaggcagaggttgcagtgagccgagatggcatcactgcactcccgcctggtgacagagagagactccgtcccccccctaaaaaaaaaaaaaattagcagggcgtggtggcgcatgcctgtaattccagctactcggggaggctgaggcaggagaatcgcttgaacccaggaggcggaggctgcggtgagccgagatcacaccattgcactccagcctgggcaacaagagcgaaactccatctttaaaaaaaaaaaaagaggatggggctgggctccctttgtgccgtgggatggtagaaatcagccaatgcctcctgctccaggaggccctcgctgctctcttctcctcccctcagaccagattgggggctaaagcctctctgaactctcagctgggcaaagaaaggtttttaagtgcgtggatagatgattcagtaaacaaatacgtgaattttcaatctggcaaatgcctatgcatatgtcaaacccactccatttattatttatttatttttaatttaattaatttttttttttttgagatggagtctcgctctgtcacccaggctggagtgcaatggcacgatctcagctcactgcaacctccgcctcctgggttgaagtgattctcctgcctcagcctcccaagtagctgggattagaggcacccgccattattcccagctaatttttgtatttttatagagatggggtttcaccatgttggccaggctggccttgaactgtgacctcaggtgatccatccgccttggcctcccaaagtgctgggattacaggcatgagccactgcgcctggccaacaaaacccactccaaatgtcccctataaggtccagaagcgctgtctggggcccttgggagggtgaagtcagcgtgacatctccacgtggctaacttgccctgtccccacccagctttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctgtgagtgtttcggggagcaaggtcggggtttctgggacatgctgcccccctccaccagcctgaggctatcccctaagcctgaggctgcctcttcccccagggccctgctcatcaaccaggtcggcctgttcctgatcgtgtccagcgctgcctgctgtggcatcgtcatgtttgtgttctacactgactgcgaccctctcctcctggggcgcatctctgccccagaccaggtgagtcccacccaggctcctggttggctctgcactccctcactagcttggtgggattgaggtcgaagagcattcctagcagagggaatggcctgtgcaaaggccaagaagtaggaaagagctgagaggaggccaggtgcggcggctcatgcctgtatcccagcactttgggaggctgaggcgggtggatcacctgaggtcaggagtttgagaccagtctggctaacatggtgaaaccctgtctctactaaaaatataaaaattagctggacgtggtggcacgcacctgtagtcccggctactcaggaggctgaggcaggagaatctcttgaacccgggaggcggaggttgcgatgaagggagatcgcaccactacactccaccttggatgacagagtgagactctgtctcaaaaaaataaaataaaataaaataaagagttcagaggaggatctgcaaggaatgggaaaggtgagtctgggaggcaatggaccgccctcagtaggtgtgagcagacaagggccacattcagatctagagttccagagagttccaaagatcccctgggagatgctcaggaggagatgaaaccatgacccaggccgggcatgttggctcacgcctgtaatcccagcacttttggaggccgagacaggcagatcacttgaggttagaagttcgaaaccaacctggccaacatggtgaaacccccctccactaaaaatacaaaaattacctaggcctggtgatgcatgcctgtaatcccagctactcgggaggctgaggcaggagaatagcttgaacccgggaggtggaggttgcagtgagcagagatcgcgccattgcactccagcctgggtgacagagagagactccatctcaaaaaaaaaaaaaacaaaaaaaaaaaaccaaaacaaggctgggcgcggtggcttacgcctataatctcagcacttttggaggctgaggcaggggtatcacctgaggtcatgagttgaagaccatcctgaccaacatggaaaaaccccgtccctactgaaaaatacaaaattagccgggtgtggtggtgcatgcctgtaatcccagctactcgggaggctgaggcaggagaatagcttaaacctgggaggcggaggttgcggtgagctgagatggcgccattgcactccagcctgggcaacaagagagaaactccgtctcaaacaaaaataaaaacaaaacaaaacaaacccacaaaaacaaaaacaaaaactgtaatccagcgggaactaatcatgttggtgataataataatgacagctctggtctcccatgtcccaagcgtccactctgtgcctcatgctgttcccttcaccagcagttagttctccatctaatctttcttctgagaaaggcagggcagtcacggctccaactttacagatgaggaaattgaggctcggggggaagtcactgcctgaggtcaatgggcaagtcggggggcggtgccaggacccatgcctaggtcacaccccaagtagagttctgaccatggggttcagagttagcagagggtacgggggaccaccccatctgcagtcctccctggaggtcagatccgggactgctggactgtgtaacttcagggagggactgtactctctgcctcacagtcttcatcaataaaatgaggatgacacgggtccctgcttcacagggatcccagggctcagaacacagtggggctcagggacaattctcaggttcatgcagttgatcaacaaatgcacattatagcctgaggaacatagggagaccccatctttacacaatttttttttttttgagccagagtctcactctgttgcccaggctggagtgcagtggcgcaacctcagctcactgcaacctctggctcccaggatcaagccattctcttgcctcagcccccgagtagctgggatgacaggcatgcgccaccatgcccagctaatttttttgtattttttgtaggggtggggttttgccatgttggccaggctggtctcaaactcctgacctcaggtgatccacctgcctcagcctctgaatgtgctgggattacaggcatgagccactgtgcccggcctttctttcttttctttctttttttttttttttgagacagagtttggctctgttgtgcaggctggagtgcaacggcgcgatctccgctcgctgcaacctctacctctcagattcaggcaattcctctgcctcagcctcccaagtagctgggactccaggtgccaaccaccacacccagctaatttatgtattttgggtagagatgaggtttcaccatgttggccaggctggtcttgaacttctgagctcaagtgatccacccgcctcggcctcccgaagtgttgggattacacgcgtgagtcaccctgcccggccagacccctatctttacacaaaaatttaaaaaaattagccaggcatggtggcgcacacctgtggtctcagctactgggggactgaagcaggaagatcgcttgagcccaggagttctaggctgcagtgagccacattcatgggactgcactcccgcctgggcaacagagcaagatcttttctcaaaacaaaacaaaacaaaacaaaaccacagacaaaaactaaatgcatattaaatgccgactctgagccctgtccgtcttgggtgctggggacgtgcagcatcaggacagatagatgccccggtcctcggggtgcagctgtctgggaggctgacccccagttctccccagtacatgcctctgctggtgctggacatcttcgaagatctgcctggagtccccgggcttttcctggcctgtgcttacagtggcaccctcaggtgagcacccctgcttgttcatggagcattatttcagcccctgggagcctccttatcctggcctgccatccctctggggcatggaatgttctggacctgtccatcagtcccagttcctgcttgatccctagaagacagctcaggtaggcgctggcagagagcatgccctgggcacagggaccccaactgcaagggtttaccttcttatcacctgtcagggccacgcctgactctcctctcttcttcttccttctttccttccttcctccccagacaaatatttgttgaacatctactatgtggcaggtactgtttttttttgttttttttccggatggagtcttgctctgtcacccaggctggagtgcagtggtgccatctcggctcactgcaacctccacctcctgggttcaagcaattctcctgcctcagcctcccaagtagctgggattacaggtccacgccaccacagccggctaatttttgtatttttagtagagacggggtttcgccatgttggccaggctggtcttgaactcctgacctcaggtgatctgcatgctttggcctcgcaaagtgctgagattgcaggcatgagccaacgtgctcagcccaggtactgttgttctaaaccctggggcacagccatgaccaagcagtcccctgcttctgccttccaaggccacacactcaggtggtttccactcttccgggacttctggtcacatgccctcactgtcccttttgcaaatctcccacatgtgactgcagtccctctggaaccagaacccacctgtctgtcccacctgcccttggtcacaggtgtccttgctcctgtagggatgtctcaggtcttcggggaggggaggggcaaatatctccttcacctttgcaggactgggttacccccaccgttgccctcaggctgggtgaggtctggcaggccagatggtgtggacggtctctccatatggcctgaggaccccccgctgccttcctcacacagcacagcatccaccagcatcaatgctatggctgcagtcactgtagaagacctcatcaaacctcggctgcggagcctggcacccaggaaactcgtgattatctccaaggggctctgtgagtttcagggagacctgggtgggaggccagggcagtccctccccgttgaccgtgccatcctcatccactacagcactcatctacggatcggcctgtctcaccgtggcagccctgtcctcactgctcggaggaggtgtccttcaggtgagaccccacctgccccctgccctggtctcctgagaggtgggggcacctttccctctttcccattaaactgaggctcagagaggtcacatgtgtcagtggcagaactcacttctatgttttttttttttttgagatggggtctcactgtgttgtcccaggttggtgagcagaggcccgatcatagctcactgcaacctccagctcctgggttcaagccatccttccacctcaatctcccaagtagctggagttacaggtgtgtgccaccatgcctggctaatttttttcttttttcttttttttttttttttgaggtggagtgtcactctgttgcccaggctggagtgcagtggcatgatctcagctcgctgcaacctccaccccctgggttcaaggaattctgcctcagcctccagagtagctgggattacaggtgcatgccaccatgcccgtctaatatttttgtatttttttttcttgagacggagtctcgctctgttgcccaggctggagtgcagtggcaccatcttggctcactgcaagctcagcctcctgggttcacgccattctcctgcctcagcctcccgagtagctgggactacaagcgcccgccaccacgcctgactaattttttgtatttttagtagagatggggtttcaccgtgttagccaggatggtctcgatctcctgacctcgtgatccgccctcctcggcctcccaaagtgctgggattacaggcgtgagccaccgcgcccagcttatatttttgtatttttattagagatgggacttcaccatgttggccagtctggtctcgaactcctgacctcaagtgatccacccgcctctgcctcccaaagtgttgggattacaggtgtgagccaccacgcctggcctggctaattttaaaacttgtttttagagacagggtctcgcttcgtgcctaggcttgtcttgaactcctggcctcaagcaaccacccgcctcagccttccaagtcgctgagattaagaactaagttctatttgatgccagaggccatcaggggacttttttgcagctggctggcttggggtgggggaattgggaagggggaggtggcgacagaaagggcctccctatggaggttgcagtgagccaagatcgcgccactgcactccaacctggacagcaaagtgagactctgtctaaaaaaaaaaaagaagaagaaagggtctccctggcttgagggtgggactgccacccccaagagataatcagtgtctttgcctccaacccaagggagataggcaggaacaaggggggggggtcctctcccctttagggaaactgagacacagaggagtccttgagacccacattggagttcctgaggtctcgctttcccagcgggtaaactgaggcccagagcggtgggagggctccgccctcagccccacttccacctactctcccagggctccttcaccgtcatgggagtcatcagcggccccctgctgggagccttcatcttgggaatgttcctgccggcctgcaacacaccggtgagtgggggcggggcaaggggcggggaggggcggggccggacaggcccctccccttccctgacgccggctctgcccccagggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccaggtgagcagacttgagggtaggggggtacccgagccctggatggtgtgatcttgaagggaaacttacttgccctgcactctgtgtaagaagcctgattagtaaaatgcattcctgggggagggaacggtaggtgcaaaggccctgaggccacaatcgggttagtcccagtccaactgcactgaggttagggtgcatttaatgggaggagagatgggtgggagatatggtgcagccagaggaagctagtactttttttgttttgtttttctgagacagagcctcgctctgtggtccaggctggaatgcaggggtgcaatctcagcttactgcagcttcaacctctcaggctcaagcaatcctcccagcttgagggaggcccagaatttggtttggttctattttttattgagataaattagccatttaaaagtggcatttaggccaggcaggcacagtggctcacacctgtaatcccagcactttgggaggctgaggcaggtggatcacctgaggtcaggagttcaagaccagcttgatcaacatggggaaacccccgtctctactaaaaatacaaaacttagccaagcgtggtggcaggtgcctgtaatcccagctactcgggaggctgagacaggagaatcgcttgaacccaggaggtggaggttgcagtgagctgagatcgcaccactgtattccagcctgggcaacaaaaatgaaactccaactcaaataaataaattaaagtggcatttagtatatttgtgcaaccatcaccactatctaagtcaagaacgtttcctcttttttttttctaattttgtatttttagtacagatggggtttcaccatgttggccaggctgatcttgaactcctgacctcaggtgatccgcccacctcagcctcccaaaatgctgggattacaggtgtgagccactgtgcctggccccaaaaacattttctatttttttttttttttggagcagggtcttgctctgttgcccaggctggagtccagtggcacgatcatagctcactgctgcctcaacctcctgggctcaaggaatcttcctacctcagcccccctagttgctgggaccacaggtgcacaccatcatgtcctgcttgtttttatttttattttttgtagagacagggtctggctatgttgcccaggctggtctggaattcctgggctcaagcgatctgcccacctcagccttgcaaagtgccaggatgacaggtgtgggcacccagccaaccaagaacattttctgttttgtttatttatttatttatttattttggttttttgggtgggtttttttgctttttgtttatttgattttttggagacagggtctcactctaacacccaggctggagtgcaatggcacaatcacagctcactgcaccattgacctccagactccgatgatcctcctgcctcagcctcccaagtagctgggactataggcatgtatcaccatgctgggctaaattttttgtattttttatagagacgagtttttgccatgttgcccaggctggtctcaaagtattgggctcaagtgatctgcctgcctctgactcccaaagtgctgggattacaggtgtgaggcactgttcctggtcataagaacatttttatcaccccagaaagaagccctgtccccatcagcagtcacttcccacttccccctctccccagctcctggcaagcacgaatccactttctgtttctatgaatttgcctgttctgggcatttcatgtaaatggaatcataaaatatgtgatcttttgtgtcttagcataatacatatatattttttgagacggggtttcactttgtcgcccaggctggagtgcagtggcgtgatcccagctcactgcaacctctgcctcccaggttcaagcaattctcctgtctcggcctcctgagtagctggggtcacaggcatatgccaccacgcttgggtaatttttgtatttttagtaaagatggggtttcaccatattgatcaggctggtcttgaactcctgacctcaggagatccacacatcttggcctttcaaagtactgggattacagcagagtacagtggagccactgcactccagtctgggtaacagagtgagactccaccaaaaacaaacaaaaccaaaaacatttgtgaacaagttttggtatggacatatgttttaatttctctaggtatatacctatgagtggaattgctggatcatatggtaattctttaactttttttttttttttttagatggagtcttgctctgtcgcccaggctggagtgcagtggtgtgatctccactcactgcaacctccgcctcctgggttcaagcgattctcccgcttcagcctcccgagtagctgggactacaggcatatgccaccacgcctggctaatttttatatttttagtagagaaggggtttcaccatgttggtcagggtggtctcaaacccctgacctcagatgatccgcctgccttggcctcccagggtgttaggattacaggcctgagccaccacgcccggcctatgtttaactttttgaggaactaccagactgttttccacagcggccacatcattttacattccgaccagcaacatatgaggattctaacttctccacgtcctcgccaatactcattattctccatcctagtgggtgtgaagtgatacctcactgtggttttgatttgcatttccctgatgaataatgatgttgagcatctttcttttcattggccatttgtgcatcttctttggagaaatgtctattcaaaccctttgcccatccagcctgggtaacatagaaagaccctatctctataaaaataaaaatgaaaaaattagctgggcatggtggtgcacacttgtagtcccagctccttgggaggctgaggcaaagaggatcgcttgagcctggggggccaaggctgcagtgaagcatgatcccaccactgcactccatcctaggcaacagagcaagaccctgcctcaaattaaaaaacaaacaaacaaaaaaacaccctttgcccatttttaaattgggtgatttgtctttttattgttgagttataatttacatatttttatatctttatgtattctgggtacaagcccctgatcagatgtataatttgcatgtgatattttctcccattctgtaggttgtcttcattctctcgatagaatcctttgatgcacagaagtttttaattcttttttttggtgggcggatggagtctaactctgtcacccaggctggagtgcagtggtgcgatttcagctcactgcaacctccacctcccaggttcaagggattctcccacctcagcctcgtgagtagctgtgactacaggtgcacaccactatgccaggctaatttttatatttttagtagagatggggtttcaccatgttagccagcctggtttcaactcctgacctcagcctgcctcagcctcccaaagtgctaggattacaggcatgagccaacatgcctggccagaagtttttaattttttttttttttttttgagatggagtctcgctctgttgcccaggctggagtgcaatggtgtgatctcggctcactgcaagctccacctcccgggttcatgccattctcctgcctcagcctctcgagtagctgggactactggcacccgccatcaggcctggctaattttttattatttttttatttttagtagagacagggtttcaccatgttagccaggatggtctcgatctcctgacctcgtgatccacccgccttggcctcccaaagtgctaggattacaggtgtgagccaccacgcccagccagtttttaatttttgatgaagtccaattgatttatttttttctttggtggcttttgcttttggcgtcatatctaagaaacaattgcagtcacgaagattcccacctatgttttcttctgagagtttaatttggtttgattttgagggtgacagggagccacagagggtgacgggcagcagcaggtgatctgagttacattttagtaatgtgccctttggctgtgtgtggaggacgtctagggtggggatgggatacctggagggaaggaacattggctactgcacagatctgggcagacagtaatggaggtctgtgctaggccatggcagttgggggaaggaagcagggggtgaggttggaacagcttttgagtgcaggcaggggataaaagaggaggttcaagtctgtctctcccaacctgcagctcaggaatggacgccagccgacccgccttagctgacagcttctatgccatctcctatctctattacggtgccctgggcacgctgaccactgtgctgtgcggagccctcatcagctgcctgacaggtaggtaaacagagcatgtggcctcagaggtcatcccattcatctctctgcctcaaggctccacccagcagggaggggagaaaggacgctcccattggccaaactgccactgtgtgctgtacacatttgtaccttattattattattattattattattattatcatcatcatcatcatcatcatcatcatttttgagatagagtctcactctgtcacccaggctggagtgcagtggtgtgatctcagttcattgcaacctccacctcccagattcaagcgattctcatgtcacagcctcccgagtagctgggattacaagtgtgtgccgccatgcttggctaattttgcatttttagtagagacggagtttcgccatgtgtctcgaactcctgggctcaagtgatccgcccacctcggcctcgcaaagttctgggattataggtgtgagccactgcacctgggctgtacctatttttttaaaaggaaaaaaaaagtttgtgaggaaaaaagaagtgtgtgtgtatatatacacatacatacacacttttatgtgtatatatacataaaagaaattatgaatatatataaaaattatgactatatatatacataaaagaaagtgtatatatatatagtttcttttaaagggacggggtcgactgggcgtagtggctcatgcctgttatcccagcactttgggaggccgaggcgggtggatcacctgaggtcaggagttcaagaccagcccggccaacatggtgaaaccccgtctctactaaaaatacaaaaaaattagctgggcatggtggcaggcgcctgtaatgccagctacttgggaggctgaggtaagggaatcgcttgatcctgggagatggaggttgcagtgagccaagattgcgtcactgcactccagcctgggcaagagagtgagactccatctaaaagaaagaaagaaagaaggaaggaaggaaggaaggaaggaaggaaagagaaagagagagagagagaaggagagaaagagagagagaaagaaaagagacaggtctcactgttacccagactggagtgcagtggcacaatcatggctcactgcaaccttgaactcctgagctgaaagcaatcctcccacctcatcctcccgagtagctgagactacaggtgcgcgccaacgtgcccggctcacatttacaccctttaaagctatgttgctttcttgacaaccctgcacctctcagagcttgccctattttgcagaggcagaaacggaggcattgcctgcaactcctctccccaacaagattaagtcctcagtagaggatatgggttggggcgggcggcgctatccctggtgctgaaatatcttctaaagctgccggtgactccgcacttgttagggaattctaaattccacggaaaagtagaaggagacaaagaggggaaagtcagtagtgataacagtacctgctcacacttcttgagtctcagacttcacagtcatcaggcctttatcgagtcctcctctgtgctggacgctattttaggcactggggatgcagcagtgaatggaaccgtgtgctggaccctcccagccatccattaatgtctttgttttgttttgttttgtttttttgagatggagtttcactctggtcgcccaggctggagtgcaatggtgcgatgttggctcactgcaacctctgactcccgggttcaagcaattctcttacctcagcctcccgagtagctgggattacaagcgcccacccccacgcctggctaatttttgtatttttagtagaaatggggtttcgccatgttggccagactagtctcgaactcctgacgtcaagtgatcccctgccttggtcttccaaagtgctgggactacaggcgtgagccaccgtgcccaacctccaatgatgtttttgttttgttttgttttgttttgttttagaaacagggtctcactctgtcaccaagctggagtgcagtggcacaatgacggctcactgcagcctcgacctcttgggctcaagcaatcctcctgcctcagcctcccaagtagctgagactagaggcacacaccaccatgcctggctaattttttaatattttgtagagatgggttcttgctatgttgcctaggctggtctccaactactgggcaactctaagcaatcctattgccttagactcccaaagtgcaattatgagccaccatacctggcctcactgatgttttattacaacttcactgtgtagatgaggaaactgaggctcagaggcttgccagggtcccttagtgggactggagcctgttagacttcatagaccagggatctcctttctccttcccaggacctggtctccaacccccatgaccccttcactgaatgcctggatttctccatttctccccgcctctcaggccccaccaagcgcagcaccctggccccgggattgttgtggtgggacctcgcacggcagacagcatcagtggcccccaaggaagaagtggccatcctggatgacaacttggtcaaggtcagtcttaggctgggttcccagatctagaggcagccaagtgactttaggacgtgaccacagctcaggggagggacatggtatatcagcacctttctccatcgctcattatctccagtcaaaagactctattgggagctgattcatcctcaacagtttttatctcccttcacaaggactgaacagagtttaatactattcctttttgtttgtttgttttttgagacagagtctcgctctgttgcccaggctggagtgcagtggtgcaatctcggctcactgcaacctccacatcccgagttcaagcgattctcctgcctcagcctcctgagtagttgctactacaggcgcatgccaccgcacccagctaatttttatgtttttagtagagatggggtttcaccatgttgcccaggctggtctcgaactcctgacctcaaatgatccacccaccttagacccccaaagtgctgggatgacaggcatgagccaccgagcccagcctcatcttcaagtttttgttatctcccttcataaggactgaacaaagttgaatactattcctttttgtcgttatctgtttttacagtgacttccaatctttggcaggtgaaactggtgtgctgttagggtattgatgtaaagtctcttcttaaaataaaattacttaattcaaaagtgagtcaacttggggaaaaaatcttacataagaaacacaacagatggtaaaccgattttggctaaaaccgcgtggttgctttgtgaattcccagagtttggaaaatgctgtccctgggggacctgatcccatgcctacccctgttttggaatccctgttccattctctcatttattgagcacctgctgtgtacccagtcctgctctgggctatggtctaagacccccaccccaccctcatctagcaggggcaggtgaaaactaaaaagagaaacatgtagggtctgtctcagtatgtgataagcattcaaaagataatacaaccagatgctgtcaggccgggcacggtagctcacgcctgtaatcccagcactttgggaggttgaggtggatcgcttgaggccaggagttcaagaccagcctgtcgaacatggcaaaaccctgtctctactaaaaatacaaaaattagccgggcatggtggcgtgtgcctgtaatcccagctactcagtggaatgaggcagaagaattgaacaattgaacccgggaggtagaggttgtagtgagctgagatcgcgccactgcattccagcctgggtgacagagcaagacttcgtcaaaaagataggaaagcaggaagggagggagggagggaaaagaaggaaggaaaggaaagagccaggcgtgatggctcacccctgtaatcccagcactttgggagacttaggcaggtgcatcacctgaggtcaggagttcgagaccaccctggccaacatggtgaaaccccatctctactaaaaatacaaaaaattagccgggtgtggtggtgcatgcctataattccagctattcggaaggctgaggcaggagaatcgattgaactcaggaggtggaggttgcagagagcagagattgtgccattgcactccagcctgggcaacaacagccagacactgtcagaaagaaagaaaagacagagagagagagagagagagagagagagagagagagagagagagagcaagctaaaaagaaaaacgtgtagggtctcagcatgataaatattcaaaggataataaaaccggatgctgtgatggggagcaactttagccagggaagtcaggggtggcctcttgggagaggtgacattgattgaccctgagttaggagaagaggaaccagccacagacaggaacagctttgactgagaaggggattgggaggggaggggtttgcctgaaggtgtttaaagctccctccagctgccctagagaagtgtttatcttttctttctttcctcttttcttttcctttctcttcttttcttttttttctttctctctctttttttgttctttattattttatttttcttttttgttgtctttgttttatttgtgtgttttttttcttttttgtcttttttttttttcctttttttgagatagggactcactctattgcccaggctggagtgtagtggcatgaccatggctcactgcagccccaacctccatggtccgagaaattctcccatctttcaacctcctgagtagctgggattataggcatgcaccaccgagtctggttaatttttttatttttggtagagatggggttttgccatattggccaggctggtcttaaactcctgggctcaagtgatctgcccaccttggcctcccaaagtgctaggattacaggggtgagccaccgtgcccggccagaaatatttattttcttgaaggtgaacaggcagagaagcagagaaaggagggaggaactatagcaggcatctgagaaagcgttgatggcctgggctgtaggtgacatgtgagtggggaagagaagcgcatggaaattttggaggcagagcgggcaggactggcccgtgcactgagcaaggggatagtatgcaattctgtgcacgccccgtcccgccaggtcatcagtagcccatctgggagatgagctgacacggaacagggtggggacagggtctctgatggggtctctttttcccacttttccccagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgaggacagggccagccgcgggactgacaccctgggatggaacctcaggatgggccaaacccagacaacgggcccatggccttgggctctgattggctggattgccttgtatgcaaatgagttcaggactacaataccctaccctatggggaggccctgcctccgggaggtcattttttaaatccagccccttgcttcaaccgtccccagtatt

SEQ ID NO: 37493 - DNA, 20304 bp, Homo sapiens
gggatctcggactccctggaccctccctccagcccagcctcgctagctccgcctgcggtacgtgctcccgcctccgactcaagtgagtaggggcggtggggcggttccgcggcgccgccaaccccggggcgggagttgcagggggtttccaccgcctcccggggtcgtgctgtcgcccggccggcgcgccccggtctcctccgacatccccatcccggtccgcatttgtgcccctgccagccttctcatccctgcgccccagattttctctctcttatcccccaaacacacctgcccttgtccccgaggccgtccaggccatgccctgggatcccaggcccgcggggcaggtaaataatcttatatgacctttaatttctccatactggtttctctgggagagaggcgggttgtgagtttcgcgtttctgctaatccgcctcttagcagccgtcggtcccctcgtccagcggcaggctctctctggggtgggggtcggagtctcagggccccctctgcccggagtgtggtgagcaccgagggcgaccttactgggttctgtcccctaggggtggaatggggcttctacatccccccgagcccagggtactgctcctgccgccgtaccgggctcctggcatccccattgtttggtggtgtctgcccacccagcaccgaacccctctatgttgaaggaacagcagggaatgtcaatcacttactcctagctttttccagaactttctacgattcaggtacaaagaagaatgcaagaatgcttggttgtgaaattatgcgacaggtcctgcgaatcacattctgggttctccagagccagattcaggagctccacgtaggcaccccctgggggcgggggcgggctttctaaaccggcggatccctttcccccttctaagccaggacatttgttaaacgatttttacttaaatggctacccaaaatgtttaacctgttttatttgcagtctgcaaaccaagcacattttccctttataaatgcttttcggtacagaattttttttggggggtgggggggtggggcgggggcagttagtaattttttaacccgggcagcgaaaatcgtcgtatttagttcttgacttttccaattaacctgttttaaaactctcctcataaaatgccaagaattcaaataggacagccacaaagttggctgtactttgactcacgtttttcaagaaagaattgggtgatagattttgaaagggagaatctaacatagtttcagaactgcatgccaagctacaaagaatgttgtgaagtactaagtggtctcccccagtactcctggggtcatcgctctcgtccattgtcactgatactttgtcagtatttctctgggtcctttctcctctgcattgtagttttctttgctcttttggttctgtgttacctttgagaccagacctgcatcacatgagtctttgaaactcacagtgcttgcttgggtaccttggacaattgactgaaagaaggagcgaataaggttgtgattatagggaacaaaaatataatttgactcacacaataggtatttgtttgcagatttgatctaaagttcgtatcataaatttttaatgcatttctccgaatgtatttaacaaatattgattgatactggtataggctaagtactgtgctgaaagcagtacttgctggaggcctgtcctgatgaaattgcaaaatcacttggatttgggggagattgaattttatcctaaaacagcaagaatgttggtgtagagtagaggacagcaataaatgaggagttttagaagcctgagtccagaggcaactctgacactaaattgctatagtgatctgggtctctaggttttcttctttgtcaaaagtgaggtgaatcaaatgaaccccaaaagggagccccctatgggagaggaggcatggctgaaagggggaggaacgaagccaggcaggaccaaattcacacctcaactccagtacccattggtttgatgcccttgggcaaattaactttactctttggcctcaatacttcatcatgtaaaatgggtgtagtggcacatgccttgcagggttgtcataaggcctgttgatacttgtacaaagcccagcccagcctgggagtagttccttgtaattagacaaagttgtgcacttggttgaatatatgtgggaaaaggctatcagtgaaagtctgtttcaggagagagctggctcacacctgaagagcgtttcctagaccttgcctggaggccagctttcttctctgtgcagatgttcacaggtttcctcaaggcaccttaccctgactgccagcatgccatcccttgggttctgttgggtggggatccccagacacctctggatctttgattacctaggtggggtttctgactttttatatcatggcactcctgtgaggcctccagaccccttctcaaaatgacgtaacataaagtatgtggtaccaagttccccaacccccagaattaaaaggaattgtggcctttgggttaagaatcctgaattaagggaatatttctcagtctggatagtggagaagctgggcacaatttcttttttttatattttttccttttcaaattcctttttaccacaggcacaatttctgattgttaaaaattttattgttgtaagtcacagaggaagaactaatagaagtacatggtgaatgatctggaaaggatatcaggttccttgtttttttgtttacaatcttattgtgccaacaatactattgtcttcgactaataagaacagacaccatgtaatacattagggccaaattacttcccagttcactataggaaagagggcttcatggtggtttcacagtacttccaaaagaaaataagcagagagaattgaatcctcatccagcacacggcagtgcaggaactactcagcttaagaagaacctatgccatagccatggaggtcggtactacatctgtattgctaccaggggtttagtttagcaaaacatcagtgaaataattttgaattggaattttattggtattcatttttaagttgaattgataattttattttggtttcacagttatgagtcatttaatagctctatgcctcagtttccccactcataaaatgagaatagtggtagtgcttactttagttgttatgaggattaaatgaggtaatataaacataagtaaagcatatattaagctttatagaagtatttgtaattattacctgtcatgtggcagacactattctaggtgttttgcatatattgtttaatctaaaaactgccttattgtataaataagcattgtccccatttttaaaatgagaaaactagcagatcaaatgaacaacctgtgatcatttggcaaataaacaagagtctcagcatatatatctaggtctgattccatgaaaaaatcgtgcaaatattaaattgtttgaataattaaataacttgtagttttgcacagattgtggattgctatggcagatgttggggatcagggttactgagcttatagcatagttgcattttaattacaatatgggatttggcagatagtgattcaaatctgtgtcgaattttgctgcactctaagttgaagacacgagtggtagcagaatacagaagtagtaagaatggtgaggctgaggtacacacaggagtgttcactagattagaagagagttttccttcagtggggttagatttaggttagcagagaggggtaataaaaagctttttggttgaaagtagcagtttgggtgtgagagtggtgcacagagaccacttactgaccgctagttggatggagaggaaggtgtgtaatttgtgtgtgtaatttggtaactcaaggattgagaattctcaggtcatttgaatagtctcaacccttaatgttctgtgcctgtcagatatgggagttttgaggaaagcttgtggttctggaatcaaaacatgagcctgatttgtttctttggagatctgtgacctcagcaagtcacccaactcatcagtccccatcctttttggcaccagggaccagttttgtggaagacagttttttcatggatggtgggtggatggttttggcatgaaattttgggatgaaactgttccatctcagatcaccaggcattagattctcgtaacgagtgggcacctagatccctcacctacacaattcacaatagcgttcccgctcctatgagaatctaatgcctctgccgatctgacaggaagcagagctcaggtggtaatgctcgcttaccctccactcacctcctgctgtgcagcctggttcctagcaggccacagaccagtagcaagtagcctgaacacaaaacacagccatcggtctgtggcctgggggttggaacccttgacctaacggactgaacttggtatattcaggccccgagtgctcctaaaggaaaaggaagcccgcccatttgtggagtacaggctctttgccaggtactttacaaactttatctcattaaatctttacaaccgcctataagatagttctcatccatttccaagttacctctgaggaagttaaggctcagaggttaaggaaatttggccaggatcacatagctgataactagctttgacaaccagcttgtgtctatctgattctaagctccgcactgtttcttttatatctggcatgtctaaaaggtggcatgtgtactgcggtatttccatggcaaaaataattaatcacagttctcttgattgtagaacctggactgaatttcagaatctttctcaacgtagttccaggaatccactctcagtggatctgcaagatgaaactgttttgtcatgcctgtgaaagtaaatggtgcagaccttcaaaagccctttttgcatgcctctgtgtcatttattatattgctattgtttgtccacatgtttttaccacctcagtagaactctgtgcaaaacgggcctttccttatgacccatttatcctcagccccctaacccagtacctggcttatgaaatactgttgaattaatacatttatatgagagcttcataaacagtaaagcattatgcagtgcttataagctgcctctaccctagaaaaattacttgagatacagaaatgaagttagctggatggaacggaggtaaggcagttgccttgatggggagggtttgggggataaggaaggaatagatatgtgagatggtagggcaagatgagtattgataacaaaggttagaacattgctaaatattgatactatcatttgagtccccactatgcaagcgttacctcatctataactctataaagatggtactgttcttaactctctaaaaaaggtactgttgccctaagtttacggatgagagaaatgacacttcgtggactccaaacgcgtgttcttactttgcccttatgctgaactgacttaaaggccaggttgaggatttggcttcagtaggaggagccaaatggagtacggagctgatcactaagacatgaagagttcatccttggttcagtggtattcacttccgtaagagaagtagactaagtgggtagttggggtaacagaagaaaaaatttgtagaacaggcatcaactgaaagcttaatttccaattaactacagctgtcaaatcctggtcttgctaaaaagtcatcgtaacgggacagtgctactaacttacattctttaacaagtgactccccctggatgtggctcaagatgagactgtattttataataaattctcctttaggggaaattggattatagtcaggttctagtgtaataacaaggccctacatgtagtaataaaatgtcaaagcttctggaggcatttagaatctgggcaaatatagaatatagactaattcaatccaaacttttagtttcagggcagataacttaaactttaaatggtaacatatagatttgaatttcatagattcaagtcattctgattctaaagtaagacagtaaatgcggcactaatggtatgagaatggcccaggtagtcagctcttgattatcatacggctctgatgagtgcaggaacacaagggttcttgatcctgccgccggtttagataaaacaacacggacacacgtggagtggttttaaggagcggagagtttaatgagcaagaaggaagggagaagacagaaggaagaagctccccggtacagagacacagggaggggggctccaaagcccaaagaggaggtccccacctgcaatggataccagcctggtatatatgcaaagactggaggaggcgatgtctgatttacatagggcttaggggattggtttgaccaggcatgtcattcacgtagcccaagaaaaagctggccctcacaccctagctttttagtatgcaaatgcagggcgccatgatgttccacacacgtggggatatgtggaggctgccctgtcaccaggcacaggtggggcatttgcatggcccacatggcctgcatttgcatatcaaaggttgctggcctggctctaagagccagggctttacaagaaacttttccagagatgctttaaaaaatgaaaacttcccaaggaccccttttcctctctatctgcctaaaataatttcgtaataactcctaccacagttatctagagagtgagctaactgtaccataagacgactcagacttagactatatcagtttttccgcatgggtgagtcttatgaattttggtggcatcttaggctaagaagaggtagcaaggagaaattgcacataggtgttcagatataaatcacgttgtaacatgtaatacagtggataaatcctagtgctggaactctttcagacactgaaaaacaaggaacaagactgagaaacagaatttgccctattttatcacatgtaaagtgggattttatttttgcttttaccattctgtaaattaatgcctaggatttgggaaaggcatgcagcccagattgcttagtgcaaatccagtttgctgtgattaatggcagctgtagtggagtagtacggccaaaggcttgtaagaaaaatgaagacttgcttttttttttttttatgcacagcaatgccaagagtgacagaaatggaagatcatcatacttcttccagccaaattcaggaaatgtccattagaggttcagcctaaaagtgcaaatttgaacttcgtttcttttcttttttttttttttttgagtcggagtcttgcagtttcacccaggcgggactgcagtggcactatctcggctcactgcaagctccacctcctgggttcacgccattctcctgcctcagcctcccgagtagctgggactacaggcacctgccaccgcgcccggctaagtatttttagtagagacggggtttcaccgtgttagccaggatggtcttgatctcctgacctcgtgatctgcccgccttggcctcccaaagtgctgggattacaggcgtgagccaccgcatccggcttgaactttgtttcttagacagtcaccaccatatgtggaactgttgctttactttggagtgcattttaatgtccccaaaaaagaaggtttatagtgaccaatcagctcagttttgtccttaccttgtttgttgctctgcagctatgttctaggtgctggttggtgggttttcctactagagtactgatagcaggctggatagagtgagatgtcccctctgtcttcaagctgacagctactggattcctgccaaggcatttgcttaccttatcttgccttcacaatatttctgtgggtagagagagctacctatccccatttttagcttgagaaaatgaagcccaaggttgcgcagctattataacggtggagttaatccaggtgtgtttaaaccagtcaatcaacttcctctccctccttccattatgaaatagttcagacatacaaagtagagaacaatataaggaatattcaactatcaccatccactttttttttttttttttttttttttgagacagggtcatcttgctctgttgcccaggctggagtgcagtggtgcaatcatagctcactgtagccttgacattcccagcacaagcaatcctcccacttcagcctcccaagtagctgggaccagaggtgtgtgccaccatgcctggctaatttctttttaaatttgttttaaatataggtaatatagcgtctccctaaattccaaattccaaagtgttgggattacaggcatgagctaccacacctggctccctaaccatcttaaaaaaaaaaaaatgtaaatccaactgaagctttctgacaatgttcttttgttacatcatttccctctatcacagaaaaggttattcagaaatccttaggaaagcccttaagctggatagaactgcaatattttgatatatgcaaatactctgatagatggtgtggagaatacagagatgtggtccccaccatcaagggaccagaaacttattgcacagtaagttgaatgttgtggaactttgataggtatttcctgaaaagctgacacatttacgtttggctggtgcagttaacttagaataagtaagtttaaagaaaccctgaattacataaagaaagggaagatattccttctttcttaaaaatccaggctgttcttcaatggtatggaagagaataacaaggttattagttgggttttccttttaatgtatttttaagtgttattcaaagacagcctagtctagcctcagtcgtgatagcaatctggctccttactggtgattgctccaaagtaaatatgtgtgaaaatgaaaaataccaagttggtattaacagttcactttctaatatgagaaatgtttcaatgatagaaatgcctcgacaacaacaaagtattttaagaaccagttgataacttgggatccaatataagtaattgtagtgtcattacctggaggcctggatttggcctttggttctgcaggaatcatgagggaacttccagcagatgtctgttgcatccatgagcattcagaatacaggtagctttggaggcaaggggcaaggtcagtttctctaactgtactacaaacacgggtcagtgcaggctgttggagccaaggctttatgtcttaggttttaccgccaggcttatgtttcactctggatttcaacaatggagtgcctgtctccagggaggagaataaaagatttatgcagctacaaaaggaaagcttgtaaacatgtcctattgtcgcaagatactgatcctatatggatgccttcacggtaagcctggtaacatttgtggacccttggaatgactttgttcctgtctggttaagagaagttggctttttgcaaattcagacttacattttagtgataacaagccataccagtcaggggtgtgtgtgtgtgtgtgtgtgtgtgtgtgtgtgtgtgtgtgtgtgtgtgttgtttgttttaaggaacaggagctccaattccaaatgacttaagaagggaatttattggctcataactgaggcatgcaggataagataaggcacagttgattggccgtgactgagtcacatgcccagccttggagttgggggttgctatggtttgagtgtttttgtcccctctgagaatcatgttaaaacttaattcccaatgcaacaacgttgggagttgggcctaatgggagatgtttaggtcatgagggatccactctcttgaatggattagtaccaccataaaaaggcctggtgggagcgggttcaccctcctctgctcttctgccatgtaaggtacagtgttcctggcctccagaggatgctgcattggaggcaccattttgcagcagagatggggcccttagcagacactaaacctgccataccttgatcttggacttcccagccttcaaatatttatattctcagtctgttctttataaattacctagtctctggtatactgttatagcaacacgaaacagactaagataggggtagagtcagtaccatctaaaaccagtgcttttcttttttttttttttttttcttttgaggcggagtctcgctctgtcgcccaggctggcgtgcagtggcacaatctcggctcactgcaagctccgcctcccgggttcacgctattctcctgcctcagcctcctgagtagctgggactacaggcccccaccaccgtgcccggctaattttttgtatttttagtagagacggggtttcaccgtggtctcaatctcctgacctcatgatccgcctgcctcggcctcccaaagtgctgggatcacaggcttgagccaccgcacctggccaaaccagtgcttttcaaatcatctatggtaaatgtattagtctgttgtcacgctgctaataaagacatacctgagactgggtaatttataaaggaaagaggtttaattgactcacagttccacatgattggggagacctcacaattatggcagaaggtgaatgagaagcaaagtcacatctcacatggcagcaggcaagagagcttgtgcaggggaactcccctttataaaaccatcagatcttgtgagacttattcactatcatgagaccagcacgcgaaagactcgccccaggattcagttacctcccaccctgtccgtcccacaacacatgggaattatgggagctacaattcaagatgagatttcggtggggacacagccaaaccatatcagtaaaggactgttatttttaatttccaagtacagactgatgactctgttcaacaggatgagttcactgatcttctcttagtttttgtggcataaaagtttctaaatgcttacctgaagtttgtctcaaattggtaacaagaatagtggcccatccatcaccaggagaccacattttaataagcacttctctaaaccacatggtctaagaaagagatggctgctttcccggaagacagtctagggaaggtaccaccagaagagaggcaagagaatactgagtgctggaaagttccccaccgcaatgatcaactccattaatctttcttttggagaggcctcatctttgtgttcaggaaattgtcaggttctggatcaccttaatggggtaagatgagaatttcccacatcccttttgattttaaggattggagactctttaatcttttctacttagtagcactctgtttcccttctctttctagccaggtttgggttagtaagaggcctcggccttattagccacctatttcctagagaggcaagcagtctatctaaggagacctaacaggcaagggctgcaaatgccactctacagaaggaagctcaaaaaagatgatggggaaaggggaatcaatcgcttgtgtttttagataccactcagggcagggcagacataacatgtcttcttagcagaacaactttctgtactggttaaggcatctgaggaagctggccattcagaaccaggcttttttcttttcgtcagagtctcgctctgtcgcccaggctggagtgcagtggtacaatcttcgctcagtgcaacctccgcttcctggttcaagcaattctcctgcctcagcctcccaagtagctgggattgcaggcatctgccaccacacccggctaatcttttttttttttttttttttttttttaaatttagcagagacggggtttcgctatgttggtcaggctggtctcaaactcctgacctcaggtgatccacccacctcggcctccgaaagtgctgggattacaggcgtgagccaccatgcccagccagaaccaggcattttaaagtggtcgaggcagactaatttgttgagaagggagacgagaaaatgttggccctacatgacagtgagacaccctaggatctgtacttccagcttgccctttacagcaggccatactattcagaggctattcctgcatgctcagcaaacagttcaactggtaggaagggaacttgtagcagattctgtatggcctgactgacttgccaaagaggaaaacccaactgctggctgcactagtgggccttggggttagtgaagcatagaaacttaagccggagccatctggatgggcgtttgttgtggttacggcaaaagttccgtgcatgcagttgtacgagtcacagacacagctatttatgctacaatcgtgtaatttcagcaaacaaatataaaacttgttcttgcagggcaacacactttgttccctagaaagcgtgttatagcttatatatgttaaacgttaagaatttagtgttgttacaattaattaaacatgtaatgaaaacctccacccaagggtaagatcttcagctgagttcaaaaaaatatgtttattaaaaatgggcatattagggagggggacaaggcttgcctttcccctccccacgcttctttcttaactcctgtggattctaatggcatagcttgttttgtgcctggtgacctgtactattgtactgaatgcaggtcctttgtctggcaggaaaaaaaaaaaatcttgtgcacgacaagccagtttcctaatgaaagagttgttatttgggagaggagatgaggttattttggaggaacgcaggcctttgaaagatgtggttagagaggttcataaagaaacgaaaatctgcagctgtccctgggcttaaatagccctctagggagccgtacgaccagcacagggacattctaatgaatcctttattccttcagaatgcctgtctggggaggtggaaacaagtgtggggcctgtgggaggaccgtgtaccacgcagaagaggtgcagtgtgatggcaggagcttccaccgctgctgctttctctgcagtaagtagctctccatgctccacctttgacggaatttgtatgtacagagcttcaatatgtctatttaaggaaaaattgtggttttgccaacaaagatcattttgaaagcacgaatggtttttacctgtcttcttagatgttgtaaatgccaagcctagcagcgaagacaggaggggtggcccaagacacccagcctccctttgtgtccccatagcttttggcctccattttggcctttattttgttaacacatctgcctcccccacctcactgagtgctgggtgtcacttatgtggtctggcacctagcacagtttctggcacattacaagggcttagctcccatttttgagtaaatgattgctcctcatccaccccagctttctctttctcaggttccctttaatgacaacaaagtcttcggttttaaaactgtagagtagcaacttaaagcacttcattaatcatcttctgatttaatgacagaattttctttaatgaatgattatgtcaggtaaacccacccatacgggcagatgtttgccttatcaatagtattgtacagggaaaattcctacagaaaaccataggttaaaaataggttacattgagaaataatcttcaggaaaagacttctttctcaaatttgaattgtccttttccctcattggagccagcattcaaggtatctggacctctttaatagcataactaaactgctttgcagacaaccagaagcagacaacagaaagttgcagttacaaaaaaataaaaatactacataggaatgttcactatgtatgccttcctcagaagacttggtttaaccattgcttttagaagttacttttttaaaaaaggaatctatttttcagcaggcttgtaaccaagaaagtatggaaacagaatgcaaatactttagaaattgctctcagtttcatctgtctaggttaagccacaatgtctacaccatagtaacatatgcgtgtatgctgttgacatttgttttactaaatgtcaagttctctactggtcatttctacgaatcctttctaatatctgtctctgctgactaatgccttttaaggaaataattcagagtagtttgcagacctatgagaattttactgcagagaacagcatgaggactggggaagaaaggggtggttatatagtaacactttcatatacctacacttgttttggttcatacaggtttttcaaaacagtatttacatttattctctctgttaagggtagttgtccttcagcagtgcatggtgttaggttaactatggtttaagatatagttatctttaggcacatgtatttcagcacttgagcctcaacagttagattccagagtagatgccatttcattctaccatagaagactttagtttaagataatagactaaattttaaaccagccagctagtcctgcttccctcccctcctctttgctgtccttccttttgtcctccttcctttttattcaacccccccccttttatttttcttacttttaatttttatgggtacatagtaggtatatatatttatggggtacatgagatgttttgctacaggcatacaatgtatgttaatcacatcatcttaaatggggtatccattacctcaagcatttattatttttttgttaccaacattccagttaatactgtcttatttttaaatgtacaatgattgttgacagtaatcatcctgttgtgctatcaaatactagatcttattcattctaactatatttttacacccattaactctcctcacttccttcccgacaccctacccttccgagcttctggtaaccatcattctactctgaatcatcatacaattgtcttttaaataaggggaagaaattctgatctttgatttccagctgccagattgtgctaccagtgagtttcctcacaatttacttttttctcaagcttaattgaagttttagaaaatgaaataatgtctggatgaaactcgatgacatttggcagttttatgaagtgggacacgtggaaatgtcctgtggcaagagatccatcaagaaagaatgcattctcctttgggacagaagggaaaacaaatgcagactttaaagcacttgacgattttcaggcagactcatcactgctggagaagctgctggggagaggaaagtgtgatacttcccagtctagactagtgatgaaaactagaattcaggatttaaaactattattatcccaggaggtgcttttgggggaggaaaggctacagaggcaagtccccgaaggcactgagcttcccttctgttctgtattaggttgtgatttaacagtacttggttaagagaaggctgaaaagattaagagtgttgagggttgggagcaaggtggtgttttattccttttgtttaagcatttttatagccacctttgaaacttttctcccttaatatgatctcccagaaagggaaatcatagtaagagtttgatcagcaccacaggaaagggaataaaaaataaacgaaacaaactaaaaataaagcttgaggcttctggatgttatattctgatacatttctgaagcaactgtcatatccatggaggaatgtaaataatcctcgaatgtagctggccagtccagatgctgtctcatggcttttgggaagccacaggataaaccaggaatgtgagggagcctcagccttcaccatttgtaggccatgtgtctgtgccaccattgttctaaggaaaaaggcatctttggaacatgtgtaaagtctaactttttcccctgcagtggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagaggtgagttgggagaccgttggttaccttcagaaatgagttgcgacagttagtgccgcttgctgaacaggaacctggcagtctccagatttttagttgaaactaagcaaataaaatgggactctgattttctaatgtcaactagttcaaaatattgagttttggacctaacaaagttcttattaataattccagtgatttctacttctggctttatagcattccaagctgtatcaaggagtcgtgttctcaaaagcaagtgatttgtatttacttcaatttcacagcaccttggagaccggatgtcatgaaattaaatggtagagaaatgtgctgtgtgaatcatgagaggtgtttctcatgtgcaatgtaagcagccaatgaaaattcctaagtcactccttctatgtaaacatttttcatcaagaaatcacttttctctaacttaaaattttttacttaaaaatggaaattacttcttatttttgattctttgagagagtagtgttaaactttaaaggctttgttgccaacgtatcaaggtgctaaatttgtgaaagttcacttagtatttcatattcaggttaaataacttatttgtttagaattccccccacacacttttttttttcttttttgtcacagaatctcactctgtcacccaagctggagtgcactggcacaatctcggctcactgcaacctctgcctcccaggttcaagtgattctcttgtctcagcctcctgagtagctgggattacaggcgtgcaccaccacaccgggctaatttttgtatttttggtagaggcggggtctcaccatattggccaggctggtcctgaactcctggcctcaagtgatctacttatctcggcctcccaaagtgcatggaataacaggcatgagccaccgtgcccaacctggaatttcctcctaactcctacttttaacccagtgattccactatttgaacttcacattttcacatccattttatattgagaagtccaaaattggtgtaatagtccaacaaaatggcctttggacaagaccataaaccatgccagccaccgtgcagcattagcatatgttaactcgtgtaatcctcacaacagtcctacaacatagggcttcctctctttcttcagaacagatgaagacaagaaaaattaagtaaaaactttgcccaaagtcacactgttagttaattgtagagcctggaacttaacctagtctaactccaaaccttatgacctgaatgaaacgtggtgcttggcttggctaaaataataattaccatgtattgagtccctgttgtctgttgaacatttatcttcattctgtataatccttagagtaactctgaggtatactttgtccatttatagatgacgacactaagagtcgggtcacacaaataagtgagggagccaggatttgaatcaatgtccatttggttccaaaatctgttctcttcctactgcagtatgtactacattgaggctcacctctgtgttctttgagcttcttccaccctcagagtttctgggccatgatgcccagcttacctttttatctttgttaaaatttattttacttgttctgctctccttttccatcttgttacatctatttttgtgttttaaaggttttgttgaaaacctttcaaaatccatatcccctcactcaacctgcatctccctcaatccaaaccagatttatccatgaccccaaaagtaagtcagtgactatggccatagttttaaagcacaaagaccagtgaaccctcctttttttaaaaaaaaaaaaaaatatatatatatatatatagacagggtcttgctatgttgcctaggctggcctcgaactcctgagttcaagttatccttccacattggcctcccaaagtgctaggaagacattgtttttccagtaggaaaaattaacagttgtggagtgctatcattttatctgctcagctaatttataaggttctaagagggcttaaaaaaaaaaaagtcttctcaaagcccgagaatgttctgcacatactaggtacaccttactgaatggaaacagttcctactgatagcaagaaatatggtttactcagtgatctgtaaatagtgacaaaaataccacccttaccagagaaaaatgaaagataaacagattgcatagtaataatcaaaatttataaaatatttttccatgaagaaagttggctattcacactttcctttattcaagatatactgggagactaagtaatctataaaacatgcttaaatttcttagttacagaccaaagttaacttacctatttgtggaatttttaaactacttaatagtggtttttccgactcctgtgaagtaaaaagctaggtatgattccagtgatattattctggagtaaaaatatatgctctggtaagtttttataaaccgtaacataattgcttagtggagaggccaacactgaggagtaaatgaattctgtttagactcagagggacagatctttacgtttgggtccctatctggttttttgaaataataatgagcccatagataggttcaagtagtaactctggctggcacctgagtcacttcttctttattccctcccctgtgctggcctgcaaaggcttccagctttgaggcagtgtagcggttaagtcccagagttctattgttcctgccttgtgtacttaaaagggccctgtggaaactcttgcctactttttttttcctcttttcacaagtgttcagcctcacaggcctacaacaaatccaaacacttctaaatttgctcagaaatatggaggtgctgagaagtgttccagatgtggggattctgtatatgctgccgagaagataattggagctggaaaggtaaagtgctatttggaattaataacagcaaatgacttctctctgctccctttctcccctaacccttccacattccttgcttgggtgatgtcttacaaatcactgtcttatatgaaacttttctttaaatgcatttccatcagaatcattaacttttttgaagtgattcccttatttgacaagtcatttttctgtttaaaagaacttgttttcatagggggcactcctgaaggttaaactttaaaaggccagactgtaagggaatctccaggttattcagtatagtgaaaaaagcaggaatccgagtcaggacacctgatgcgaattcagtgtgtggatttggaaaagttaccagctaacctctttgagctgcgctgttcttggccagaaaaaagatggtctctttaaaggagcagactgggcttgtggttaggactgaggctgctcttagggaaacagcctttctgtgggtgatcaagagtgcagatactgaggactggtttcagccttctcattggagctgaaccacagaagtcaggagcttgctttgagatgatcatcctgagccacttcttgccatacatctaaattgaactgtaggaaacaggcctctcaaacatgctgacacattcatctcttccagccctggcacaaaaactgtttccgatgtgcaaagtgtgggaagagtcttgaatcaacaactctgactgaaaaagaaggtgaaatctattgtaaaggtaaaattcatttcagttactgctgtccatatgaatattccacactggttcttgtttaatgaaatgtcactggcattaaaaaaaaaaaaagaaaagtatgccactattttctgaaaataaaatatcccaagatgcttatagatgacagagaaccacagttaagttcctgatcatttaaaactccccaccagataaaaacaccacaaatagccatcttttgccttcatgtcttgagcaaagcgtaagtatatggaagaaaacagacaaatacataccttacctggcctgactcatgcttgcaactcagcaggaccacgctgaacactatagggccagaatgtgtggacttgtctttgcagctttaagatatttagtacatgacacatttaacatcttaaataagttgagctcttttacacagcagtttaatttatgggggtttgttgagtgggtcttaagcagtgctagcaaagcttaatggacttgcactaactatccttcctccctttcctttgtaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttg

SEQ ID NO: 37494 - DNA, 114923 bp, Homo sapiens; identical to SEQ ID NO: 37326

SEQ ID NO: 37495 - DNA, 38413 bp, Homo sapiens
gtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggtgagccctagaccccccttctcgggaccccgttgtccttcagagctgactggatgcctgcaagatcctccttgagaggcctcactgatcctccacccattcccagtatctgctttggccctttgtccaatagttggctttgctgtagctccttagtgtccctctcatgatctatttcattgaaaggagagcttcaagactggggctgtatgcagaatatctgccgaggttcatgctttgtcagacccacaggactgtggaggagaaagcctgtcactggaaattactaacttctcatggacaggaactcccttggcatccctagttcccaatgtgcaatggaactgtatacactttgcatgaaattgaattgaatgaaatcttaagccagactgagagttaggtagtccttaaaaattttaatgtttcttcttttccttttccaggttccattgccttctctttcccccacaatgcaggcaggcaccatagcccgttgggaaaaaaaagagggggacaaaatcaatgaaggtgacctaattgcagaggtaagtttttttttttttttttaattaatttatttattttttttattgatcattcttgggtgtttctcgcagagggggatttggcagggtcataggacaatagtggagggaaggtcagcagataaacaagtgaacaaaggtctctggttttcctaggcagaggatcctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcacagatcaacaggataagaatttttcttagtaccgagcaaaatgaaaagtctcccatgtctacctctttctacacagacacggcaaccatccgatttctcaatcttttccccacctttcccccctttctattccacaaaaccgccattgtcatcatggcccgttctcaatgagctgttgggtacacctcccagacagggtggtggccgggcagaggggctcctcacttcccagtaggggcggctgggcagaggcgcccctcacctcccgggcggggcagctggccaggcgggggctgacccccccacttccctcccggacggggcggctggctgggcggggggctggccccaccacctccctcccagacggggcggctggcctggcgggggctgacccccacctccctcccggacggggtggctgccgggcggagacgctcctcacttcccagacggggtggctgccgggcggaggggctcctcacttctcagacggggtggctgccgggcggaggggctcctcacttctcagacggggcggttgccaggcggagggtctcttcacttctcagacggggcggccgggaagagacgctcctcacctcccggacggggtcgcggccgggtagaggcgctcctcacatcccagacggggcggcggggcagaggcgctccccacatctcagacgatgggcggccgggcagaggcgctcctcacttcctagatgggatggcagccgggcagagacgctcctcactttccagactgggcagccaggcagtggggctcctcacgtcccagacgatgggcggccaggcagagacgctcctcacttcccagacggggtggcagccgggcagaggctgcaatctcggcactttgggaggccaaggcaggcggctgggaggtggaggttgtagcgagccgagatcacgccactgcactccagcctgggcaccattgagcactgagtgaaccagactccgtctgcaatcccggcacctcgggaggccaaggctggcggatcactcgcggttaggagctggagaccagcccggccaacacagcgaaaccccgtctccaccaaaaaaatacgaaaaccagtcaggcgtggcggcgcgtgcctgcaatcgcaggcactcagcaggctgaggcaggagaatcaggcagggaggttgcagtgagccgagaaggcagcagtacagtccagcttcggctcagcatcagagggagaccgtggaaagagagggagagggagaccgtggggagagggagagggagacggagagggagagggagagggtaagttgttttaaagtaacggagatgagttcgaagagactggctttgcctaattgactgaacattgactttctggatgtgtagctacccctttgtttaagaaactgaagtgtttttcacaacttgatgttagacaagattggttggataagttgtcagcagctggccaaactgattttaaccaaggcgtttctaaagtaatttcttctttgaaatctgtcgtagtggccttatcttcacatgaactgtataattctagacacaaaggccaggctggccaacatggtgaaaccccgtctctgctaaaaatacaaaaatcagccgggcatggcagcctgttcctgtaatcccagctactcgggaggctgaggcaggataatcgcttgaacctgggagggggaggttgcaatgagccgagattgcaccactgcactccagccttggtgacagaatgagactctgtgtctcaaaaaaaaaaaaaaaaaaaaaaaaattctagacacaagctaataaattacataccaacagtacaaacctgagctactgctttttgtgttaaaaggttgaaactgataaagccactgttggatttgagagcctggaggagtgttatatggcaaagatacttgttgctgaaggtaccagggatgttcccatcggagcgatcatctgtatcacagttggcaagtgagtagtgcgctcataatttgtggaacttcattgcttggtggagtattttacccagaattgagaattaggagttaaagactattttttaagactacttttgtgaaagctgaatctgcccattatatttatgcattctttctcttccttaggcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtgaggctcagcctctgagtttttgctctaggtgattacttacttactcactttttttcatagatggctactacatcttggaaactgacattaaatgtggttaggtcttgtcatttgggagtatataggtttaaacatgaagattgacaactattcttcctggttgttatttccagttataagaacttgaacagttcctgtaacctttctcagcctcagtgtagtacacagggtaatgcgtggcacttttcattcaagaacattacattacagattttgaggatgatttttactaacatctattccctgtataattagagtttatagcaggctgtgttagtctgttttactttggcatgaagaaatacctagggctgggtaatttataaagaaaaaaggttcatttggctcaaggttctgcaggctgtacaagaagcagggcgccagcatctgtttctcttgtggccacaggaagcttacaatcatggtggaagttggaagggaaaggggaagggtggtgtgtcccatgagagagggaacaagagacagaggggagtgggtaaccaggctctttatagcaatcagatttccccttaactcattaccatggggcatgcagcaagccattcacgagggatcctcctccaatacccagacacctgccaccagaccccatctctaacattggggatcatatttctttttttttttttccacatacaaaaaaactttatttacacagtcttggattctgaatctccagtacttccagggtctcttgatcaaatggggcagcagcaggcagggaagcaaacacaggggccagtccagattatcttactcaagaacaccaccaagaagggaaggcctaattcagtcttggtctggactacatctccccgcactttgagatcaccacagtagtttgggcttattgttggggcctgtgggaacattctgaatctttctcatcactagaagtccatcagtgatttttccaaacattacatgcttcccatccagccaatcacacttagagcaggtgataaagaactgacagccatttgtactgggaccgctgtttgccgtggaaagcaggcctggagctgagtgtctaagtttaaaattttcgtctgcgaatgtctcctggtaaatactggcgactccagtaccatctccattaacaaaatctccaccctaaatcatgaaatcctttatgaccctgtggaaagtgcttcctttgtatcctattggaaccccatcttttctgaattctctagtgcagaactacccaaagttctcggtcgtcttaggcacaacgtctgcagagagctcgatctttgtgcggccaacttcctgactgccattgctgacatcaaagaacaccatggggttagcagggcttgaagttgccaccaccatggctctgacccggaaacggaagtcgggggatcatatttcagcatgagatttggaggggacagacatccaagctgtatcataggtgtcaagtgctgtctgttgaatgaaagtccccagttggtgttcttttgacatgtggtgatctattttccaagagtgggtgaagtagtccaatagtattaataaatgagaaaactgacaaaagttaagtgtaagatacacatatgtaatagtgttgcatcaaagttgaaggcagtgaatgtaatcactgttgattgtgctaactaaatcagtttctaagaaactaagtcagtttattaggtattagggttatcgtctgtatatttgtgtgctttagatgttaaaagtggataaaaatccagccgtccttttctaaataattctgactggcatttctccttaatctagtttatttgtagaaatttttgtataggaatctttttctcctttggaaataatgttctactccatggtctgttagtaacaatcatttaggattttttgccaggtgttcagttcacacatgtattacatgctgttcggcaaattctatctcatgatgtaagactgacttaattttcctctactttgtgtctgtagctttgtgtgcatgtgttagggttttaccttaattattctttaagatactgaattggattctgaatctctgatagtattctttaagatactgtatagagattattggcttcactgtttcttaagaagcagatgaagatggcaaattctgcacaaaaaaagcacttacaattttttttctaaggcttgtcttactttcccctctctggaaacatcttcaattgaagttattttcctctccgcataatcctgttgctaatcagatacagaagacaaagaggatagcaaatgaaaccaaattcagtggatacacaagccatataaatagtaaagcaattttacatttagataggcattctgatgtttggatattattggggtggaaatggctattataaaaacagggctttttttacccctggttttttatttttatttatttattttttgaaacagggtctcactccatcacctaggctggagtgcagtggcatgatttcggctcactgcaacctctgcctcctgggttcaagcgattctcctgcctcagcctcccgactagctgggaatacatgcacataccaccacacctagctattttattttttgagatagggtctcactcttcacctaggctggagtgcagtggtgcaatcttagctcactgtagccttgacctcctggctcaagccatcctcccacctcagcctcccaagacgctgtgactacaggcacgtgccaccatgcccagctaatttttttttttttttttttttaagagatgaggttacatcatgttgctcaggctggtcgtgaactcctgggctcaagtgatcctcctgcatcagcctaccaaaatgctgagattataggcatgagccaccatgctggtctttcctgttttttttttttttttttttttttttttttgagacagtcttgctctgtcaccatggctggagtgtagtggcacgatcttggctcacggcaacctctgcgattctcatgcctcagcctcctgagtagctgggactacaggtgggtgtcaccatgcccagctaattttggtatttttagcagaggagggggtttcgacatgatggcccggctggtcttgaactcctggcctcaagtgatccgcccctcccaagtgatccttggcctcccaaagtgctgggattacagatgtgaacagctgtgcctggcctcctgttttatttttttgaatgatcatcatgccactgcactccaggctgggcaacagagtaagactccatctcaaaaaaaaaaaaaattatcaaataaaattctgtgtaagaattctgtgtacatatattatatacaacaagttgttttgaaatatgtatatattgtggaatggctagattgagctaatttatatatgcattactttatagacttatcttttaggccacttaaaaatctactgtcaggaatttacaagaatacaatacattgttattaactattgtcaccaaataatgtttttttttttaatatggaatgcttcacgaatttgttgtccttgcgcaggggccatgctaatctctatatcgttccaattttagtatatgtgttgctgaagcgagcacagaacagttcttaatattacgtttttatcttggaaagatatctggtaaggttgggacaaatgcagtttcctgtgggtaaaaaataggtagatgctaagtacagagcgcagtaaaattttaacagaatggtttggaccaaggtcattttgtgaaaatgaaaaacttcttggttaaaaaaaaatgaagtctgggcgcggtggctcacgcctgtaatcccagcactttgggaggccagggcgggcggattacttgtggatgggcgttcagagaccagcctggccaacatggtaaaaccccatctctacaaaaatacaaaaattagtgggcatgatggcacccgcctgtaatccagctactcgggaggctgaggcaggagaatcacttgaaaccaggaggtggaggttgcagtgagccgagattgcgccattgctctccagcctgggggacagagcaagactctgtctcaaaataaaaataaaaataaaaatagatgaaaagatgctccatacttagatgttgagaaattaattttgactgtctgaaagaaatctttcccatgtgcttgttgcatttaacttggagtgtgtgttagagtgtgggcgagagtataagagtatgggtcagagtatgagatttgaaggatgatttacctggtgggaagctattgaggtgtgaagcttttgctgtggtgagtatttggattatcatagtcaccatcattctatgaaaccacataagtctgccagacttttattatgtagaagtcttcctggtattaagcaataatatgtgtttgtttctgcaggtacttcttcctgccctctctcccaccatgaccatgggcacagttcagagatgggaaaaaaaagtgggtgagaagctaagtgaaggagacttactggcagagatagaaactgacaaagccactataggtgagatttcttcagctcttaatggttgaggcactgagtttcccaatgaggaagaggattgccattctttcctataatgagtgagtgataatatgaaaactttataattcttaggattcattttctgggacagaatattttatttttatttagttatatgtattctttagtttttatttatttatttgtttatttgcttatttttcagacagggtcttaatctgttgcccaggctggagtgcggtggcaagatcatagctcattgtagccttgaactcctgggcttatgcccaaatgatcctcctgctttagcctcacaagtaggtaggactacaggcctgaaccaccacacctagctgattttttaaattttttgtagagatggggtctcactttattgcccaggctggttttgaactcctggctcaagcgatcctcctgccttggcctctcaaagtgctgggactccaagcgtgagcccctgttcctggcccagcataatttataacaaaaataatgcgtagtcagatttgtcagttccatcctgtgctcactgaatcaaaggcaatcaatctgtcaattcacagattatttttaggcccaagtttgcttcttggccttattatgttactgagaagctatatcagaattgctgctgtctaaactaggcaaaggaagtcaagaagaaacaggagaaaatcacttccatggcaggataatagcaaagaatttaagatgactttgagggaaaactgaaaccagggttgagattgttttcatagtttgagaatgactgatagaatgtatgtgtgtaatatatatatgttcagatatgtcatatgtccacatatctccttcttaattcatttttaggctaaaaaaacccatatagacaataatatatttattattattattttttttttttttgagacggagtctcgctgtgttgcccaggctggagtgcagtggcgcagtctcagctcactgcaagctccacctcctgggttcacgccattctcctgcctcagcctcccgagtagctgggactacaggtgcccgctgccacgcctggctaattttttgtatttttagtagagatggggtttcactgtgttagccaggatggccttgatctcctgacctcgtgatccacctgtcttggcctcccaaagcgctgggattacaggcgtgagccatggcgatttgtagtattatgaatttcttctctctgcacccccgctttttcttttttttttttgagacagagttttgctctgtcacccaggcttgagtacagtggtgcgatcttggcttactgcagcctccgcctcctgggttcaagcaattctcctgcctcagcctcccgagtagctgggactacaggcatgcaccaccatgcctggctaattttttgcatttttagtagagatggagtttcaccatgttggccaggctggtctcgagctctttaacctcaggtgatctgcctgcctcggcctcccaaagtgctgggattacaggcataagccaccgcacccagcctctctgcttcataatcaccaccaaagggaagcctttcccaaagatgtaatgggaggtactgggcatcctctgccttggttgttttcagattgtgttcttcaaatcccatcattcctttaaggcaccttgaggcaaagggggaattaaagagcaggaccttacagccctgcctccctgccttacttccagcagagcagttcttttctatctttttgtattttgtgcttccccataaattttatttgaagaaaggattctgtttcttaaaaacacagaaactttggaaacagtagttctgcttcaccatttaacttgaataccagtgtcactatagagactagtcactagagaagtgttaccttggttgaactttgaagtctattgtggcccaggagccttttcattttaaacacttcttttttttttttttggaaacagagtctggctctgttgtccaggctggagtgcggtggcgtgatctcggcccaccacaacctctgcctcctgggttcaagcgattctcctgcctgagcctcctgagtagctgggactacaggtgcatgccactacgcccggctaatttttgtatttttagtagaaatgtggtttcactatgtgggccaggctggtcttgaactcctgacctcgtgatctgactgccttgtgcctcccaaagtgctgggattacaggcgtgagccaccaccgcacccagccttttttttttttttttttgagatagagtcttgctttgtcgcccaggctggagtgcaatggcatgatcttggctcactgcaatttccacctcccgggttcaagcaattctcctgcctcagctgcccaagtagctgggattacaggcgcctgccaccatgcctggctaatttttgtatttttagtggagatggggtttcaccatgttggccaggctggtcttgaactcctgacctcaggtaatccacctaccttggcctcccaaagtgctgggataacaggcgtgagccaccgtgcccagccttaaacatatatatatatatctccagacttaaacatatatatatgtgtgtgtatatatatatatgtgtgtgtatatatgtgtgtgtgtgtgtgtgtgtgtgtgtgtgtgtgtttttttttttttttttttttttttttttgagacggagtttcgctcttgttgcccaggctggagtgcaatggcacgatctcggctcaccacaacctccacctcctgggttcaagtgattttcttgcctcagcctcccgagtagctgggattacaggcatgcgccaccatgcctggctaattttgtatttttagtagagacggggtttctccacgttggtcaggctggtctcgaactcccgacctcaggtgatccacccgcctcggtctcccaaagtgctgggattacaggcatgagccgccgcgcccagcctaaacatattttttattgggtattctcagctgggaaatggaaggattcatcaaagatgtgttcatcaaggagaggcacaacagtacagaaagccaatggcttcttttagttttacttttgcaatcctaaatgtttaagttctttgcaaggaaggcagtagttgaataaaatataagttgtcaacaccatagaaatcccagtaaagctgtaattctttacattgaaatacttggtataatatcaagtataacctctttgaaaagttccaaagatgcttttagggctgaaatccaacattagtatctaggttggtagctcccttaattaggcatgtatgtggttcttatctttagcagcatagctgacaccatcttagagtcctgtgagtctgcatggggactgtccttggagattttttaataactttgagaactaaccactgtctgtaatctttcatagttttattgaacagatttttatttggcatttactttgtaccaggttgtattatttctaagaacttgaaaaatattaatctgtttaaatgtataacatcccagtaccaatccagtgagattggtactattattatccccgtattgtaggtaaagaaaccaagacacagaaggttaaataggttgcaaaaaaggctatatagctagcttgaatgagaaaaatcactttacttaaaactgtgctgtgagtttggagggatagtggaatctcttaagtcccataatgttttttctttctatttaaggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtaggtatgcttctagaattcaggaaacacttaccttgttcatctctaaattaaggagttttgattagatgatatcctaggttccttccacctccaagattctatgactgaggagggagatagtttattaacatttgtggagacctatagtgtttgttgtactgcactgttcacctaatggttgatagtttgggccttgtagcttttttcttcctgctatctagagtcctgctgagaacaaagctgagtgacatgttctctttctgctttagatacagataccatgcttgtggaaagtaaggcttcattgccccaccctttttttttttttttaagagacaaggtctcaccctgttgctgaggctggagtgcagtggtgcaatcatagctcacttcattgcccatttattattaaatatactgaataatctctgtcacttgaaatcctcttgttattgacttagtaggtcaagcatatatttgtgatacagtggaaccttgacatgacttgttttgcctagaatttattatatcaccaaatacttgatacactatataactataacctgaacttgtataactccaaccagagataacactgacagtgaagcttcagtgattctcacagatgctagaatcatgtgagtttaaactaggtaaacatttctataagagaaaagttgatttctgactactgtacatttgtgggaagctggcaagtagcattgttgttggatttcttttgttgttgttgttgagacggagtcttgctccgtcacccaggctggcgtgcagtggcgtgatcttggctcactgcagcctatgcctcccgggttcaagcaattctcctgcctcgacctcccgagtagctgggattacaggtgttagccaccatgcccggctaatttttttatttttagtagagaaggggtttcaccgtgttggccaggctggtcacgaactcctgacctcaggtgatccacccacctcggcctcccaaagtgctgggattacaggtgtgagccaccacacctggccgtatttcttaagatacttttcaacatggggccttacagcataattttatattttgaaattagctggctgggtgtggtggctcatgccagtaatcccagcactttgggaggctgaggcaggtggatcgcttgaggtcaggagttcaagaccagcctggccaacatggtgaaaccccatctctactgaaaatacaaaaaattagctgggcgtggtggtgcgtgcctttaatcccagctacttgggaggctgaggcaggagaattgcttgaacccaggaggcggaggttgcagtgagccaagtttgcgccactgcactccagcctgggtgacagagcaagactctgtctcaaataaaaagaaaaaaaaaaaagaagttaggataattaaaaataaaaatcatgttggtgatgtaaaagaatgcgaataaagaagtggtaagagattaaagtgaagaaaggctgtagaatactatacactgattggcaatattcaattctgtgcttcatgttgttatggaataaggtaactgttctgtctttgatatagaagtatattgttctcgctgttcgtattactacattatgttggttaagctggcgaaaagtacattatgatctttggaaaaatgaaagttattaatatttaattaaaatagttttaatttattaataagatgtaaacttttaatctttcagaccagtctttgaagtggtgaattaaaacaatttgtaattttttttcaaaaggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaaggtaaatctgtttctatagaatggactttataaagttaaaatttagttgaatttcctccttaagacttgcaagtacaactatgtatagccgtacttataattgggatagtagggacaatcattaataattccttcagaagggagaaatagttcttttgttgccaccacagagtagggaaacttttactgagctttatttactctgcctagaatctacccatacactttagatacctttttttttcctcttctattcatggaaactgcttgtttggtgaaagtatatgtaaaatttggttatgggacttgattatgtaataagaaacctctgttagtgcttggttgactgtagcaataagcaaagcaaaataaaatttgaagttggggtgatttggaatgacttaataaaattcatataaaacagaactagagctccctgaaggcaagggaaaacgccttacttgtctgtctgccgccaaagaaaaaatatagctttgtgataagagcatggggcctggaatcagaccacctagcatttaatcctggctttataattttctatgtaatatgttttccagtgaattacttagattgtatgtccttatgtcaattacttttctatctgtaaaactgaggtactgtacatcgtatagattgtgagagttaaatgagctataacaggtgaagtgcttagaactgtatctagcatataagtactcaatacatgttagttgtcattcatattgatattactgcctggtgcttaaataagtttttttgaattaaacttaagctaaaatttagtgtaggataactaaggtacttatttggaatggggggaagttattatgcttggaacttggtttgatggcttgtactatgtgtcagtcatttaacttaccatacttaatgtacacaacacttcttgaagtaagaattatcattccttattttctggataagaaaacagactctcagactcttcagggttcttccttcctgttaaatagtaaagttgcagtgtaactctagatttgtttaactctaaagcctgtttcttcacactaccctatcctgccttctgttttgatgctctgccatccataattactaaagaaaaatatgcttatttccccaattttctagttatgggtactcaatggtggttatcccgtatctgcaatttgctatcttgtagttagaagtcaagccaatcccaagacacaagagtagaatgttgtaaattttttggacctcagagattcttgtaatattggaagattcttttttttccatcttaatgccatttcagtagtatattgctatcatatatgtatatatgattagaatcagggacagcagtgtaagttggagtaacttttaaagggagaaaggactgggttaataattatatctaaagaatttagacaagcaaagaaggaccatttattagatattcagcaatactcgttaccttactaaagatataagtggaaaatcccttaggtatgagctgagaggagtgttaaaaaaaaaaaagaaagaaagaaaatcccactgttcttactatgcaggcagagttaggtgataaatatcatcgactgctatctacacatcagacacttgttcatcagatggataagatttcagtttcagttgcttatatgaccaacaataaagaattaaatgaacagaaagggagtatagcatagtagttaagagtgtgagctctgtagctggaatgcttgggtatgaacctcagctctttatactagctgtgtgaccttttgtgtcacaatttctttgtatataaaaacattaggtttaatggttgtgaggtttaaataagttaaccagtgcctgtacagagaaagcatatctaggtattagctataatgataataatatttttgttattaaataagatgatttgagtgctaagaaagaaagaaactcagtgatatactagtgagtgaaagggtgaatggatatatgtgcagtcatgactacttttagacaggttggttgggagatctttttgatgaggtgacatttgatttgttttgaaagataagaaggaggcagcttgagccaaccatgtgaagaactggggaaagatcattttggatagagagactagctgtacacagtctgaaatgggaaagagtttagcatgtctgaggaacataaaagaggccagtgttggccaggcgcaatggctcacgcctgtaatcccagcactttgggaggccgaggcaggtggatcacaggtcaggagatggagaccatcctggctaacacggtgaaacctcgtctctactaaaaatacaaaaaaattagctgggcatggtggcaggcgcctgtggtcccagctactcgggaggctgaggcaggagaatggcgtgaacctgggaggccaaacttgcagtgagccgagatagtgccactgcactccagcctgggcgacagagcaagactccgtctcaaagaaaaaaaaaaaaggccagtgttaatgaagcataatgagcaaagggtctagtaggagatgagattggaaaaaaacagggatgagaacataaatgaccttatagattatggtaaagagtttgaattttatttaaagtacttgaggaagccattgagaaatttaagcaaagaagtgaaataaaatgattatgttttgaaaagatcattttggttgctccatggaaatggatgaaacgtttatatagtttatgtttgacaagatccctactttttgttacccatagtccagtgttgttccctttataccatattgctttatgatggcctgttgtgccgcccaagagagatagggaaaagggtttacaaggtttcaactaactcctaagtcaggaaattcttgtgggtggctgaagcttagcataaggcaggtggtactatggatttcctcctcttgagggactgtggtgtctagatcagccttggttgtaaggggaggttatggtttctgtcttttacaaaggagagaaatctaataggggtactaccacctctgttctagagctcctagtgaggataaatacaatcctagccaactcagttttcgtaatgaaggaaaggaattgggaagaactacacacaacaagagtcctttttaaagtctgccttgggggaagatgaatcagtttgaccaaatttttcctagaagtgggccagtgtaaaaggtattctataataataactaaattctgaatctccgtagaattaaaggtcaagattatctacttgggtccaaaattaaacctaagaggctgtaggtgggaggagggaggaaattgaatataagtaaaattaaacctactgagagaactttgaagatccttcctcatgtgtgacattgcacctttttccttcatttcctttaacacgggccagtttagagccttggctactgtgaaaaagctatgagtcatagagaccacataaggaatgaatgattctaaagataagataattgcagtaaagagttattcgtgctattttggggtgaaaaaatcgacttgatttgtcaaaacaattattgttatacctgtaaattctgtataaaaggaattctttatggtcacataaatccagaacccaaatgaaatctatttcacggcttaggaatggttttttggagctaaccaggaggaggcagctagtttcccttttggagatataaactgtgctcggcattatccttatgccacatttcccaatttaaaagtaaggaagatgaaaaaaattaagtacaacttggataaaactctaaaagagaaatacataaaggaatatttgcagtagttaaaaagaaaagacccactccagatcacacactggtactctgtgtggattaaaattaatagttgacaaaagctggtatttgtaggtagcaccttaaggggtagggttaaggctgtgaacctttcagaatgtttttggtagtaaacccttaggagcttgcagtttaggatcacagcgttgatctccttggggaaccaatggtatgtcatcatgtatgtgatatttatgtctcttacagggacaggaccagatggtagaatcaccaagaaggatatcgactcttttgtgcctagtaaagttgctcctgtgagttatgtgtagctcttactttttttgcagtttgtctctacagcctgttagaccatttcatacattatttatgaacgaaatagctcaaccaagattgttttcttctaatttcagtggtttaataatacagtcatccctcggtacccatgagaggttggttccaggagcccccttgtataccaaaattcgcaaatgcttaagtctcttatataaaatagtgtagtatttgtatataacttacccacatcctctcaaatactttaaatcatctctagattacttataatattaaatacaaggtaaatactatgtaaatagttgttatattttattgcttaggaaataataataaggacaaaaagtctgtacttgtgcagttcagatgcaaccatctgtttttttctggaatatttttgatttgcctttggttgaatccagtgatgcagaacttatggatatggagggccaagtgtatttagatatttgtgtgctatcatttatatacaagatcaaagatgatatactacattgacatgtattccacattatgttttgagctagttaatcggtttttgctttgaaataaaagatttgttctttttttctttttcaaaatattttaaagtacagttgaatgagttgtttttggtgtttggttttttttgtttgtttgtttttgagacagtctcactctgtcgcccaggctggagtgcagtggcgcgatcttggctcattgcaacctctgcctcctggattcaggcgattctcatgccccagcctcccaggtggctgggactacaggtgcatgccatcacacctggctaattttcgtatgtttagtagagacagggtttcgccatgttggccagcctggtcacgaactcctggcctcaagtgagtcattgtgaggctcaagtgagcctcccaacccccttttcttaacattgtttaggataatggattagcttgtttatacttatttattattccttgcaacttaagaatgcttccattgcttttcttgaacataattttgcaaaaacaaaattattttgacacaaactggtcattgaacatactctgatacaaagaaaaatgacacttaaaacatgacttcagaattctaagtaaaaaaattaaaactcttaaaacaagcagaagtctcttttgctcactggggacagaaataggtattctataaagcttagtttttagactggacatggtggctcatgcttgtaaccccagcactttgggaagccaaggtgggtggatcacttgagcccaggcatttgagaccagccagggcaacgtggctaatttccgtctctactagaaatccaaaaaaattagctgggcatgttggcgtgcacctgtagtcccagctactctaggggctgagatgggaggattgcttgagcccaggaggttgaggctgcagtgaaccatgattgagccactgcattctagcctgggtgacagagcaagactctgtctcaaaagacaaaaaaaaaaaactgcatagtcactggcagtctttcccaggtacttacgctaagattgaatcacagttactaagagctttttctttcctcccataggctccggcagctgttgtgcctcccacaggtcctggaatggcaccagttcctacaggtgtcttcacagatatcccaatcagcaacattcgtcgggtaagagaattaccatcatctggaatcagctgttaggggcatctttaggttgtttagttgcttccatagtttttaacacattaacagaggctttttaagttgggaatattggatgattactttaagggaagttttggccaactgaatacttgaatcactttgttcctattagaagggccaggcgcagtagctcatgcctgtaatcccagcactttgggaggccaaagcgggcagatcacaaggtccagacttcgagaccagcctggccaacatagtgaaacaccccgtctctactaaagatacaaaaattagccgggcatggtggcacatgcctgtagtcccaagtactcgggacgctgaggcaggagaattgcttgaacttgggaaatggaggttgtggtgagccgagatcgcaccaccgcactccagcctgggcaacatagcgagactccatctcaaaaaaaaaaaaaaatctaggaggtgttatattatggcggagtcctccatctttcaattataataatgcttgaggtaagtattagcagagagtaaggtgaagagacaaacagagccctaaattagttaaggtcttaactcaagataattgattttttaaatctctttggtttcaggttattgcacagcgattaatgcaatcaaagcaaaccatacctcattattacctttctatcgatgtaaatatgggagaagttttgttggtacggaaagaacttaataaggtaaaagttctgaaaattccaactttctaagttataaaaattttgtctttccccaccaaacatttatatttttgtccatatattttgttacaatatatcagttggtggttactttcttgatcttgtcctttgaagcacaagattttaaatattggttatgtccacttttatcaatttttttcttctgtgcttttggtattatatctaagaaactattacctagtctaaggtcatgaagatttatacttttgtttccttgtaacagttttatacttttagttcttatattcaggtctttgctctattttgagttaattttttataggtggtgtgagataggaatccaaccattgttttgcatgtggacatttattctttcatcccagcaccatctttccccatcgaattgtcttggtatccttgtcaaaattaatcatatatgtgagaattttatttccagatttttttttttttgtagatcttgttattttttgttttgttttgttttattatactttaagttctgggatacatgtgcagaacgtgcaggtttgttacataggtatacacgtgccatggtggtttgctgcacccaccaacccatcatctacattaggtatttctcctaatgctatccctccccttagccccccacccccctacaggtcctggtgtgtgatgtttccctccctgtgtccatgtgttctcattgttcaactcccacttacaagtgagaacatgcggtgtttggttttctgttcctgtgttagtttgctgagaatgatggtttccagcttcatccatgtccctgcaaaggacacaaactcatccttttttttatggctgcatagtattccatggtgtgtatgtgccacattttctttatccagtctatcattgatgggcatttggcttggttccaagtctttgctattgggaacagtgctgcagtaaacatatgtgtgcatgtgtctttatagtagaatggtttataatcctttgggtctatacccagtaatgggatttctgggtcaaatggtatttctggttctagatccttgaggaaccgccacactgtcttccacaatgggttgaactaatttacactcctaccaacagtgtaaaagcgttcctatttctccacattccagcatctgttgtttcctgactttttagtgatcgccattgtaactggcgtgagatggtaactcactgtggttttgatttgcatttctttaatgaccagtgatgatgagctttttttcatgtttgttggccacataaatgtcttcttttgagaagtgtctgttcatatcctttgcccactttttgatggggtcatttgtttttttcttgtaaatttgtttaagttccttatagattctggatattagccctttgttagatggatagatttcaaaaattttctcccattctgtaggttgcctgttcactctgatgatagtttcttttgctgtgcagaagctctttagtttaattcgaccccatttgtctattttggcttttgttgccattgcttttgttgttttagtcatgaagtctttgcccatgcctgtgtcctgaatggtattgcctaggttttcttctagggtttttatggttttaggtcttacgtttaagtctttaatccatcttcagttattttttgtataaggtgtaaggaaggagtccagtttcagttttctacatatggctagccagttttcccaacatcattgattaaatagggaatcctttccccattgcttgttgttgtcaggtttgtcaaaaatcagatggttgtaaatgtgtggcattatgtctgaggcttctgttctgttccattggtctatatatctgttttggtaccagtaccatgctgttttggttactgtagccttatagtatagtttgaagtcaggtagcatgatgcctccagctttgttctttttgcttaggattgtcttggctatacgggcccttttttggttccatatgaaatttaaagtagtttttttctaattctgtgaagaaagtcaatggttgcttgatgaagatagcattgaatttataaattactttgggcagtatgtccattttcacgatattgattcttcctatgcatgagcatggaatgcttttccatttgtttttgtgtcctctcttatttccttgagcagtggtttgtagttctccttgaagaggtccttcacatcccttgtaagttgtattcctaggtattctattctttttatagcaattgtgaataggaattcactcacaatttggctctctgtttgtctgttattggcgtgtaggaatgcttgtgatttttgcacattgattttgtatcctgagacttcactgaagttgcttatcagcttaaggagattttggactgagatgatggggttttctaactatacaatcatgtcatctacaaacagacaatttgacttcctctttttctatttgaatactctttatttctttctcttgcctgattgccctggccagaacttccaatactatgctgaataggagtggtgagagagagcatccttgtcatgtgccaatttttgagactgagtctcactctgttgcccagactggggtgcagtggcgtgatcttggcttactgcaacctccaccttccaggttcaagcaattctcgtccctcagcctcccgagtagctgggattacaggtatgagccaccaggcatggctaatttttgtatttttagtagggacaggatttcaccatgttggccaggctggtctcgaactcttgacctcaaatgatccacccaccttggcctcccaaagtgctggaattacagccatgagcccccatgcctggcctatttccaggttcttaattccattccattaatctctgtatacccttaatgtcagtaccacagtcttgattactttagctttgtaataagttgtaaaatcaggaaacgtgagtcatctttgttcttttttctcaagatttttttttttttttttttttttttttaaagacagagtcttgctctgtcacccaggctagagtgcagtggcgtgatcttggctcactgccagctctgcctcccgggttcatgccattctcctgcctcagcctcccaagtagctgggactacagacgcccaccaccatgcccggctaattttttgtatttttagtagagacggggtttcaccgtgttagccagaatcaagattgttttgtctgagtcccttgcaattctaagtgaattttaggattagcttgtaaatttctgcattgaagccagttgacattttgataaggattgattggatgtatctgctgatcagtttggcaagtgttgccatccgaagaatatagtcttttcatccatgaacatgtagatgcccctgtattagttaggtgttcttcagtctctttcaacagtttttttatagtttttcagagtgtaagttttgcactctaaatttgcatttgttaaacttatttctaggtattttattctttttgatactactctaagtggaattgttttctagatttcattttcagattgttcattgctactatataaaggtatgattgatttttttttttttttaagactagtcaggtatactagtgagaagggcggaagagtagaaaagaagttagatttataatggactctgagcaatcaattgagataacaattcatttttctatattgatcttttttttcatatacctgctgaaatgggatctatattgaccttgtatcctgcaaacttgctgaagtcatttattagttcttacagttttttagtgtatttcttaggtttttctgtaaacaagataatgttatctgcaaatagagataattttacttttttcattttgacctgtatgccttttatttcctttcttgcctaattgctctggctggcgcctctaggcaatgttgaataggtgtagcagaagtgaacatcttgtcttgttctcgatctttgggagaataagtctttggtcattaaatagttgtgaggtttccatagatcaggttgagcaagttccctcctgttcccagttagtaagagtgttttgatcatgaaaaggggtattgaattttatcaaatgctctttctgtgtctgttgagatgattatgtgttttttgtcctgtattctgttaggacattattacattaatggattttcagatgttaatggaaatttgcattcttgggataaatcagatttgatcatggtgaatgatcctttttatatattgctggattttatttgctagcgttttgttgaagatttttacatctatattcataagatattagtgtgtacttttttttttttttcttctaatgtcgtctttggttttggtatcaggctaatcccggccttacagaatgtgtggggaagtgtttcttgctcttctttgatttttctttgaaagaatttgtgaggaattgatattaattcttctttaatatttggtagaatactgacgaagccatttgggtctaagcttttctacatgggtagtttttaaattaccagttcaatctctttgttagttataggtctattcagagtttttgtttctccttggttcagttttggtagcttgtgtctgtatggttgttcatagtattccctataattctttttacttctgtaaggtagatagtaatgtcccctatttcactcctaattttagaaattctagtcttctctcctcttcttggtcagtctaactaaacatttatcattgtggttgtcatttgattgatcttttcaaagaaccaaattttgttattgttgagatgaatgaaaatgatgacataacatactgtaacttatgggattatgctaaagcagtgcttagcaggaaacagctgtaagagtccgcatttaaaaagatgaaagaaccaatgtttggtttcatttctttctttccacctcaggatatttgtatattctctttctcttcctccttttctcacgattatacagttttactctttggtgagagaatttagaaactacagttgtccggggagggaaagcattaggaaaaatagctgatgcatgtgaggcctaatacctgggtgatgggttgacaggtgcagcaaaccaccatggcacatgtttacctatataataaacctggacattctgcacatgcaccctgaaacttaaaattaaaattaaaattaaaaaagaagaaactacagttcttcttgtctttccagatattagaagggagaagcaaaatttctgtcaatgacttcatcataaaagcttcagctttggcatgtttaaaagttcccgaagcaaattcttcttggatggacacagttataagacagtaagtataactggggaagatatatatccatcggtagttttcttgtattatttaatgtgtgagtggagttgaggggataaggagaaatggaatacagagaggcagatgacttacataggtcaaacaacttgaaaacaacacaaaaatgtttatgagttactgctttttacttttttttcttactggccccaattttcaaccttgtttttgtttttgtttttgttgttgttgttgatttattttttaaagagatagggtcttgctctgttgtccaggctggtcttgaactcttgggctcaagcaattctacagcctcggcctcccaaagttctgggatttcaggtgtgagccacagtgtccagcctgcgatattgctggatttagctagtaaaggctatagattctttgtatgagttcagcaaagggagattagtgaacaaatatgtgtaattaagttgataatgactgtcacaaagcagggttaaacagatgattttcattctcctgaactttacgggcaaaattagaacagtaattgttaataatacaatggtatagagtagtatggtactcagtgtgtctcttttatctcattcaattctcatgactatcttatgatttaagtgctttcacttccatttctagataaagaaacagactccgtgagttaagtaacttgccctgagttaataaattagtgttaggactgtgattagaaccaagattctgactcctaagcctattcgtttcttgctgtgtagatgcttctatgttattcttattctgaaaggaaaaaaacaaacttttttcctttgtactttgctgtcacacagtcacagcaccgcttctgtgaccagatgagtagaggcaggggtggggagggtttccccacacaccaaccaaacaattaattctgcagtgatttcctctaattcaattcaattcaattctggtgctgtctacctgtagatagtgtcagatcccaaagattgagggctcagtcctacaagactgccctcacttcagatgccagtcaaaagtgtaggccactcatacttgtaactgactggctacaaacttgttgctgtgacctcttccttgggtttgattaacttgctaggacaattcacagaacttggggaaacactttatgtttattataaaggatattacaaaggatatggatgaacaccagatgaagagatggctagggcgaggtttgaggtggggtggtgcagagcttccatgtcctttctgggcataccacccttccagcacttccacagttcagcaactggaagctcattaaatcttgttgaagggtcttaatagagggggctggggagaaaaaggaaaggaagaaaaaagtctttgtagagtttgatctccaggatctccagcctacatctccctcccctttcccttaggtcagtgggtagagctaaaagttccaactctctaatcctctagtcattttgacccttccagtgactggcgccatcccgaggttacttagggatcccaccctaagtatccgtcatggagcttattatataagggctcattataaataacaaaacatactcctatcactcaggaaattccggttctaggggctctatgacaggaactggcaacatggggacaaagaccaagtatatattataccacacttactaatatttattaatattttagggccgggctcacacctgtaatctcagcactttgagaggccgaggcaggtggatcacttgaggtcaggagttcgagaccagcctggccaacatggtgaaaccccatctctactaaaaatacaaaaattagctgagcgtggtggtgcatgcctgtaatctcagctacttgggaagctgaggcaggagaattgcttgaacccaggaggtggaggttgcagtgaactgagattgtgccattgcagtccagcctgggtgataagagcaaaactctgtctcaaaaaaatattttcctaataaatattaaatttaggttagaatactgctccatggcttagagtgacttgttctaacccttaatctgaggtcagttcccaggaggcaaacacaactgtttgtttttttttgttttttgtgttttgtttttgtgacagagtctctttctgtcgcctaggctagagtgcagtggcgtgatcttggctcactgcaacctccgcctcccgagttcaagcaattttcctacctcagcctcctgagtagctgggattacaggcatgcgccaccactcccaggtaatttttttgtagttttagtagatatggggtttcaccatattggccagactggtcttgaactcttgaccttgtgagccgcccaccttggcctcccaaagtgctgggatcacaggtgtgagctaccacgcccagcccttaaacacagcttttaaactattgtttcttctggtatttatttacctgcagatttccaaataacatttttctgttgccttttatgagtttttcatttattttactttattgactgactccccgttaaagaacattaatatttagctttagctccagtcttgggactagagagaaaaaaaaaggtaggtttgttatgcccttcctacatacacacacataacaccatcttcccaaattgattgtagcacaaatttggattaaatctatatttggggccaggtatggtggctcacacctgtaatcccagcactttgggaggccaaggcaggtggatcgcctgaggtcaagcgttcgagatcagcctggccaacatggtgaaaccctgtctctgctaaaaatacaaaaaaaaaaaaatagctaggtatggtggtgcgcgcctgtagtcccagctaatcaggaggctgaggcaggagaattgcttgaacctgggaggcggaggttgcagtgagctgggattgcacgcgccactgcactccagcctgagcaacagagcaagactgcatttcaaataataataataataaataaatataaatctatatttggttaatttttttagagtatgtgtgtgtgtccagtgttaatatttgaatgcctgtgacagtgattgtgtatgactaagacatgtatgataccatgaatgctaacctaattgattttaataattgctttagggaaggctagttttctacgtatatgtgaattctttctgaaactccacaagcgaggagaggagattcagaaaccattaaaccatttctcaatctgatcaaacctattgggtaaactctttgttctaacttttccttggtcattcttcatttggagaacatctggacatctaatattctttataaactgtatagttttccagggctgccattattaatgaccacaaagttgatggattaaaacaaatttattctctcacagttcgggaaacaagtctgaaatcagggtttcagcaggggcaatgcgttccctccaaagactatagagaagaatccttccttgccttttccagttctggtggctttaggcatttagtggtttgtgattgcataactccagtctcttcttccatctttacatggccttctcctctgtgtctgtattttctcttctcttaagaggacagttggtattggatttagggccactcagataatataggatgatcttatctcaggatcctaattataccttcagagacctttttccaaataaggtcacattgataggttccagggattaggacaaagacttatcttttggagggccaccattcatcccactaaacagactttagtcttcctgttttcagcattattcatactactgactcgtggagagttttctggagcctggcagaaatggcttgcttaaggcattgacagtcttccgtaattcagtcaaggcctattttttttttttttttttttttttttgagatggagtcctgctctgtcgcccaggctggagtgcagtggcgcaatctcggctcactgcaacctccgcctcgtgggttcatgccgttctcctgcctcagcctcccgagtagctgggactacaggtgtgcaccaccacgcccggctaatttttttgtatttttagtagagatggggtttcaccatgttagccaggatggtctcgatctcctgacattgtgatctgcctgccttggcctcccaaagtgctgggattacaggcgtgagccaccgcgcccggccaaggcctatattcaactattgctcctctctaaacccctcttcttgtgccattctgagttagccactgttactgaacatacctttcagttctctccttctaggatgctgtttgggctttcctgttccttgcttttagatgcattccttttccgtgctatggccaccgtgatgatcgtcacagcagcaaacattcaaggaatttatattccttaaatataaatacaggatacttaaaatctagataagaggcaggaattttttttttaatattcctttaattctcctctgtgccagcatatagacacttttttttttttttttttttttttttttttttttttttgaggtggagtctcgctcttttgccaggctggagtgcaatggtgctatctccgctcattgcaacctccgcctcccgggttcaagcgattctcctgcctcagcctcccgagtagctgggactacaggcacatgccaccacacccagctaatttttgtatttttagtagagatgggatttcaccatgttggccagaatggtctcaatctcttgactttgtgatctgcctgcctcggcctcccaaagtgctgggattacagcatgagccaccgtgcctggccgcatgtagacactttttaacatttaatttgccattttacgtatcataaaatgtacctgctctaagtgtacaatttcttgatttttgttaaaggtgcagaattacgcagtctttaccacaatctaattttagaaattttcatcacccccaaaagatcactcatgctcatttatagtaaattcttattttcaccttcagcccctgggcaatttgttatagtgcttgagtctatagatttgtattttctagaccttttatagaaatggagtcataaaatatgtggtcttttgcatctactttctttcacttaacgaaatgtttttgagactcatccatgttgtagcatgtatctgtagtttattcttttttattgctgtatagtgtttaatcgtatcaatatacctctttatcattcaccagttaacatgttttccagttttttgctattatgaatgatgctactatgagtatttacatacagttatttgtgtggacatatatttttatttctcttcagtagattcctaggagtggaatacctgagtcatagggtaaaattatgtttaatttttagagaaacttctacattatttttcaaagtggttgcaccattttaccttcccaccaatagtggataagtgttccagtttctctatgtcctcatcaatatttgttaccgtgtgggtgtgaagtgagaaccatctacttgtgagagtatctcgctttattgcactttgatttattgtgcttttttataaattgaaggcttgtggcaaccctctgtcaagcaagttgatggcaccatttttccaacagcatgtgctcacttcctgtctctgtgtcacattttggcaattcctagagtatttcaaactttattattgtatctgttatggtgacctgtgatcaaggatctttgatgttaccattgtaattgtttcaatgccccatgaaccatgcccatataagatggcaaacttcattgataaattttgcatgtgttctgactggttgatagaattgatagaattatcaaccagctgttcctctgtctctctccctctccttgggcctccctattccatgagacacaataaaactgaaatcaggccaattagtaactctacaatggcctctgagtgtttcagtgaaaggaagactttcacgtctcttactttaaatcaaaagctagaaatgattaagctcaatgagtaaggcatgtcaaaagccaagatcggttgaaagctaggcctcttgtgccaaacagccaacttgtgaatacaaagaaaaagctcttgaaagaaatgaaaagtactatcctggtgaacacacgaatgataagaaagtgaaacagccttgttgctgatacggagaaagttttgagtggtctagataaaagattaaaccaggtacagcattcccttaagccaaagcttaattcagagcaaggccctaactctcttcaattctttgaaggctgatagaggtgaggaagccgcgtaacagaagtttgaggctagcagaggttggctcatgaggttgaaggaaaggaggccataataacataaaagtacagggtgaagcagcaaattattcagaagatacagctaagataattgatatccctcatcagtcggcagccatcaacatcaaggcaagatctaccagcaaaaaattacaattcactaaaagttcaggtgatttttagcatattttagcaataaagtatttttaaattaaggtgtatacattggttttttgttagtcacgatgctattgcactcttagtagacaacagtgtagtgttaagcataacttttgtatgtactaggagatcagaaaattcatgtgactcgctttattgcaatattattttggtggtctggaactgaacctggaatatcaagatatttctatacttagatgaagaaattgaggttgtctgttaattctaaccaaacaccattcatttacttgttcatacacccattcaacatttatttaacatgtactgtttactggattcagtggtgaacaatatagggaatactgtccttactgtctcaaagggaagatgattgaacaagcaatattgtaataatttattcaagaaagcagtatttgctgtgtgataccttggctacagttctgtggtaattaatgagtcatacacggtatttttattagagcaggttcctgtgtttgtttgcaagtgacaaaatcctgctctagccaacttaggcaaattgggggatttggtacccactgatctttttggagcttgtgcctagaaagagctggagttctttggaggcagagctgtgcctttgtttgaagtcttaactttttctcgattgcagaacactagcaggggcccttaggcagaccccaaggagaccacggataaaatccatgaatccatgagcttgtgaacttcagttggggtgggggaaggggggggtggggggggggaatcacctttttttttttctactaacatttagcatttcttccttttataaatgtagagaacagatcaaatgttaacagtacttgtgtctggtgaccaataaaaatcagttattttcatatcacattgtagttgtatatatctcaaaatgttattttgttcatccctgcttcaaaatgatagccattattagacctgcaacaagatcttattattgagtgaatacagaagcacatttgtcataattttgcttttgaaccgtttgataactgaatttcagtatagtttctctcttttttctagtaatttgagtattttcagtgttaaaaaggtattctgagataagatccagatgcatagggacacattctgtagaaaagattgggactccttgataacagaagatctgatattgtgtaaaaaaaaaaaaaagattgggaccccttacttttacgttcttctgaggtaccaccacccatgtatcctgagcactcctatttcttgctacaatgcagttctttcccttcactcttcctttcatctgctcaaactacttgcagagactcaactgcagccaatgtacgtccactcaaaatccaaggagttctgattggtggggttttctttcagctgcattcacgtgtcggtcaaggcagacggcaggggatgttagacgatatgtgcgaaaccaacctactgctgctgacacatttctcattcttttttttttttttttttcttggcaggcggtggggtcaggggcaggggcagcgttgggggatggagtctcgctctgctgcccaggctggagtgcagtggtgtgatctcagctcactgcaacctccacctcccaggttcaagtggttctcctgcctcagcctcctgagtagctggcactacagctgtgcaccaccatgcccagctaacttttgtatttttggtagagacagagtttcgccatgttggccaggctggtctcaaactactgacttcaagtgatccgcccacctcagcctcccaaagtgttgggattacaggcatgagccaccgttcccggacctctctttgatttttaataactacaagtcaaggagagggcacagcaaaatgtaaaaattaggatagacatcttaatttttgtctttggctgaacaataacacacattggttcaaaaaatttttgaagtaaatataaatattcttgcttaacctggcacacaggctcttaataaacagttttttattatatttatttttctttttaaacagaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccaggtagggtattaattattgctttctaattatgttatttttaaggtttgcataatgcatttattgcatttttcaccttttgattctgtcacgtaatttttttttttttttttttttttgagacggagtctctctgtcacccaggctggagtgcagtggcatgatctcggctcactgcaagctccgcctcctgggttacgccattctcctgcctcagcctcccaagtagctgggactacaggcacctgccaccacgcccggctagttttttgtatttttagtagagactggttttcaccatgttggccaggatggtcttgatctcctgaccttgtgatccgcctgcctcagcctcccaaagtgctgggattacaggcatgagccaccacgcccagcgtaattcttttttgaaacagagtctcactcttgtcacccaggttggagtacaatggtgcaatcttggctcactgcaacctccgcctcccaggttcaagcaattctcctacctctgcctcctgagtagctggtattacaggcatgcaccactgcacctgactaattttgtgtgtgtgtgtatgtttttagtagtgtcggggtttcaccatgttggccaggctggtttcaaactcctgacctcaaatgatccacccgcctcaccctctcgaagtgctgggattacaggtgtgagccactgtgcctggcctgccacgtaactcttattgacacaccgttctgaaaataaagtaaaattcaatcatatatccaaaagaagatattgtttgaaaataagacattttccggctgacatttttgttcatattgtaatggttgtatatcttcagtaatgtgtattccattcaggcctttcttaagaccttgcacctttttagcttaaggtcttttcacagaacatttgtcaagttttctgatttatgttgacaaactataatttatttttaattttttttcctctagggtggcacttttacgatctccaatttaggaatgtttggaattaagaatttctctgctattattaacccacctcaagcatgtattttggcaattggtgcttcagaggataaactggtccctgcagataatgaaaaagggtaagtgccaaaatggaggggaagtcgtaagctaatttttattacactgtacacttgtcctgtggtatcctcaggggattggctccaggaaccccctcaaatatcgtgatccacaatgctcaagtccctgatatgatatgatgtaatatttgcatataacctacacacattattctgtatactttattcttgacttataataatacaatacctaaacagcacttcattcacatggatccagtgtagtgcccggtgtgcagcaaattcaagttgtgcttactggaaatttgtggaattgtttactttctggatattttgatccatggttggttgaatctatggattcggaacccatggatatatggagggtcaaccatacctgtttttgagtatcagtgttttttttgtttgtttgtttgagatggagtctcactcaccctgtcacccaggcagaagtgcagtggtgccatctcggctcactgcaatccccgcctcccaggttcaaataattctcctgcctcagcctcccaagtagctatagctgggattacaggcatgtactaccacacttggctaatttttgtatttttagtagacatgttgtttcaccatgtaggccaggctggtcttgatcctgacctcaaatgatctgctcacctcagccttccaaagtgctgggattacaggaatgagccagtgtgcctggccagagtctcagttttatatatagttattggcatgctatattgtatcttcaaataaaattatatatatataaaaaatacgaaattcttcaaggcagcaactttactaaatgcagttagtcctatttgaggtggaaagccttatttattctaggtgaggagtcagcatgcttttttttagttgtatagtaagtattttaggctttctgggacatatggctgctgttgcaaataatctgccattgtagtatgaagggaggcataaacaagacaaatgaattgcagtaaatctttacctaataaaaacaggcagaggacaggatttggcccattgcccacccatactccaggtatctggtctgtttcttcaagctataaatttgagctaaaggtataggagactggaagagtagataggaagtattacctggttgggattatagggtaggagtgagcatttgggtggttactggctgaaatgcagtattttctttcagaatatctaaaatgtctttatctttttctaggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcagaaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaatt

SEQ ID NO: 37496 - DNA, 3912 bp, Homo sapiens; identical to SEQ ID NO: 36332

SEQ ID NO: 37497 - DNA, 104955 bp, Homo sapiens; identical to SEQ ID NO: 37014

SEQ ID NO: 37498 - DNA, 17820 bp, Homo sapiens; identical to SEQ ID NO: 35685
